United States Patent 7,868,149 (PLANT GENOME SEQUENCE AND USES THEREOF) - sequence listing, part 19

SEQ ID NO: 9066 - DNA, 806 bp, Oryza sativa
aatccttaatatactttgacggacaggtacttcaatactcttattatatgtaattgaagtcttgaagatgacaccttggaaagactatatatataactagctaattcatgatacgaaattaattattatacccacaaccctgttcctatcatatggcatactgactaaatgctaaatgctggctaaatgctgagcttgaagagaaaagagaaaagagagaggagaagcgggctgtaaacttacagctagcttgaacaccagaaccaagaaattctgtgagagagacaagtggatcatgcattaattataaagagctaactattatataggtagattaagagaatgctaaaaaaaaccttatagccagcagatcggctatattattagcctcgctctaacacccctatcattaaaaactaactaccgcggatagtaattacccccatcacatgagatttgagctagactcatatttcaatcgacatgcagagaaaacaatccacagatacatgggaaattccgtcaacaaaagtgaccaacgcacaaattaaagatatgctatgtgtgtctgagattttagggtattcctaatgtttcatgacaataaagatagcttacccgataaggaaaaagtacaaattaaccccctccccccaactatcgtggtcgacggaattacccctgaaccttaaaaccagacattactcactctgaactttcaatacggacgaattacccccctcgagccaatttagagcggaattgtcctacgtaatgtacgcgtggcaatccagtcaacattttct

SEQ ID NO: 9067 - DNA, 425 bp, Oryza sativa
cttgttgacttcttggtcatgtcagaaaagtttccatccttgtcctcatagaatcacttctacctgtggtcatctcgcttactcgcgaattcatctgctttgatgacagggtggctattgtagggtcaattgctatcgggagtcttcctcgagtgacacaaatcatggttctcgttatcctttatcaatcaactttcgacctacttattttccctgtaaccaaacatttttttcgatctcttccattaatcacctttcgacctttttcaaccaggtacttttcactccgggtgttgaggatgcttctggggcaatgaggtccttgggcgtgctgtctttcagagaaaccttgaagtagtttgtcaaaaggtagactgacaattgttgcctttgatccgaagaagacacatctgaaacttttagtc

SEQ ID NO: 9068 - DNA, 1657 bp, Oryza sativa
  unsure (1)..(1657): unsure at all n locations
nnnnnnnnnnnnnnnnnnnnnnnnnnnnnnnnnnnnnnnnnnnnnnnnnnnnnnntttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcaacaagacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccacgcaccccgagcccagcctaaaaccattttggggattttgaatagaaggagcggtgtgaagccaattccacaataaccaaaccattccaaagtgtccaggtgatatgaatattcccaaagtctagagttgaaaaaccacctagtgttacctaattaaaatagcgaagcatctacctaaaatcatgctagtggtaccatgagaagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggtgtcgcgtcccaaaacgactctaaaatacatcctcaaaattgtgcatagaataagtaaaatccatgtgaaagcctccaacaataaaaatgtgcaaagttaaaagtcgaataaggcttggaggatttttgtatatttcctaaaagcctaaaatgcgtaaataaattttagtggaattttcagagcacaaataataattaagaagaaataaacaaagttaaaaaggttttataaaaagaaaaaaaccctaaaaagtctttttcccccttccccctcttgggccggctcggcccagctccctccctctctctcctctcccccgcggcccattcggcctttccccgcgcgcgcgccgctgacgggcgggcccgcccgccaccctcgctgacgggtggggcccacccgtcatcccctacctcgcgccgcaaccgccgcctcgcccgtgccctagcgccgccgccgccgggatcaccgcatcccgccgcccccgcgcgcaataaagagggggaaatcactccccgtgattccctctccctttccccccacttttccctctctctctcccgttcaaacaggcggatttgcccccgcaaatctcgccggcgccattgatggagcccgagagcgccgcgccggtttccttctcctccggccgccctttctcactcccaaccctatataaacactccccgtgcctccct

SEQ ID NO: 9069 - DNA, 620 bp, Oryza sativa
catgttattcacattgctagcgagaataaagagcttaaattgctatcttctttaaatacttggggctatattcaatttgatgatgtttgtccactcaactgcttacagaagaaattatttgctagatttgaattgccatgcccttctgatgtgatttttcatgttattggcaattatgatagtaaaggagaatataatgtgcatgaagtatatgtttgttcgaatttgactatacctccttttcatgatgaaatgtattgtctagaggaccgcatgcgtataagtaattctctatctagttcctctagttgtttaaatgagctacaggttggtttgcaagaagaggagtgttgtggtttttcgactacaaagattttaggatccaaccaaatggccatcaagaaatgttcctcaccagatgttgtgatagataaagataagttcaatacgctccatgacaaggcgaaatcgaggacgatgaggatgatgaggacacaactagcttagatataaccatgaataccttatgtattaatcaaccaaaggtacatatgttctatgttgcaggtacgtcataagggccttcggccgacctgccgaaaccatccaaaatagcaaac

SEQ ID NO: 9070 - DNA, 2138 bp, Oryza sativa
aaataaaacagtggtaacacggaaatttgaataaagtagtaatgcaataattcaaatcaaaatagttttataaactaggattcaatgtgctcaaggatgatgcgacttgccttgctcagagagaacggccttccgaaccttggcgacgaccgtgaaccacgcttcgggaacctccggaacgacaggagctacgcgaagcacacaagcagagctaaaccctataaagaagcaataacaatacataaaaagaaagcacagggttctttaggttataacaaacattaggagacttgaacgggtcaattcagagttcgtatgaccaatgtatggtcatccgaagtttaatgctgttatatggagatttgcggattataataattaggttttgcaactacaaaacatgtgtaagcgctagcctggaaaagacaggaaggctgcgccgttgacatgcggactccacatgtcaacctaaaggaccgcggtaggccgagtacatagacacggtccacgggttgacggaagcggaccccgtgtgtcaaccgaggcgagtggccgacaagcggactccactagacaccacgcgggctgcacacatgaaaccacgcggctaccgagcgggcacactaacacgatcaccacacgcacaaacgaacgactaccgacaccggtacatgggtaccggggtcgacaaccacacgacgggtacggggcaacaccgaaaggacgaggacgggagcagcgagaggagagatccttaccaccacgcgacgaggcgtgggaacgacaacgacgaacgagcgcggcggagacggctcggggacgacggaggcaaacggcgagggaatgacttcggcggtgatccttgcacgaaggcgagacgtggccggcgcaacgcttgacgacgcggaggcgaggacgaagacgacgacggggctgcggcacttgacggagcgaggacgacaaacgagaacggcttgacggagggacgaacgccacgacgaccgggaacgacgagaggacgacaacgacgatgaccagggccggcgaggagacggcgatggcagccggcagcagctgcacagatgcgaggacggcgtggaacatgccgctgtgatgatgacgatggtggtggcgcagcgagacgatgtgccgggcgaccgacaggacgtcgacgtcgaggacgaacggtgacgacgacgacggacagcggaggggttcggatggagggaaggcgatgccgaggacgtcgtcgccggctcgccgctgcgatgccggaggagacggcgacgtcggccggcgcacgggaacggtggaaggggttgccgaaagaactccggcgaggcggagggcgagaccggagcgggcgacggcgttccggcgaaaccgagggtaggccggggtggagggcgacgcggcgatgtcgagggaggatggcgacgacgacagtcgctacaccggcgagcgggcacaagcgtcttgaggcggtggagtggtggcgacaccactggtcgtcgacgaggacgtggctccgataatttccccgcgaaacggaggcgacgccggggaagaggaggcggctacgaggccgctgggggtgacggcacgaccggacggcactccggcgaggagggagaggcggctggaggcgaccggcggcacgggagaaagaggaggacggcggggagaggtggtgaggccacgggatcgaacgcgggagggggctaaaactggagaacggatcgagggggttccattttataggggaggagagggagctggccaagggagaggcggggaacggtggcgaaattcgtggccggcggccgtggaatgtggccggggttggcgcgggcgttcccgacgattggggtcacgaatcaagggggaaatatgggggaaagacagaggaatcaatagggattaaaaccccctaatcaattttggaaaccctggtttgaatcgcgtggattttggggaggttggcgctagggtttgcacaggagagagagaggaaggaggccgggcgggaggaggacgacgactcggcgcgtgggacccacgcggtcgcgcgatcagcgcgcgtgagggggggtgggcggcttgggaggctggggcggctgggtggggtggcttgggcc

SEQ ID NO: 9071 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnttactagtatataatcatgtagccaataccccctaactatgccctcctggtgtttcgagagaccacctctgattatcgagttccttacgacaataagtcatggatatctgatcggaaatgaatacggaggagtacccataccacgaaaatttcttaggattatatacgaatgtggaggaatacccgtattgagttgtcaccatcagtggcccacctctactgacccgtggcatataagcccaaatagtgaaatctgataatctaagcaccgcacttacattattaaatactactctacacccttgcgatcgatatagagcaatcatttgcatgaacattaaacccacaccatttgttgacgaccaaatttggtaaattgtgaaccaggtttgacattgggatcgaggcggattcgaaaaagagatcgattcgaagaacatagtatgcatcggctgcgaaggcatcggctggagtctgcatcagctgagatggatcggacagaggatagccgatacaaccgatagaggtgatgcagccgattccgatgaagatggtttcaaggttgtttctagaatcggtcaaagtgcttcatgaggaatgccacgatggagataaagctctcggataaggcaattgtatctattaattaggatatttcatgtaa

SEQ ID NO: 9072 - DNA, 2188 bp, Oryza sativa
  unsure (1)..(2188): unsure at all n locations
gaatcacagggcaagtgctggaagtatccatggccaagccattgggagacaagaagcctgatcactcgttcaagcctggaggagctccaaattttcctcttcctccttatggtggctacatgggagatccatatggtgcttatggtggtggtggtcctggattcaaccaggtaaaccaaactaaaccaagtggtgcttatggtagggttggtcctagtatacctaaataccaaacacattctgcgagaaaatccacatataaataggtataatacatatgtataatcttgttgggtcaaatgcttcgttctctggctctttttgtccatccactaaaccctcagtccacaaaatgacccattcttgagcatcgccacttcagctacagtctgcctataaggcccagtggcccacaatgcccaacaccaaaccctagttaaccaatatccagcatctctatttctcaattccccatttccagctacccagctggcagcatgggtgcacggtcacccaggcatggcatggttactgcggtcccaagtgccaaagctgacaggtgcccagggtggcagaacgtcgcatttgccaggaggagcagctgagcaagtagtgtgcctgttgcgcactagttgatctctggatcctgtacaaggacatgcaggtagatggaggagctagcatgtgcgtcttgattctaaatcctaatcttctctgtaatatgtgcatcttgattcgaaattcgaagtttctttgttgatacgtaaatgtgaaatcaaagtatggtacattgtttttttatggaaaactgtggactgtagacaccaaaacaaaaatagaaagatctgtaaccacatcagggcatgttgtaagaacactaacattgacctgtgacggtgtatcaaagcaatccaatagactgttcacttcacatgctcccttgatttgtatgtagatgatgaagttcttagtgttgtctaatgatgataaagcatcatattctgaagttgtgaaaaatgccttgagtctgttgaagattagtcaacatatattgatagtctgttaatgttcttttatacatggatcatgatttttttgcatgaactttccatttagttattagatactacctccgtcccaaaatatatctatttatagcatagtatcttgtcccaaaatgaagctatttctccacctacctcctctcaactaattaatatcattctccttcacccactttcttttttcaatctatcacaaccttcctccaatcattcccatctactttttattacttgtgccaacctaaaaaagcgcacatatgagctgtttgttaattgtggggctaaattatactccctccatcccaaattatagggcgccgctgccccctttttaaggaaaatcaaacttggttgcttttgactaataatcatactaaccatatctatactaagtattatgcatgttatatcactagatttatattttgaagtacttctatgtgatgctaatttcatatttgttgggatcatagaatggaataaaatactagtcaaagtatattattgaagaccgtgtaaaaaaaatataggccttataatttgggacagacggagtagttttctttaatgattttgtaacacctttaaattaaattgcattgtcatctattgtacattgattttggtagttcatatactgtccttttccatgaaatatgctttaagtaactctgaatacccatgctagaaatcctgcatccaccactgcatattgacaatttagtcattgtctctatcaacatttttgttacagcctatgatatatggtagaggaccagcaccagctggaatgaggatggtaccaatggtgctccctgacggtcgtctgggatatgttctgtaagataatgctgtcctagagtcacaactcacaaacaagtcttaccatacatcttcatttcctaacagttctgtttgtaatgtcttgacaggcaacaaccaggtggaatccctcctccgcccccaccgcgtcggggtgaccggagggatggtggcagcagaggtggcgaagggagtcatggccggcgatatcgcccttactagctttttcgttcccttggtcctgccgccannnnnnnnnnnnnnnnnnnnnnnnnnnnnnnnnnnnnnnnnnnnnnnnnnnn

SEQ ID NO: 9073 - DNA, 689 bp, Oryza sativa
cagttttgtactacaatacacaaaaatcgattcaaattacagaaaacataaataggagatacatacttgaaaaacacaatttactttaaatgaaatgacaccgattgataacattgattatatcatgcctaccacaaaatacatatttttgtttgtagctcctatcttcctattgtccaccttctagttaagtggagtggctggtgcagaaagcatcgcactgcttcttgcactgatgctggcaccaaagtgcttaggagttccctcgatagtaatctactcacagtgttgaggacttacactataatttccctatccacacttccttgatcttctcagcataacaaatcgttctgctacctccttcatatcaggtcgctcttcaaccttttctttcaaacactccattgccaacctgccaatttcttctaggattaggatatcttcttcatttgcaatctccttgtcgaacattatcctcccactgttctcttgatcataggcattttggaactcaatgatgaggctacaattttcaccatatattggtggctttctacatatgactctagcagtacaactccaaaactgtatacatcactcttttgtgtaaatgggccgtcttatggaatactggatctatgtagcccatactttctacaacaacatggtgaaatctttgtctacat

SEQ ID NO: 9074 - DNA, 670 bp, Oryza sativa
tcatgttggattattgatgcctttccgtggcgatccgccggaccatgcgccgcccctgcctccgacgcatcatggtgatgtttgtcttcaacctgcttctgtgtcgcaaagtcgtttggcacgtggggttcgagaggttcttgttcagtggaaagacaggccggcggctgaggcgtcctgggtcggattggatgattttcatgctcagtatccagattttcagctcgcggacgagctgcttctccaggggggagagatgtcatgtggggattgcattatgcacggcgccgtcgcagagttccgccgacacagccgtaatgaggaacagtaatcggtttagtctctgtacagtttaggagtttgttagtcatctttatctctcgagttgttaggattctatcccttagctcccttataaattgtaagctgctttcgttggaagtaatcaatcaaagttcagattaatctagtatcagttcctgcctccccggtgcggtgccgaacaccgctcctccgcgccgacgaggtccaggaccatgtcctgttacagcctataaatacttcctccgtcgcaatccttcttccaatctcctcgtctgtaacagaaattcgatggaccgtttggataatgggaaagggaaatgatttttacctatgaaagggtactttg

SEQ ID NO: 9075 - DNA, 5662 bp, Oryza sativa
ccatccgtgatcgtttggaacaagctcaacaaacctacaagacagcatatgatggcaagcaccgagcgctggagttggcagtaggcgcttcgtttgcttcactgaccaattgcatctctagctgtcaagaatcgcggcatgttgggaccaaagttttatgggccatatcagattacgcagcgcatcggatcagtggcctatcgcctgcggctgcctccaggtgctcgcttacatgatgtttttcatgttggattattgatgcctttccgtggcgatccgccggaccatgcgccgcccctgcctccgacgcatcatggtgatgtttgtcttcaacctgcttctgtgtcgcaaagtcgtttggcacgtggggttcgagaggttcttgttcagtggaaagacaggccggcggctgaggcgtcctgggtcggattggatgattttcatgctcagtatccagattttcagctcgcggacgagctgcttctccaggggggagagatgtcatgtggggattgcattatgcacggcgccgtcgcagagttccgccgacacagccgtaatgaggaacagtaatcggtttagtctctgttcagtttaggagtttgttagtcatctttatctctcgagttgttaggattctatcccttagctcccttataaattgtaagctgctttcgttggaagtaatcaatcaaagttcagattaatctagtatcagttcctgcctcgccggtgcggtgccgaacaccgctcctccgcgccgacgaggtccaggaccatgtcctgttacagcctataaatacttcctccgtcgcaatccttcttccaatctcctcgtctgtaacagagattcgatggaccgtttggataatgggaaagggaaatgattttttacctatgaaggggttactttgaatactacccatccattttctccaacttatttcatcattgtccttcatttaatctcaatcacgctcctcattttctattatttaaacatagccgaggatataagataagcactatcgttatgtcccatttaaagggattataagggtttagttgtgggccatttagagaacgactgcgtagtagagaaattttaaggcaatcgttaatcaacaagatggtaaacaaaagattgcgacaaatttatcaatctaaactcttaaagtggcctttatactgctaatttatttattgggggatactactaatttattgttggggatgattcacttgtaaaagaggcattgaatttactccctctatcccataatataagagattttggattgatgtgacacatcctagtagttcagattcattatattaggatgtgtcacatccacctaaaatctcttatattatgggacagagagagtatttctttcgtgccataatttgctaatggaactggcaaatgatcaaagaaacatgaaatattttgtattttttattaatcatgtctcattcacattaaagtttttattatccagaactactgattaccattgttgaaccaaaataaccatcattttattgatgtatttccaggatgcagctgcatcatgattttagtttctacatggcacgttagggaatgtataacagactacactttgttgtgtggaagttagtctactgattcaataccactgtccactggctcaacctgtgcaaggttgtttctgttatggatggattgtcctattcgtacaaggcacccttcgcttgttgatttttttttatattcatagagataattagctttgaaatttcatatcattttaatttggtttcctgttccctaggaacatttgtctgaatggccttttcttttacaggtgaaaactatatatgtgaagaacttaccagacaatgcttctaaagagaagattaaggagatctttgaaattcatggagaggtcacaaaagtcgttttaccgcctgctaaggcagggaataagagagattgtggtcaagtgcattgaaggcagtttaaggaagcgaaaaaaaatatatgaaattggcgtgttgtaagaacaccaacattgacctttgatggtgtatcaaaagcaatcccatacaccgttctcttcacatactcccttgatttgtatgtagatgaggaagttcttagtgtttgtctaatgataataaagcatcatattctgaagagaaaaatgccttgagtgagtctcttgaagattagtcaaattgatactctgttaatgttttttcaaacatggatcatgattttttgcatgaactttgcatttagttatcagatatctagtaaatttgtgagatatatatgcatttgagctgttttcatccgcggggctaaattattgttttatttaattaatttctagcatctttatataaattctatgaaacatgatttaattaactccgaatacccatgctaggaatcctgaagcctcatcttttcgctgatgcttatcagctaaaatttgaattttcaaccttaaatttggagttgattttgaaattttctcattgaagtttatttttcagcctttgtttttagatttgctaagaacacacatgtaaaaattatattcacaaataattcttcgtttgcaattgcttcgtctgcatctgctactgcatgttgacattgtagttgtttctatggacatttttgttacagcctatgatatatggtagaggaccagcaccagctggaatgaggatggtaccaatggtgctccctgacggtcgtctgggatatgttctgtaagataatctctgctgccctagagtcgcaaacaagtcttaccatatacaatatcttcatttccgttcccttggtgccgccaatccagccatcacgcaatgtgatggatttgtttaactaattatgaaacaagataaaagcttagacgctgttccagcataacacctgcaatagcctaagacatgtaccgtcgtcttctttcagttatacttatgtgttacgcatgtggtgcttgtgaattgaaaacagtcgtgttcaagttttgtatctcgcggtcgcggcagcgtctgtagtggtaaaccgatgggatggaagaattatctgcatacaattggacctacctgccagtttttcttcttgtgattttgggctcattggttgctgattatataagcagtaagccagtaacggcttatttttagggataaaaaatgatttgcaagtaaaaattactacatgtgtccttagtgtgacttaaaaaccaaagctaaaaaataaaactacattgaaaaacaaaacttcaaaaccaactttaaaatcaagttttgataagccataggacgaatgatgaggctcctttttaccccatcattgctcggaaaaaaattacaaatatacttattttttcaataatttaccattatatacatgcatagaaaggaattgaaaaaaatataccctcctgccacggttccgtagctccaaaacgcgcggtcccgcgggacggtcccgcagatccaaaacgcgggaccgctgacggtcccacgcgaccaaaacgcggcaccgcggctagagcgaatttattatccgatcggactgtttagtactgttttaaacactgtttagcactgttcattaggcagtcccgcagacccattattgtgcggaaccggcatgcaaacagtgccaactagtttgtgaacagtgtcaacacattgataaaaatggctgttatggcgctgccgcgttttggtcacgcgtgaccgtcgtggtcccgcgttttggatctgtgggaccgtcgttttcgtgttttagagctgtgggaccgtcgcaggatgggtatatttttacaaatccttacaatgcagatatataaacgtaaattattgaaaaaataagtatattagtaaattttttttcatcattgctcctctgtccatgaagagtattgtagcgtgcttgccgatatgtaaggcaataggtataatttttggtacaaacaaatttggtataatttttttaaggcaatcaatctgaataaataaacttaagtcgaccaacaaacatttacatcgtctcgtttgacatttaaagttggttttgatttttttcaaaagaatgtgaaaaaattgtgaatctgaagtcggcgaggcgcctccccgtgaaccaaccaccggtgctccacggcggcctttgccgtcagcctcttcctgtcgccatctcatcaaaggcaagcagccgaaggttaacacaccgccgccgagtctgcacccctcgggccgccctccctccgtggaaggcaaaggaaatcacacatgaagatgcatggaggcggcgtgtcacgcccagaaattcccgaatagaatttcaagcagaatgtacattaaaaccctgttcaggaccggccagggtacacaaacgacaaagttgatatacagatccacgttttacaaacattataaaagtcttacataaatgcagcggaaaataaaagataactggagctaagccttgacttggtttgcagcgggaacaccactccacaggcatcctcgacggcacggacgaagtctactcctcggagaaaccaccatcggacgcatacttgaactctgagggttgggagatagagcaagaactacccactgtactcagcaagtcctaccggaatggagggtatgatgcaaggtataaccaaaggacagctaaaagagttcatttgtataaagctagcatttataaacagtaattgaaagcagtaaaacagttgtaataattagccaatattaaaccaaccactgctcaacgctacaccacgttgagatatgcccaaaccaccacctgaactaatcagttccattaaacttaaccgtggacacggctattcgaatagttttactataatcagagatgtacaattgtacccataagacacagccccacgacacgttcccatgcgttgacatgccaccacgacgtactagaaggaggccgtgacaggactcttcgcataaccccctctaaccaagcacaccacacctcaggtttcacccccactcctcgcaaggcagcgggcagtcccctctcgtgcctaggtgaatccgaaagccgcataggccgtcgtagggcccatccgaactccatcacgcccacccttgcctggatgcgtcagctagagggaagctacactacaagcccagccgttgcccatgctggcttgtggtaagtacgaggaatttttccagggtttcccgcgaaccggtcattaattgccatgggcgcatgatggcgggtggtgcatggtgctaaggcgaaggagagctcgggagcggatggcgaaagagggaaaaaggtggaggaggaagcggtggtgctttatatagggctggggaggtcggacgtggccgagagaggcggggagtggccggcgaagtgggggaggtgtggagagagggagagagaggtgggattcgttttcgaatcccagccatcttggacgtgggtgcgggctggaaagtggggcggcggttgcaggggagtgcggggcgagtgcggggagtgggcgacgtgcgtgggcacgcgtgggagaggcgggcggcggcggttgcgggcgcgggcggcgccggccggaggttgggaatgggcctgacaggtgggccccacctgtcagtg

SEQ ID NO: 9076 - DNA, 3501 bp, Oryza sativa
  unsure (1)..(3501): unsure at all n locations
nnnnnnnnnnnnnnnnnnnnnnnnnnnnnnnnnnnnnnnnnnnnnnnnnnnnnncgctatgaagtggtctgaatgtttgctctctttgagagaattttgtaataagtgattgtagcttatttgaagtaaaggcaggaatttaatccattatccaaaaaaatcaccttatcattttcaaaactatattgacatcgaaatcgtaacctaatcatgtgattttttataatattagtttttcttgttgcaatgtatgagaagatgaatgagcgaagggttgatgcaatgcactcaaattttctgggaaaaattttcgcgaaaagttttagttgtgctcttctcgacttttcctttgaagcaaccttactttcttttaatctcttttactttggacctaaattttatttgtaaagttaaatgttctcttttaaattttataaaatccttatttatttcaaactttataaaaccctcctttttatttctttcgacttttacaaaacccctccatttatttctctagcctctaaccgttgctctgggatatatttcctttggatcctttcccaaacatctctagagtacatgaaataccatctccctagagtcaacacttttcctttagagcttaccattctaccaccaattctgttcatatagaaaaattcttatgattccccatccacatttatttccaaatctagatttattaaatgttcttacttattgatggcgcgtgaatcactgatatatcagtgttgttaacacgtggatctatattattttatcattttatctaaaaataaagtaatgtaactgctataagaaatatatatctaagaaatttctttacaagctgcaatcatattttttatttatgcagtttgtgttttcccatgtaggtacacctggaaaccaagatttgtgaatatcttgaacactaaattatataatttacaaagaaatcaaaaccaaaaaaatatagaaatataaaacaccaattctaaagaaaatgaaaacatagttaccaagcattctagttacagatgggaattgagatggcacctgcaaatcgcgcatctgcacaagtggctgaaagtaaactgtcgggctttccaccgtcggaaacctgatagccgagggtaccgtcggccattcgctaattactgaccactgatcgccgatgggaaattaggccgacggtttgccattggtcactagtattaattaccgtgtgtttttgtgtatagcctacggttatctcacactaggccaaaaaagtaagaaatcttgaagtacttggttcagagtctcaattatttttttatattatttactaattcaaaatttggggagaaattaccaaaattgtcatgattgttatgtacctatatctaacaatagaaagaaaataagaagaaaaatagaaacggcaagcaaaatggtcatttggctaccatgggggatgaatagtcatggcaatattatgttattttcttaagtcgaattctcttcgtaaagccatttaacaacctacgatttttctgatcgtatggagaaaattgtctataaaatcatcaatgcaggattggataaatagtattgatcaggacaatataattttcagcagacatttcatttgatgatgaagcaaatattagttagctttgtagcttgtcaacaaacgatttagatcattagatatatagtgtttactatacaaataaaaagcttctatacacattccaagctactttagctctatgaaattcttgaatgtgatcgaagtcgtgcattacatgtatacaccattatctaacatggtccaagttccacactacagaaaatagattacacaatcttgtgctacaacaaactgcatctctgtcatagctagaaaacataggtaggagatgcatgcttgaagacataaagttatttcaatcaatggatactaatttataggataggtacgctgcacataccagaagatagattatatatatagcttatttgcttcacttccagttgttgatctatagcttgtagagttctttgcgttctggagtgcatgttgcagaaagactcacactactatttgtgctaaaatcagcaccaaaactcgtaggagttgtttcaatactaatctcctcatggtgtctaggactcaaattatagcttccttgtccatgctttctggcttttcgcaacatcacaagtcgttctgctacttccttcatatcaggtcgttcttcaaccttttcttttagacactccattgccaacttaccaatttcttccaagataaagatatcttcttccaccgcgatctccttatcaaacattgccctcccactgtgtacttcatcataggccttctggaactcgatgatgaggctaaagttctcgccatatatagttggctttctactaatgagctctagcaatacaacaccaaaactataaacatcacttttctgcgttaaacgaccagtcttatggaatattgggtctatgtatcccatgctcccaacaacaaacatggtgaagtctttatctactgtaagaagcttggatgtcccaaagtctgagatcttagggacgaacttgtctgttaaaagtatattggcaggcttgacatcaccatgtcgtatggtacaatttgtggacgagtgcatgtattttagaccttctgcagattcaattgcaatgtccaagcgtatgtctagtgtgagaaggagtgagcgattggcatcaccatggagaatgtcttgcagactcccattagcggcaaactcatacactaacattggaacatccacctccaagcaacaacccaatagcttgataatgttattgtgcatcattcgcgattgtattataacttcatttgtgaaatcctccttccgagcttcatttacctcaattgaagtcttcactgccaccattgtattatcttcaagcgtccctttgaacactttaccaaaacctccttggccaataacgtgtgaattgttctttgtgattttctttagatcatctttggagaaaatcatgatattgtccactttctgtagaattgaaccaccattctttttgaaatactcattaatttttctcttttggagcatcattagagtaaaaagtgcagcaactatcaggaaagaaaatcccaggcttatgcctacaaagatcataagttctcattagcaacgataacaaatacatttgacttgtgattttgttgttatcaacttataatagaaaataataacgaatgctcacttgagatgaatatatattactatatatcaacagtgtaatgtttatatatattatgcatgtacgactgacatgcaaaagctaaagaattgttttttttcctacgaatgaaaaatatgaaaatagttaggatatttgtaactcactaaagatcatatatggttaccaggaacatattctatgtacacatgtttgggtaccgagctcgaattcgccctatag

SEQ ID NO: 9077 - DNA, 4894 bp, Oryza sativa
  unsure (1)..(4894): unsure at all n locations
nnnnnnnnnnnnnnnnnnnnnnnnnnnnnnnnnnnnnnnnnncatctttggagaaaatcatgatattgtccactttctttagatttgaaccaccattctttttgaaatactcattaatttttctcttttggagcatcattagagtaaaaagtgcagcaactatcaggaaagaaaatcccaggcttatgcctacaaaagatcataagttctcattagcaacgataacaaatacatttgacttgtgattttgttgttatcaacttataatagaaaataataacgaatgctcacttgagatgaatatatattactatatatcaacagtgtaatgtttatatatattatgcatgtacgactgacatgcaaaagctaaagaattgttttttttcctacgaatgaaaaatatgaaaatagttaggatatttgtaactcactaaagatcatatatggttaccaggaacatattctatgtacacatgtttctcgtgcgcaccaactaacaaatatcacgaaaaattctataaaattaaacatttactcctattagtactacacatatatataaagtctcatattcaagttcattatattttagccgtaacaaaaaaaatctgacagttttctaggtaattaaaaatgtgtcagaattttgtcttttttattacgaccaaaatataatgaatttgaagataaaatttcacatataggtgtaatattattcgaagtatgtgtataatgttttgtagaattttcgtggcatttgctagttggtatgcacggagtgtgcataggatatgttcccggttactagtgcgaatactttgctccagttgatccatttgtccattgaaactatccaggcatatttgataaaaaccctaacgatatgtgaaaaagcttccatatccatttctgaaaattttgtgtatgaaaaaaaaaaattcgaatggttcagctccctgccttttcatttcaaccaaccaattaaaaaaacaacggtgaattgcatttatctatcgaacttggcttaattaatttagcatttgtgtgctccacgcagtcctttaattttagagggctgctacaaaacgggatcccgttacaacgggatagacatattaactattctcttgcacgagtatcacaggtatcaggtcctaggtatcataggtaccagataacaggtatcgcaggtatcgggtaccatgtagttgataccacaacatgtatcaggtatatgtactgtctcatagaagagtatcccgttacaacgggataccgttgtctaggttttctctggtaattttatctatttgctaccatggatgtttcagccttttttggcctattccagcggcagcaaccccagcccatcgctgtcaactcggacgacaagaaggtgcttaatttcctggatggatccactgacagatatagatggccaaaaggcccgaggcccgatggcccagcccatggcacggtattttggcccggcccaagcacggacggcccgacggaggccgggcccgtgccggcccggcccggcacggccgggccggcccggcacgatgggccggcagctaggcccgatacacaaaaaaataggggagtaaaaatagacattatatgccatgaacgaaagcatagggatctaaaatagacttttattatctatacatatgtcagccaaagaggagggacagaaaatagacttattttagctatacacatgacagcccaaagaggagggacggaaaatagacttattttagctatacaaatgaaatagcctagagaggagggaaaaaaaatagacttattttaaaaaggcccgatgggccacccatgccttcgggccagcacggcacggcccgacagctggtaaggtcgtgccttgggcaggaggtgcagcccatgggggggccgtgccggcccgatggctgctgggccgtgcccacccgtgcctgggcgggcccgtgccggccgggccctttggccatctatactgatagagaacaaagagatacagctgacttgtagggttcacgaggggtaagataaacatttcacacgtcttgtccaccgtgggagtgcaggctggcatgccatgcatgtcagcaaagagtgaaaaattacttatcataaaagtaaaaagtttggattttggttgaaattggagatgatgtgactgaaaagttgtgtgtatgacaagttgatatgatgaaaaaggactgaaatttggatccaaactttagatctaaacacagccgtagtatatgagttgtgacattttttttaaagtgacaaacagttaaaatattccccatattaaatgtcattgaagtgcagctggcatattttccactaatccgctgttataaggggctgacactgttctatcgaatgtgttaataatgtttgactgaacaaatgtcagttctgctcctgacgtttctctacaagcaatccctcactttggggcaggtgacatcctaaaacgctaatgcgagatctacatacggcggtatggggtacttattctgaacgtatacatacaaaaaaaattatacgtatattatatgtgtatgaactcctatttttttatacgccccaaatatatgtgtacgtgtgtgtatgtatgacagctctaatctacacctcctataaaattaagtatttgcaaacatatatttatcatatgaattttgttgtttatgtttcactcgttgatatatatgtaatgttttgttggaatatgtttatatatttcattcctcttaaataatgaggtgagttgaaacatttgcacacgtgatagcataattttctataaattgtgaaacaatggataattctttatcaaagtataattgtgtgagatctttctaaaatgttttgattataacaaatataataatgtaatcaaatggtagattggtagattggatatgcacttttcgatacaatattatttaaaatttgatataaaacaatgtatacgcataagaaaagtgaaaaaagaatgcatgatagataggtcgggtgggctccatgcacaatgcacaacatcgggccgtgagaagcagtggcgaagccaccgagggtgccagggtgggcctggcaccccctatccccatgcgctgcatgcaaaccttcgggtgattagccatctaatcaatacaattcgctcattaattagttgtctatatctagctatccacctgagttaattgacatagctaagggatgtggctgcaagtctccaaaactaaaaaggatgaatagaaatgatgtcatgtcattcaagtactgagtagtgttggtgctatttagtgacatggtttaaaaatgattctttttatgctacattaaagtatattcggactcggacatacactctccatactaaaataagtttaattttatatataaatctagaagaacatgttaaaatatatccaaaatcatatcaacaatcattttatgtatatattaatgcaaacgatcgacaaataactacaaaattcaaagtataatcatacgaggggcgactacgcatattagagtgaacaaaaggcgatttggtgaggccaatctgccactctgcaggatctgagcccagccgtgcttaccatatatatgcaggctgggtgggcgtccgatatagtttaatgcggagtcatctccagatgtaagctaggagttgaaatagttgactacgtgaatttaccgttagtttcttttcaggaatgactatattacaccttccttgtacatctcatagaaaaagatgctcactgtagagtattgaattaaacaattttgtttttcattaattgattttatatactccatttgttcactagttcatgttgttttgggaatacatatacagcctgccgcatagtttgatcttggctcaatcttttccatcctcttaattagggttttgctttaattattccttttatgctcttagttttctacttttgaataaacattgaacaaaagcgttaagccgcatgaattaaatggatatatcaagtatagtcttgcgagtatatatatgcaagggagcatctttaatttagtacaccgttttcaacaaattattttaggcgtctagatatttcaaattttagaatgaaacaaagtactttggttcctcctataaaagaaatactttggttggaaggcacataccgagagcaatttgtgcaggtagagggaacttttggctgcactcgtctatcttgggaccgcctcctctaggctggtaacctgtgcgacatttgcagtgataatctcctacggtgtttctgcagtccccgtggcagggatattcatccgagcgagcgcactcatcaatatctgcatatatactgttcgattcaatggcgggtgtacaaataacttaatttgaatttttttaaaaaaaattgtattggtaaacagacatagatggcatgactagcgtgggatgcacaatagtgcaaactcaatactccctctatttcataatataacacattttgatttggtattataaatgttgctattttttttaaactaattttgtcaaacgtaagaaaagtttgactttgaaaaaattaacaaaaatactataaaatggcaataccgttcaaacgatatagttgaaatcagtatgttaggtaggtatcatgatttgatacttatgagatatcatgtttgatacccgatatcaaatctagtattgtaggtaccatactgacgttattataatacccagatatcaaagtatggtatctatgagtatcgtgtttggtacctgtggtacataagatatcgtcagcacatatgagctatttcattnnnnnnnnnnnnnnnnnnnnnnnnnnnnnnnnnnnnnnnn

SEQ ID NO: 9078 - DNA, 13231 bp, Oryza sativa
  unsure (1)..(13231): unsure at all n locations
ggctggtaacctgtgcgacatttgcagtgataatctcctacggtgtttctgcagtccccgtggcagggatattcatccgagcgagcgcactcatcaatatctgcatatatactgttcgattcaatggcgggtgtacaaataacttaatttgaatttttttaaaaaaaattgtattggtaaacagacatagatggcatgactagcgtgggatgcacaatagtgcaaactcaatactccctctatttcataatataacacattttgatttggtattataaatgttgctattttttttaaactaattttgtcaaacgtaagaaaagtttgactttgaaaaaattaacaaaaatactataaaatggcaataccgttcaaacgatatagttgaaatcagtatgttaggtaggtatcatgatttgatacttatgagatatcatgtttgatacccgatatcaaatctagtattgtaggtaccatactgacgttattataatacccagatatcaaagtatggtatctatgagtatcgtgtttggtacctgtggtacctaagatatcgtcagcacatatgagctatttcattagaactgtgtagcattcggtagtaggcctaaaaaattaaaatgtctaacaatatgaaagatagcgagtaggaaagagtagattgtttgtctcgtgtacgtgttcttaccgttgcaacctccgactaggtagggggtggcctcgtagcctttgctgcacttgcagtagtattctgggccattgggggagttgacgcattccctgttgtcgctcacacaggcgtactcaggcgggattttttccctaacctccggcgcagggcaggacaataatgcggaggagttgccgccgtcgcggatcgcccagtccacccacaccggctgggtccggttgaggtcctttggaaaatctgacctctgaaagtggaattcgtccttgccaacaagaaaggcttanttgcaggggttgaagtccacctggaaatagcgtgaccactcgccgaaggtgacgacgttgtcactgaggcccggcgagatgtcgacatggcagcagccgatgccggcgacatgccgtcctgcgcgctcgacgagtcgttgcaataggagacgcagccggtgtagtagaggccggcgtaagggcctttgccatgactgtccccgttgttcgtgtaggccatggtgttgcagccgaggacgacgaacatgttgcgcttgtcggagatgcggtacacgccgttgttgttgaggtctaccgcgccgaagaaactctcggtgacgctgtcgctggagttgtagcactggtacgccaccggcagcatcaccttgacctccgggatcggcgctacaaacaggctctgcacatggatggtgccattggcggcggcgagggtcggcaccaactcgccgctgccgtttcgggttcgggtatcgcaggcgatctcgaagcccttcccatgggagcagttggggccgatgccgaacgggtaggggatgctgacgtcaccgcaccgtgtctggcaaccggcggcaggccggccggagatgctctccgcggcagaagccagaagaatcagcaggtctgcaagtagccagaatgccatgaacgcatgtaagttgtacaacattaactgggaacttatttcctagatatatgagtaggagtagctgcagctcttcctttaattagtttcccttcaataagctccaattgtctgtggcgcgtgtatttatagatagcagagctgtgtttgtccacctgctacgatctactctttccctcttaaaatactatattatagctatatatatttggtattcaaattttgttttataatataactaattcttcacctacccgttgatctaatataattttttttaaaacaagtaacatgctttttcaaaacaagtaaaacaaatatgtgcactcgaaaaacgagggaggtgaagttgggaaagtgaacttaagaacgcaacataagttcgaggttgaggagtacaaaaaagtacctaaggtagtaagtggtcaaactgaaagtataggccaaaatacagaggtcccatactccaatgggaagcattggtaaataaatgtgtccaaaatcttaaaattgcagttcgttcttattttttttaaaattataatttcaaaattaattccttttcccatcaataagtaagtacacggtacacatgacctctacgccgctcgcttgactcgatcttcgtgtacttactatacaaactgcagtccgcacccgttcaccagactggaggtaggaatgagtacatatatacattgagaaatattaggaacttaactttgaagggaagaagcatatgtatatggatatatataaatgagagatttgcaaaatatatcaagtcacttgtttttttatatcaggcaaatacattagggttaattggatacatgccaataaaaatttatcagtttcgaaatatgccacttgtattcatgtatttggaaatatatcattataattttacacatatttaaaagataccactacttacccctcggatgcatttccagaaaaaattggaccaaactaccccttttccctcttcttctttcttcccctttcttcttcctcctctcttcctgcttagcagcacggcggcaagcagcagcagcggcggagcgtgagcagcgtggtggcagagcaagaagcactagtggagaaatggtctttacccccagttcctaaccccctatactcctggttttgtaaccgagaataggaatccaggactaaagataggaatctttagtcctgggtgaaataaccggaactaaaaatccatctttagtccctattagtattaccaaccgggactacagatatatagggtcacgtcccaactgttttatttatttattgtttttttgctgcctgtatctattttcctacccaaccgggactaaagatcaaaaagtgacgtcaggtcttttaaccgggactaaagatattttttagtcccggttcctatttaaaccgggattattttggattttgggcaaccgaccaaagatggtttcttcagtagtgaagcaacgtgaagagagaggtagaagataagagaagagagaggtagaagatgagggtattttcgtccaatacatgcaaaatacgtatcttagaggcacaactgagattacaaacaagtagcagtggcatcgttacaaatgcgtaaattgtaatggtatattttgaaaccagcaaaattttaatggcacagatctaattaagctaatatattactacccggctttgtaaaaagcccagaagaaaattaataggttcttacagaatcttacaaaagtagacagcaataaacagggtaacaaaaggcttcgcgacactggggtccccagctttccatgaaaggtgcagaccataaaaaagtcctaaaacgtaacctccctcactaaccacatcctgtataggggtggaaacgagccgagcagagccggctcggctcggctcgtgaaagcttggtacaaggaaagctcgtcttggcttggctcgctacaaacaacgagctaaaagtgcagctcggctcggctcgtttatgggctcgagctagcttggcaggtctaagagaaatgaagcaacattttaccacatagaatgtgtaataaagtgatatttttctttaatatgtcatcacaacacataaatagataatatgacaatcaaaattatcattttcaacaaataaatagttagaaaaggtgtaaaacttttgcatatgacactattgtactgagccaagcgagctcacgagcggctcgtgagccggctcgggcttggctcgtttcggaaacgagctaaaaaggaggcttgggcttggctcgtttggctttcgagccgagccgagctatgtgagcctgagccaagcctgagccgagctcacgagcccaagcttttttccacccgtaatcatgtatatacgcaactggaacagaaaacgacacactcttcccaagctaccccaagtcttcggtagattgtcaaccacccgcaaaccgtccagaatgagcattactttctcatggaaatcattcaagtcagcgcagttttttattttagtagcagcctccatctttgcatcagggacagagacatgtacagacaacttgcaaaggagttttgattagtttgttttcaaacacccactcattccttgtaatccataaaccccacaacatcccagcaaacagtaccatacccacttgagatttcatttttgttttgatagctctcataccatcccagaaagatagagagacagtatgtaaattcaacaccatggcaattacattccaagcaaaatgagccaaaggacaagtaaaaagaacatgccctgtgctttcctcatttaaagacaatttacacttcttatcaagtgacttgttaatcgccacatgtaataatccattatcagatcatactcaatgaggggtttgcaaaatatattactccctcagttttatatcataagccgttttgatattttttaagttaaaattctttagatttgactaagcttatagaaaaacttagcgaaatctacaacaacaaattagtttcattaaataaaatagcattgaatatattctgatattttgtttttatgttaaaaatattgccatattttcttcacaggcttaatcaattttaagaatgtttgatatgaaaaaaaataaaaaataacttataatatgcaacagaggagcgagtatagtcaattatttactgcagctagctaccacacatgcacgaagtgaaaataattagtatgttccagttttcattaagatacaaattgtgtcctagtttttattaacacacttttcaaactaataatcggtacgttctgtgaaaaatattttatatagaatttgagttaaaatattaaatatatccatttcatgagtttaaaataattaatcaaacatcaatggtttcctcgtttcgcgtgcctaagcttagtaggactgccgaacggggccatatgttgcgatcagagttaggaaacggaaagctacatacatggcgtcgggccgtcggcacgtacggctgcaatgtggaaggcctcggcaaagtcgtcgtcggaggtcgtaagggcaaatttcgccgacggaaatcgtcgttggtggtgcccgcatgcatggctgcattattaatattgtacaataggaaaactgcgactgttacggttatgccatctcaatgtcaaagggaaaaactatactaaaaaaaaatagcacaacccaggtcgtcacagtatactactccatcagtcgcatccctccgttccaatttaacagcacttatatgtttggggcaatttcgtttctacccctactttgatgtctaatattaattttacccctactttttagggttttcgtttttaccctcgctttttttaactgaatgtttgttttgcccctattttggatggtgaagttaacggtgttaagtaattgataaaataatgtttataccctctcatgcatgttcattaattgtgttttttcccccattttatacatgtagctttggaactttatttttgagagtatattttaaattagatgacgcacattgactaatataacaatttggaaaaattctgaatttgatggaattttgacaaaatttcagcattttgatagaacttaaacaaaaatttgacaacattttgtaaaatgtaattatctgttccctttaaatattagtcaatgtgcttcatgtaatttgaaatatactcaaaaaaataaagttctaaagctacatgcataaaatggggacaaaaacaatattaatgagcatacatgagagggtataaatgtcattttatcaattacttaacaccgttaacttcaccatccaaagtaggggcaaaacaagcgttcagttcaaaaaagtgagggtaaaaacgaaaactctaaaaagtaggggtaaaatcaatattagagatcagagtaggggtagaaacgaaattttccctatatgttttcatggtcaatgtttgtctatctgttttatttgaaattattttattaatattattttattgttattagatggtaaaacatgaaaagtattttatgtatgagtgtatgacttatcattttaaattttttcataaatttttcaaataagatggatgatcaaatgttgcacttcaaatgggacagagagagtaccttggtcattgacttttggacgttaaattcgtcttactcaaaaagttggtaattattatttattttaatgcgaattgttttatcactaaaaatactttaacactactgcataaacacaaataggtgccggttgaaaacccccgcacaggtgccgattgggaaaccggcacatagtaggtggtactaatgagagaaatcaaaggtaatggttctaaaaccggcatctttgaggccccaagacaaataaaaaaagccgttcgatgtagctcccaatcacccctgaatcaatcaactcgaacacaatcgcacaatcaacttccaaaaaaaatcattatccacatcaacaaaaaaaaatccaagaaagatccggttgccgcacttgagccacatctcggccagatctagctgtgctcgacgccgtcgtcgtgggaaggtgaggggagggcgccgccgccatggggtggtaaggagggcaccgtcgaggagaggcgggcgagaggaggggggcaagtcgataaggccccctctcggcgtcttttgtgagctaaaaaagtatcctcgcttgactcggtttttccgtgtgtcagttttcacctataatataatatattataggtgtcgtttttttattaaccgacgcctataacatattaaatgtgtcaattttcttataaaacaggaacctaaagtataggtgtccgtttttctctagaaccggcacttatagtcgtaccttttttttttgtatttcagcctgcaaaggtgggaaaaacactataggtgccagttttcgctggttttagctattccagcacctataatgccgacgtatatgtgtccttttagtagtgtaagcatgattgatatcttacacatttgcacaaaacttttcaataaaatgaatggttaatcatgtgtctaaaaatcaacggcatcatctattaaagaacagatggaataattaactacatgggatcccatgcattgctgcagatgttttatatgacaatagtagaaatataattgtcagggttcggataaggcatatcttctatcctaggagtcaagagatatacggatatggtataataaggcataccttctatcctaggagtcaagagatatacggatatagtatatcctcaaatatatggaaatgatcctattgagttaaggaaattgataagttcttacggaaataatcggagatatcagagtcatactcggaggggataatctctacgaataggagatatcagagtcatactcggaggggataaggatgttgtcatatcgtgtggggtctgttgtcttcaagttctacttggagaccaagatgatatgtggtataaatagacaccccagagaggtacagggcactgaatcttagtgcaagacacccaccaccacaaaataaatccagaggactttaagccaattcgtcaatagatctcgtcgaagttctcacgacaaggatctcgtcagtaatctcgaagttttgttgttctctgttgtactccgtggtttcttctataatcccatataaactagattaggtatactaccttgcgagtggtctgaactagtataattgttgatatttcttaacgatattactagaaatataattcccagtgctgacactaaaatattcttggtatatttatggttacagatatgatccgcaagcacacggatattctattgtagcatttcaccttggagtaatctaaggtatcgtatttatttaattccaagggaagatttgataagagagtactattctaataattcatatattacttgtataaaccaaagtctaagcgtgggttaatcaattctgggtacgataaggttgacacagaagaaagaactaaggattactctgctaaaatataatataagctaagtggagaaagaataagaaaataatcattcatatacttctagtatatagatatcagtaatttacacttactagtatacaatcatgtagccaataccccctaactatgccaccagacacttactagtatataatcatgtagccaataccccctaactatgccctcctggtgtttcgagagaccacctctgattatcgagttccttacgacaataagtcatggatatctgatcggaaatgaatacggaggagtacccataccacgaaaatttcttaggattatatacgaatgtggaggaatacccgtattgagttgtcaccatcagtggcccacctctactgacccgtggcatataagcccaaatagtgaaatctgataatctaagcaccgcacttacattattaaatactactctacacccttgcgatcgatatagagcaatcatttgcatgaacattaaacccacaccatttgttgacgaccaaatttggtaaattgtgaaccaggtttgacattgggatcgaggcggattcgaaaaagagatcgattcgaagaacatagtatgcatcggctgcgaaggcatcggctggagtctgcatcagctgagatggatcggacagaggatagccgatacaaccgatagaggtgatgcagccgattccgatgaagatggtttcaaggttgtttctagaatcgttcaaagtgcttcatgaggattgccacgatggagataaagctctcggataaggcaattgtatctattaattaggatatttcatgtaatttccttagagatatatttgggcaaaagtctgccgcaaagacttatggtatcttagagtttgttagagataagtgtcatgtccagcaaggacatattttgtaatctcgggtataaatagaacctgaacccatgtaatcaaacaacaatcgttcaatacaatctccgcgcatcgccaccctttttactttcgtttatttcgacgagttcttgctttcaggttgagctgcatcggtttcgatcttcaactagaggtaaaacttgtcatggcggcttgcgttctcggggttaatgcttccatctttatgacactttaatcatgtttatgtaattcatcgagttatcatatgcatgttgcaatctatgttagttgcgctatataacttgttatcggctggtttttattgttaggaagcaatcggtagagttatgttttgttattaatttagattgtatcgtgtatctaccatctcttgtaggttttcatcatcttgcctagatttcatacttgtctttatgcttaatgctgcatcggttaggttcgatctattaagtaatatctataattatgatatttggcttgttttatgatcatcgaaagagatagtatcgggttatcagccgatcttacctgatttagctttttatcctatatgcttaattgatatgctaaatctgccctttatattaagatcttatcgcaataaagtatattaggcttctgtctgatatattctatctgttttaatatcttaatatagagtggtatcagagtattagccggtacatgctagatctatctgatcggctatgctataagcatttataatatttatgttaatgtatacttcgatctaagtgatttatactgtcttggcatggcaaccgatctatcccaatcacttggtttaaatatacatcgacagaaggattttatatagtgttaatatctacagccgattgagtagatttagtcttatcttgcttatttataactgccgattgattcacatatgacatcggctcgaagataaatgatatgtcatcggcgactggccgatcggctatcgtttatggatttaaccacggtttcttttgtctttctttcttgttgattacaggatcaaatcaactggcacgctcacgaacctaaaagcaagattttggatctgcactgaagttaagcagatcttcccagccagtgtgtgttttttcgactcaacatgcttttggcacgccgagtgggaccgataagtgacaacgatgtcaacagaaaagcaatctccgtcgtcggcaagcaagccgccaattcctccgaaaaccaagcttccgaaacctccaggaactaatctaccatcaactggggttgagtctgaggtcaatgagacaaacattattccaatcacactagacaaactgacgtccgaacagaggcatgagcttgaacagatgatgagtagcgtaaaggacaagttcatgaactcattcaaggaaacccgccaagggataattgttcagaaatacaagctgaaagtggttgctgctgatgaagttggctcaagctcatctcaaggtggtaaatgtgttgtagatgccttgggtgacaaaggtgacgggcttcaggatggtgtggttgaagatcttggcgaagatggtgctgaagtgcaagaagaacctcctaggtgcaccaatttccatgaccaagttgattatgcggtgcaacatgccttgatcaaccaatctggagagatcgtcaatacactaacaaatatgttcaaatctgtgatggttggcacgatagctgaacatcagaacacagggccagtctacttgccaagtggtgtcttcccaaattacaggaacttggtgataggtaaccaacagagtacttccaatgcaccaccagttcagtcgacggcagcagcttcgactccggcaccagctgcgccatcatcggtgcaaaggcagacaattaatcctcgtctcttttctagagagcaaccgcaacatgctggtcagaatattagtcggctgtcccaagactagattgcctcaatgttcctaccaactcagccaactgccggaccagtgttgtcgacgccgactcaacagcagacagttcagccgattcaacagtagacggtttcgccgattcaacaacaaacggttcagccgattcagcagcagatggtgcagctgataccaactgggttgagaacacctgataatcggcaaagacagcagaatgtggctcaagttattcctgagcacttggtacataatgtacaaccagatcaatcggttgcagcccaagttgttcctaagcatttgatgcataatatacagccgaatttctagaattatcaagagggtaacttgaattaccaataccaacctccttcgcctcgcatccagtaccaacaaggaggattacctcagccccaatatgttcctcaactcaatcagttcgagccgatacaacaacaggtgcaaggagtacctcaacagaggccatgggccgacttgattgcagatgtcatgagggaacagtttagacttaagccaaagaataccggaaatttgtatcggcacccataccctgagcggtttgagagggttccactgccaaaccgatacaaagttcccgatttctcaaagttctcaagacagaacaatgtttcgacatatgaacatgtcagtcgattcttggctcagtgtggagaggcatcggcggttgacgctttaagggttcagttgtttcctttgtctttgtccggatcagcattcacatggttttcttcattgccttacaattttgttcaaggttgggtcgatttggagaagcaattacatagctacttctacagtgggacccatgagatgaagctctccgatctggcagcagttaggcagaggcatgatgaaaccgcgcaagattacatccagaggttcagagaaacatatacaaaagctgataaaatttttgacttgctaattcgggagaaacatatacaacttcctgctagccacataataccatcggctgacctaagccttgacttggatagcagcgggaacaccactccacaggcatcctcgacggcacggacgaagcctactcctcggagaaaccaccatcggacgcataatcgaactctaagggttgggagatagagcaagaactacccactgtactcagcaagtcataccggaacagagggtatgatgcaaggtataaccaaaggagggctaaaagagttcatttgtataaagctagcatttataaacagtagttgaaagcagtaaaacatttgtaataattagccaatattaaaccaatcactgctcaacgctacaccacgttgagacaagcccaaaccaccacctgaactaatcagttccattaaactaatctagggtgagactaatcacggtgaatctggttgaccgcccataaccgcgggcacggctattcgaatagttttactctgatcagaggtgtgcaactgtacccacaagacacagccccacgacacgttcccgtgcgtcgacatgccaccacgacataccggaaggaggccgtgataggacccttcgcataaccccatctaatcaagcacaccacacctcaggtttcacccccagtcctcgcaaggcagcgggcagtcccttctcgtgcctaagtgaatccgaaagcggcataggccgtcgcagggcccatccgaactccatcacgcccacccttgcctggatgcgtcagctagagggaagctacactacaagcccagccgttgcctatgctggcttgtggtaagtacgaggaattcttccagggtttcccgcgaaccggtccttaattgctatgggcgctaccatcaaaaccatgcacccacagcccaccatttaatatattttaattaaccaacaccacagcagtggcactaatccaacatctggagtctatgcattaacgtaattcccccattgtgtactagttgaactaagaatggctaagcattccctaatccaacatctagtcatgttacaacccaaactagcaaagcaacaggataacaaatgatatggctgagacagtaggtaatcatcccattgtaacattataaaacgatgcaatatttaaaggaaaataatagagcatttgcaatatgggatcaatatgttcaagtgacaagcatgacttgccttgctctgcggctggaggaacctcgacgactatttcgaagtacaccagagcgtcgggagagccggaatctatgcg

SEQ ID NO: 9079 - DNA, 1156 bp, Oryza sativa
  unsure (1)..(1156): unsure at all n locations
nnnnnnnnnnnnnnnnnnnnnnnnnnnnnnnnnnnatcaaatttataacgaaatatagcaacacctttatcatctaattgcttttattaaatctagcattgaatataattggttttattaacttggtttattttgtgttgaaaatgctactatattttctatagatttgatcaaatatatagaagtttaacttagaaaaaagtcaaaacgttagagggagtataatgctagtgccaccaataatgatcatcggactccaaccttcgaacaccactcatggttggggaagtcaacattaagtcatcccgtgctgcaaggtgagtaatggcgatctacctgccttcttagttcgatctctatgttaacgttcctttgttaacactgatgcctacatgtggtgcctgccgacagtcatgctgtgagaagcctacatggtattggtctccatggtgacgatgtatattggatctattcttgctggacgtgcccgtcgctatgaagtggtctgaatgtttgctctctctgagagaattttgtaataagtgattgtagcttatttgagataaaggcaggaatttaattcattatccaaaaaaatcaccgcatcatcttcaaaactatattgacatcgaaatcgtaacctaatcatgtgattttttctataatattagtttttcttgttgcaatgtatgagaagatgaatgagcgaagggttgatgcaatatactcaaattttcagggaaaaattttcgcgaaaagttttagttgtgctcttctcgacttttcctttgaagcaaccttactttcttttaatctcttttactttggacctaaattttatttgtaaagttaaatgctctcttttaaattttataaaatccttctttatttcaaactttataaaaccctcctttttatttcttttgacttttacaaaacccctccatttatttctctagcctctaaccgttgctctgggatatatttcctttggatcctttcccaaacatctctagagtacatgaaataccatctccctagagtcaacacttctcctttagagcttaccattctacaaccaattctgttcatatagaaantctttatgttctccattcacatttatttcccaatctagatttattaaatgtcttct

SEQ ID NO: 9080 - DNA, 8835 bp, Oryza sativa
  unsure (1)..(8835): unsure at all n locations
nnnnnnnnnnnnnnnnnnnnnnnnnnnnnnnnnnnnnnnnnnnnnnnnnnnnnnnnnnnnnatctggagtctatgcattaacgtaattcccccattgtgtactagttgaactaagaatgggtaagcattccctaatccaacatctagtcatgttacaacccaaactagcaaagcaacaggataacaaatgatatggctgagacagtaggtaatcatcccattgtaacattataaaacgatgcaatatttaaaggaaaataatagagcatttgcaatatgggatcaatatgttcaagtgacaagcatgacttgccttgctctgcggctggaggaacctcgacgactatttcgaagtacaccagagcgtcgggagagccggaatctatgcgacatacaaagcaaacaatgcaaataggctataacactactgaaacagagaacaaaaccatttttaatggattctttgcattttcttgatttactgagacttgaatgggcttaaacggagcacggatgaattttctatgatatttagaagattcactatgtttttactataaaaagaacacgagtagatctgacggcgaaggcggcgcatggccgagagcatgcgcgagcggcttaagccagcccagcggtcctggcgagcggcggcgcggcgctagcggcggcggcgcgaggccgcgaccggcggcgagcggccgacggtggcgacgtggctaggcggcgcaggagagaggggaaaaggggaggggtctcactgatgacgatcgacgacggcgagtgatggaaaacgacagcgacagttggacgggctccggggcaacctagggaaacaaccgagagagattagtgagggagagcgaggcgggcaaaatcgccggccgaaggccgcggccatggcgagctcaccggcgcgcggtggaaagcggactcctacggcggaattggatggggaaggggtggacggcgtggcccgcgggcttgcgaacccgacgacggcgacggtgaggctcggcgacggctctagcggcgacgatcggcggccgaaggtggctaaagcggcggcggcgggtggtgcacggtgctagggcgaaggagagctcgggagtggatgacgaaagagggaaaaaagtggaggaggaagcggtggtgctttatataggtctggggaggtcggacgtggccgagagaggcagggagtggccggcgaagtgggggaggtggagagagagggagagtggtgggatttgtntttgaatcctagccatctcgaacgtgggcgcgggcggaaaagtgggncgccggttgcagggaagtgcagggcgagtgcgggaagtgggtaacgtgcgcggcgggcgccgtccaaaggttgggggcgggcccgacaggtgggccccacctgtcggtgtcccggagagagaagggggcgcggggcggcggctgggccacttgctgggcagaaaggggaggggaaatgggccgacggcccatttagggaaaaaggagggagaaaaagaaaaaaaaaaaaggattttccaggggtttaataattgcttgtgctcaattttaattggttaaaattatttctagagctctgaaaatttcactaaaaatcctgttagcatattttgacatgtagaacccaagaaaaaatccacatactatttccaattattaattgcatttattaaattagggtttctctcttgccattactcaaacaatttcttggggtcatttattaaaatgatttaggcttgggagaagaacttcagggtgtgacacggcgataccctgaaccctctgatggctattgcggctgctgctgctgttggtaccatatatacactttgatttttttcctatgttaaacttctttaattttaatcaaatttataatgaaatatagcaacacctacaataccaaattgcttttattaaatctagaattgaatataattggttttattaaattggtttattttgtgttgaaaatgttactatatttttctatagatttgatcaaatatatagaagtttaacttagaaaaaagtcaaaacattagaggtagtataatgctagtgccaccaataatgatcatcggactccaaccgtcgaacgccactcatggttggggaagtcaacattaagtcatcccgtgctgcaaggtgagtaatggcgatctacctgccttcttagttcgatctctatgttaacgttccttcgttaacgctcacgcctacatgtggtgcttgctggcagtcatgctgtgagaagtctacatggtattggtctccatggtgatgatgtatattggatctgttcttgctggacgtgcccgtcgctatgaagtggtctgaatgtttgctctctttgagagaattttgtaataagtgattgtagcttatttgaagtaaaggcaggaatttaatccattatccaaaaaaatcaccttatcattttcaaaactatattgacatcgaaatcgtaacctaatcatgtgattttttataatattagtttttcttgttgcaatgtatgagaagatgaatgagcgaagggttgatgcaatgcactcaaattttctgggaaaaattttcgcgaaaagttttagttgtgctcttctcgacttttcctttgaagcaaccttactttcttttaatctcttttactttggacctaaattttatttgtaaagttaaatgttctcttttaaattttataaaatccttatttatttcaaactttataaaaccctcctttttatttcttttgacttttacaaaacccctccatttatttctctagcctctaaccgttgctctgggatatatttcctttggatcctttcccaaacatctctagagtacatgaaataccatctccctagagtcaacacttctcctttagagcttaccattctacaaccaattctgttcatatagaaattcttatgtttctccatccacatttatttccaaatctagatttattaaatgttcttctgattcttcgtgaaaataccagaaggacaccattgattcttcctgattacattgtcctcttggccatgatcttgattcactggacccaatctttgatgaacagaaactcttgtctgccttagtcgattacccctattatatgatcggcttgagctctcaacgatatcactgcacccagggcagttttcaatagatggcaatctcataccttcattccagcagaatctaaagaactcacaaccccaatggggatcaaaaccatcatcgtattcttcatgatatttgtcgataatcttagccgaattcgcctgaaaaccccttgcacggaccctatcggctatttggccagctgtatgcaccatattaacaggaaaagggttatcatcgaccttcatcggctttttggaataatcaaacctaatcttgcccccctcaatggccacttgaatctgctgtctaaaaaccttgcaatcgttagtagaatgagacctagaattatgccatttgcaatacctctttttgcctaattcttcagccgatgggattgtatgaccagcaggaagttgaatttgcttctctcggagtagcagatcaaagatcttgttagctttagtaatatcaaagtcatacttctcctcttttccagaactttttacccattggcatggtatgacctttttactcctcacccattcggctgcagctatttcagaatcatcctcatcatcatccgacccatacatgtacagacaaacatgattaaccttcttagagcttttcctaacttccgcagacctatgctcatgcaaggttagcttctgtatcagttgtgacaagctatcaaagtcttcagacgagaatttctccctaatcggagcaatcataccctgaaaggccagatcggctaactgggcatcagttaaactcaagctgaagcatttgttcctcatctccctgaatctctgaatatactcctgcacaggttcatcatgccgctgcttaatcgctatcaagtcagataatttcatctcatgaaccccaccgtagaaatagctgtggaattgcttctccaaatcggcccaactattgatcgacccatacaacaaagaggaaaaccaagtaaaagccgatccatataaagataaccggaataacctaaccttcagagcgtctacagccgatgcttcaccacactgagccaagaatcggctaatgtgctcataagttgacacaccatcttgtcccgaaaatttggagaagtctagaactttgaaccaattgggaagaggaactctctcaaaccactcagggtaaggctgccgatacaaacttccagtctcttttggtttaagcccaaactgttccctcattacgtcagcaatcacattggcccacggttgttgctgagctgccccttgtgactgctgttgcatgggctcgaactgaccgtattgagacgcaaactgaggttgagccaatgcccctagctgatattgggcttgcggggaaggaggctgatattgataattcaagttacccccttggtaattatgaaggttcggctggatattgcgtaccaagtgctcaggaataacttgaggcattactgtgccacccggctgtacgtggtgaaccaaatgttctgggacaacttggtttaaaaattgttgtacaggctgaccaccaggcgttgcaaacccggccgatgcgcttattgaaccttggtgctggatcggctgaacgatttgctgtcttaacagcgtctgctgaatcggctgtaggggctgctgccttggtggtgtttgctgaatggttgcatgacctgttgccggattggttgtacaacctgctgaattgggggtgtctgttgaatcggctgctgatgtattggatcaacaacagattgaggtggcagaaacatggcagcaacctgatcttgggtcagccgattcacaacctgcccgccatgctgtggctgctctctcattaacaaccgagggttcaccggctggcctggcgccatcgctgatgaagcaggtaggggagttgttgccggcgccgttggctaagttgttggtgcaacggaggtaaccgcctgagtagatggctgaacatcggtaatcaaagaccgataatttgggaagacacctccttgcaaataaaccgggcctgcagcctgatgctcagctattgaaccatcggctattgacttcatcatgtttgataagctattgactaacaccccagactgattgatcaaagcatgatgcacagcgtaatcaacccgatcttggaagttattgaaaaaatcctgtgccacatcactattctgattaagatttcctccctgcagcccctgagcaccatcaccttgaactccatgcaccccgtcaccttgtactccatggactccttgagaattgtcgccttgatttcctagaaagccgtcagtagcacctttgatactcggctgagccgagccgtctggagcttgtttcccatctccatccttaaaagaactggtcccaggatcatcagcaaccacttttattttgtacttctaaacaagtgtccccttgcgggtctacatgaatgagttcaagaactaatcccgtacttgctgcaacattgcttcaaactctttcttctgctcaggtgtgaatttttctggatcgatcggcacgacgtttccttcattgacgtcagtcaatcctagctttagcatcttgtccttaacaaagcctgggctagatggtggtggtggttgtttctcggccatgaagaagaattgttggctgacttcttaaatgtcccaccaggcgtgccaaaagcgtgttgacagaaaacacgaagcgtgggagatctgcttaactccagtgcaggtccaaagctcgccttcgaatgtatgagcgtgccagttgatttgatcctgtaatcaacaagaaatagaagcaaacaaaccgcggttaaatctataaatgatagttgatcgactaggtgccgatgacataccatttatctttgagccgatgtcatatgtgaatcgatcggcagttgtaaatagacaataaagaactaaatctattcgatcggctgtagatatttccaatatatagttcttatatcgatatatacttaaatcaagtgattgggatagatcggtcactatgccgagacagtataaatcacttagatcgaaatatatattaataataggactatgtatgtttatagcatagccgattagatagatctagcatgtatcggctaatactccgatactactctatatcaggatattaaaacaggtataatatatcaaacaaaggcctaatgtacttagatacaacaatatcttgacataaagggcatatttaacatgtcaatgaagcatatagagcaaatatagttaaatcagataagatcggctgaaactctgatgctaccctaatcggcaaccagaaggcaggctagagattgatattctaagcacgacttaatagatcaaactcaactgatgcagcattaaatatgaaaagaagaacaatatctagaaaatcaagccgctggaagtttcatagagtggtagatatcttatataatctgaatcaacgtcaaaatctaacctaatcggctgccctcttcgatagatcttagccgattgtaggttagatagcgatattgccagagattatgtaagatatatgataactcgacgaattacataaacaagattagagtgtcataaagatgaaagcactaatcccgagaatacaagccgtcataacaagttttacctcttgttgaagatcgaaaccgatgcagctcaacctgaaagtaagaactcgtcgaaacaaaactaaagcaaaagggtggcgatgcgccgaaattgtattgaacatgtgtgttaaaagttacatagggctcgggtctatttatacccgagaattacaagatatgtccataacggacatgactactatctctaacaaactctaagataccatatgtctttgcggcagacttttgcccaagcgtatctctaaggagattacataaaacatcctaattaatagatacaattgccttctcaggactctatccatgtgcggcaatcaccttgaagcgcctcaattcaacccaatatcatacatcaagttgcattgtcggaatcggctgtaccggcttacctagtctgactcagacccagccgatcctaatcgtagccgatctggactccagccgattcttgctctgtttccgaactcgatctccgcctccgcttcgcttcgatctaatcttctttcctgacaccgatgattccaaatttggttgttaacacatctttatataaattctatgaaacatgatttaagtaactccgaataccaatgctaggaatcctgaagcctcatcttttcgcttatgcttatcagccaaaatttaaattttcaatcttaaatttagagttgattttgaaattttctcattgaagtttatttttcaacctttgcttttagatttctaagaacacacatgtaaaaattttattcacaaatatttcttcgttttcaaatgctttgtctgcatccgccactgctgttacattgtatttgtctctatggacattttcgttacagcccatgatatatggtagaggaccagcaccagctcgaatgatggtaccaatggtgctccctgacggtcgtctgggatatgttctgtaagataatctctgctgccctagagtcgcaaacaagtcttaccatatactccctccgtccctaaatatttgacgccgttgatttttttaagacatgtttgaccgttcgtctttttcaaaaaatttaagtaattattaattcttttcctatcatttaattcattgttaagtatacttttatgtatacatatagttttacatacttcacaaaagtcactacaccatgacctgaaagctgcaacagctcatctatcggtaaataccacctttagcatcatcctgtctgtcggtagagagttttccgacagattacgtgtatcaggcgaaagcctgtcggcaaagggcttttccgacagataaatctttaccgacagatgaactgacccctatattaccttcaacgacagacatgtctagcgacagaaacatctttaccgacagacgagttgatgaaaaaagtagatttgccgacacactgtctgacagcaagctctgctaccattaaaaagaaaactatttcacattattgtccattacacctgtttacatgagcataccaatttcaatagctaatgacattcacaatgacaaccaccctcaaatgtctgattcatttcattcattcattcatcatgtacatgaccaattgaccattctcctcagcattttaacagaggattgtgaattaaaaaaaaaaaagctaagaaagaatttgtacattgacgatcctaagggtggcaagtcctttttggcttcacataaatcacttgattaagaggtgataaaattgaactaaggaaaaaccagaggcagtagcaccacccttagcagttcagacctaatcatatgctacagccccatatccaccaaggttaaggacactatccagtatgaggaatctgaaaacaagtgaggtacatgcattagttcttgaacagtgcatgttaagataagattaaagaaaaggaaatacaaaagcaattagtgtataatcagatgtttgctgccctctaatagtcatggtttgcaaaaccaatagccaannnnnnnnnnnnnnnnnnnnnnnnnnnnnnnnnnnnnnnnnnnnnnnnnnnnnnnnnnnn

SEQ ID NO: 9081 - DNA, 412 bp, Oryza sativa
  unsure (1)..(412): unsure at all n locations
ccgttgcctatgctggcttgtggtaagtacgaggaattcttccagggtttcccgcgaaccggtccttaattgctatgggcgctaccatcaaaaccatgcacccacagcccaccatttaatatattttaattaaccaacaccacagcagtggcactaatccaacatctggagtctatgcattaacgtaattcccccattgtgtactagttgaactaagaatggctaagcattccctaatccaacatctagtcatgttacaacccaaactagcaaagcaacaggataacaaatgatatggctgagacagtaggtaatcatcccattgtaacattataaaacgatgcaatatttaaaggaaaataatagagcattnnnnnnnnnnnnnnnnnnnnnnnnnnnnnnnnnnnnnnnn

SEQ ID NO: 9082 - DNA, 596 bp, Oryza sativa
cttacttcggctgcggcttgatcaacatcttcttcaatctcttcttcacgcaaagcttgctcaatggatggtgtcgacgggggatacccgtagaccggatatagagagtattggggtacgccggtataaggatctacgtagtacgacatcgagcaatcaaaagacaagaattatactggttcaggccccttgacaggtaatagccctaatccagttgatatgggattatatggtggaaaacacagattacaaaggaaaagacttaactcgggagattcgacgagatcgtagtcgagatgatccgactagctctcgtcgacttggctctttgtaggctctgacttcgtaggctgtgttggttgtctaggctttgagattcgatgagctatggcctccgcggggggtcccttttataccgtaggttgggcgatatctgagtaggactcggatgtaccaaacctgatacgatacgtaggtaacccaattcttgttcgagaaggtttctccttgtttgttgtctttacgaagaatttccttaagtgctagaggatttatccatatacacgtggatataccttgtcgatacgtgacgtata

SEQ ID NO: 9083 - DNA, 899 bp, Oryza sativa
ccggccagcccgcggtatgaccggccgacgctgtgtcggtgtcggtttcgggttgtttatttggatatccgtgattatttcatgattatggcttctagatggatactatacgtatgtaatactattgtttgctgataatgagtcaagttgtagatagcttggtctcggaatatggtttctttgtttgctccacgtgtaggtgacttgatgtctcgggagagtatttgcggtgatggaccgggagtcggcttggggataagacgacgtccgtggtggtcagagatcatgcgggatactaaggctagagttgatgcacatggttgatggagattccatatggcatacgatggagttattgtgtgcgtatgggatgtggagtcgaatttggaaggagtccaaatttggtacgattggttctgtaaagtttctttcttgtactagagggtttcctaaggtgtttaggactcctagtatgagtttggttcgtggctttgggctgcctacctcatgtataaatagagggggagcgtgaggcttcccggtatcgctttagagagcaattgagttgagttttgaattagggtttcgagtttagtcgaaatttttgtaaggagtgttgttggtgcactttataaacacagagagaagaaataaagttgtcatccactttaagagttcttcgatttgtgtttcaccgagtttcggtggtccaaccggcgacataccgacggttagaccagtggcatcgcggcggtccgattggcggaaggacggcggtcagatcggcggcggcgacaggcgccgcaggcgacatcgatggtcagaccgggtgatctataccggtcagaccgacggcatacacttggtcagacccgtagatcaatctgggtcagaccgat

SEQ ID NO: 9084 - DNA, 689 bp, Oryza sativa
taatcaacactgaacagcacacccatgctgcacaggcccaaccatcctgaacaaccatacccggctgtacagatttaactccaaaccaggagctaagcaaattattaccaggtataacatccataattattgtgagagatgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactagaaagtacccgaatagaggctgtgataataccctttgcacaacacaactcaccacagtgcaccattcctagatcataatcacccccttataaaacaaggcatggactccccagcgacccccgtgggcttatctccgccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaaggtttagttggcaagtaattaattaaccaatcacgattgaccattgtgaactatcattaaatcatcattaaataatgagtcataaattatccca

SEQ ID NO: 9085 - DNA, 6873 bp, Oryza sativa
  unsure (1)..(6873): unsure at all n locations
nnnnnnnnnnnnnnnnnnnnnnnnnnnnnnnnnnnnnnnnnnnnnnnnnnnnnnnnnnnctgaaagtacaaaaaatggtacgagtataagtgccagttgtagagaaaaacccttttttaaaaaaaaattgacacctttattatattataggtgtcggttaataaaaaatcacacctataatatactataggtgaaaaagacaccctaaaaaaccgagccaagtctggatactttttagctcacaggacgccgagagggggccttatcgactcccccctcacctagtgtagccctcctatactcgacggggccccccccctcacatccccatggtggaggcaccctgccctcaccttcccacgtggacggcgtagagcgcacctatatctgacctatgtggctcaagtgcgacgaccagatctttcttgcatttttttttgatgtggataatgattttttttttaaagttgattgtgcgattgtgttcaagttgatcgattcaggggtgattgggagctgcatcgagccaccttttttttattattcttgggacatagaaccaacacctttgatttctctcattagtaccacctactatgtgctggttttcccgatcggcacctgtgtggggggtttccaaccggcacctattcgcgtttctgtagtagtgttaaaagtatttttaatcataaaacaattcacaataaaacaaataagaattagcaactttttgagtaaaacaaatttaacgtccaaatttaacaactttttgaggtggtgtttgaatctcctgaagatgaagatgaagatgaagattaagtgtttcacgcaaaatgaggtggtaataacgtgtgattaattgagttttaattattataaacttgaaaaatagattaatctgatattttaaaacaactttcatatagaaagttttcgcacgaaatacaccgtttaacggtttgaaaagtgtgccacgagtatccaaaagttaatccaacttttgttggagaaaagaacagggatgtatttgaaaattttattaaaaaaaattatgggtttctatccaacatttgatcatccgtcttatttgaaaaatttataaaaaaagaataagttatacataaaatattattcatgttttacgatcaaataataataataatattaataaaaaaatttcaaataaaatgaacggtcaaatgttggtcacgaaaacatataaaatacttaagataggacggagggagtagtatactgcgacgacctgggttgtgccgtttttttatagtatagtttttcccaaagacattgatatggcaattcaaaaccgtaacagtcgcagtttgcatatagtacaattaataatgcagccatgcgggcaccaccaacgacgatttccgtcggcgaaatttgtcctaacgagctccgacgacgacttccacattgcagccgtaatttgccgaggtcttccacattgcagccgtacgtgccgacggcccgacgccacgtatgtagctttccgtttccaaactctgatcgcaacatatggccccgttcggtagtacttctagagtactgtttgattcacagtactgtttaattcagcttagggttattataatctgaattattagaaataagctaaaacaaaccgataacatattatgatagattattataatctataaagcaaattactataatctaatccactcaaaagatgctttttttattattgggtggctaacaactaacaaacagcttataatccaggaaaacaaacagctcacagcttattatatgtcggcctattataattcagcttatagtaatctggttcaataatctaaattacaacaatcttaagcttagacacgtgaaacgaggaaaccattgatgtttgattaattattttaaactcatgaaatgaatctatttgatattttaactctatttcaatgaaaataatttcacggatagtactgattattagtttgaaaagtgtgttaatgaaaactgtgacaaaatttgtatcttaataggaaaagaacatggcctatgtactctactttcacttcttgcatgtgtggtagctagctgcagtaaataattgactatactcgctcctctgttgcatattataagttgcatattataagttatttttattttttcatatcaaacatttttaaatttgattaagcttgtaaaaaaatatggcaatattttaaaacatttataaaaacaaaatataaaaatatattcaatgttatatattatttaatgaaattaatttgttgttgtagatttcgctaagtttttctataagcttagtcaaattaaaaaaaattaacttaaaaatataaaacggcttatgatataaaactaagagagtaatatattttgcagacccctcgttgagtatgatctgataatggattaccttacgtgtggcgattaacaagtcacttgacaatattatcttttgaatgaggaaagcacagggaatgttctttttacttgtcctttggctcattttgcttggaatgtaattgccatggtgttgaatttatttttggaatgtaactgtccctatctatcttttctgggatggtatgagagctatcaaaacaaaaatgaaatctcaagtggggatggtagtgtttgctgggatgttgtggggtctatggataacaaggaatgagtgggtgtttgaaaacaaactaatcaaaactcctttgcatgttgtctgtcatgtctttgtccctgatgcaaagatggaggctgctactaaaagaaaaaactgcgctgatttccatgagaaagcatgctcattctggatggtttgccggcgcgcggttgacaatctgccagaagactttgggtagcttaggagagtttgggatggtttagttcccaaacaaaatttttcacatagtcacatcgaatatttgaacacatacataaagtattaaatgtaaaaaaaaatacaattacacagttcaccaggaaattgcgatatgaatcttttaagcctaattgcgtcattatttgataatgtggtgctaaagtaaacatttactaaagacggattaattaggcttaataaattcggctcgcagtttcctgacggaatctataatttattttattattagacggcatttaatacttcaaataccgtatatccaatgtgacgtgcaagggtaaaatatttttccaaataaacaggccctttgtgtcgttttctgtcccagttgtgtatatacatgatgtggttagtgagggggcttttagtactttttgatggtctgcacctttcatagaaagctggatgtccccagtgtgtcgcaaagccttttgttaccctgttttagctgtttacttttgtaagactctgtaagaacctgttttcttctgggctttttacaaagccgggtaatatatttgcctgatatacaaaaacaagtgacttgatatattttgcaaatctctcgtttatttatatccatatacatatgcttcttcccttcaaagttaaattcctaatatttctcaatgtatatatgtacgtcattcctacctccagtctagtgaacgggtgcagactgcaatttgcatagtaagtacttattgatgggaaaaggaattaattttgaaattataattttaaaaaataagaacgaattgcagttttaagatataggacacatttatttaccaaggcttcccattggacctctttattctatcctatactttcaattagaccccttactaccttaggcacttttttatacttctcaacctccaacatatgttgcgttcttaagggtgtctttagttcgcaaaaagaaaatttttgggtgtcacatcggacgtttgaccggatgtcggaaggggttttttttgacacgaatgaaaaaactaattttataactcgcctggtaaccacgagacgaattattatgcctaatttatccgtcattagcacatgtgagttactgtagcacttatggctaatcatagactaattagcctcaaaagattcatctcactttccatgcaaactgtgcaattgattttttatctatatttaatactccatacatatgtccaaagatttgatgtgacgtttttagaaaaaaaaatggaactaaacaaggtataagtttactttcccaacttcacctcccttgttttctacgtgcacatattccaaattgctaaacgatgtgttgtttgaaaaaatatagaaaagttgtttttgaaaaacatattaatctatttttcaatttttatttagctaatactttactaatcataatgtataggtcgttttacgtgcctcccgaacacagtcttagcgtgcaacctgacctccactaccttcctcttgcttccactaccttctaacatccttcatttgcttgaaggtggtgccttgttcaaggcaaaggggtcaaaaattaatagaaaaaaggcaataaaagtaggtccgttgttaaattgtaggacaggagtttaacgtgaataccggtatgaaaaaaaaatctgaacaaaaatccacttgagaattaattttagaaataaagtgttgaccaggagagaaaagcgggtaaggatctgactttcgatcttactgatgtgttcaaacagtactcgattgtagtcgctcaagggactgtgttcggaggacccggcacgcaaaacgaaccacctattattacatgattaattaagtatttgctaatttttttaaaagtggattaatatgattttttaagcaactttcgtatagaaatttttcgcaaaaaatacaccatttagcagtttgaaaagcgtgcgcatgaaaaacgggtgagaagggttgggaactagcactcccgaatgcagcctaatctctcttcaaaaaaactagtattcctggtatcataggtggccaaaaggcccactactaccgaaatgcaaaaaaaaataacagcactatatatacagactatatatacagaaaatactaaaaccgacatcaataatgtttttctcacccaaggctggtccgcatagcgccatcggctagaacaaatacctttgtggagagatagatgtcgattttaaataaaaacatgcacctatattgttagtgccgattttttaaagaaccgacaactataatatattataggtctcaatttaaagtacaggcactaatataggtgttgttatttttttaaatttacacctatagaaaaaccggccaccgaacgactttatctgctcccttgtctagtcatccttatcaccacacctcctcttccgtctcctcctcctcctcctccctcctcctccacacttgctcccgccgcctcactcacacccgcccctactgtcgccgcacgcctacctcctcattaccacccctacccgctacatcctcccacctgtctccgccatgcctcctcggccttgccgtcgtcgtcttcgttctccatctccctctcagcatcttcgtggcgctgtggctggttaccggcaaccccgcggtgcgggatttggcccccgagctcaggacctccacagcagcgaggaggaaaggagggggttcggctaggagcggcagtggcctcccgctcgcccgtccctctcctctcatctcctgtgagatttattttgtaattttcgcctctcctctcatctcatgtgtgatttattttgtgatttctgattggattgtctcttgtcttgtgatttattttggaatgatcatgtgattttcgattggattaggatttagtttttgaattaaatttgtgatgatttcggattcagttatgagctcaaagcatcgagtcgaatcaatctaatgcatcaagctatttttcttttgcctcgcgtgcacatcaaagatgtcggttgtgaaacttacatcaatgacttggggtttcatcagtgccgcttagcaggtgccgtttgaaacaaccggcacctatagagagagctctcaatcgacaccaaaatccttttgtgtagtagtagccaggtctagctatgctggcccagtctcgacacaacatgggcacaaaggttgggggctgtatcgtggttaggctgacactttagcacggccttgtgtcacctagcacaacctactatgtccatattttcccccattttctgctatatttcctatactttcatatctttccttattttcccatgttatttttccattttcccctctcacttctttaccttttcctttctttcaactattttctcttttctccacacacaccaactcgtgcggccattggcccctcttccattcctgctattctcgctccctcagccgtggcacgtgttcacaagccgtgaccagcctataggccactatcacacccattccgggccagcaaggcctaccatctgattgggctgtgtttgggctcaggcattggcacgtgggtcggcatgtcacaaaatattttagcagccatgtcttaagggtattaacttgatgagccgtgccagatgatctatttggctctaccactatcttatattatgagatagaagtagaagtagattagtatattccttccattttaaaatatagcaacctttggaattttatgttgagattaagaagtgtgtactagaatcgaatagggatgagtgttgagatgagaaagttggttgacaaattaaacgaaagatgattgatgcgtttagaggagtgggtaggtgaagaattagttatattttaaaataaatttgaataccaaatatagctataatagtattttaagaggggggagtagatcgtagcaggtggacaaacacagctctgctccatgctatctataaatatac

SEQ ID NO: 9086 - DNA, 1983 bp, Oryza sativa
ggccactatcacacccattcggggcaggcaaggcctaccatctgattgggctgtgtttgggctcaggcattggcacgtgggtcggcatgtcacaaaatattttagcagccatgtcttaagggtattaccttgatgagccgtgccagatgatctatttggctctaccactatcttatattatgagatagaagtagaagtagattagtatattccttccattttaaaatatagcaacctttggaattttatgttgagattaagaagtgtgtactagaatcgaatagggatgagtgttgagatgagaaagttggttgacaaattaaacgaaagatgattgatgcgtttagaggagtgggtaggtgaagaattagttatattttaaaataaatttgaataccaaatatagctataatagtattttaagagggagggagtagatcgtagcaggtggacaaacacagctctgctccatgctatctataaatatacgtacgcgccacagacaattggagctagcttattgaaggaaactaaaggaagaggcagctactcctactcatctaggaaaataaattcctagctagttaatgttgtacaacttacatgcgtccatggcattctggctacttgcagacctgctgattcttctagcttccgccgccgagagcgtcgccggccagcctgctgccagttgccaggctaggtgcggcgacatcgacattccctacccgttcggcatcggccccaattgctctcgcggaaagggatttgagatcgcatgcaatccccgaaacgacagcggcgagatggtgccgacccttgccgccgccaatggcaccatccatgtgcagagcctgttggtagcgccgatcccggaggtcaaggtgatgctgccggtggcgtaccagtgctactactccaacaacagcatcaccgactcgttctacggcgaggtagacctcaacaacacaggcgtgtaccgcatctccgacagccgcaacatgttcgtcgtgattgggtgcaacaccctgtcctacacccagaacgggaacagcggcggcaaaggcccttacgccggcctctactacaccggctgcgtctcctactgtaacgactcgtcgagcgcgcgggacagcatgtgcgccggcgtcggctgctgccacatcgacatctcgccgggcctcagtgacaacgttgtctccttcgggccctggaagcgtggcttccaggtagacttcagcccctgcgactactccttcctcgtcgacaagaacgagtacgagttccgtagcgccgacctcaagatggacctcaaccgaaccatgccggtgtggctggactgggccatccgcgactccgttacctgccctccactggaggtgcaggagaagaaaccggctgggtacgcgtgtatgagcgacaacagcgagtgcgtcaactccaccaacggtcccggatactactgcaagtgcaagcaaggctacgatggtaacccctacgtcgacaaggaccaaggttgcaagggtaagattaatgtttttattttattactcctagttaacagttttgctaaatatatagtgccaccattttatttttacctttcgttgtgtgcaccaaccctgttggtgtttaaattcattaactaatttttttttaccaggtttcatttgatcttttcactatttgatgtaggcgcaaaaaaagtgaaaaaacgtattgtgtattttagtaagcatctatatatacacggccgtgtgttgcaagtttcacaagttgcgtaattttgcgtgtgtgtgatatataggatttgaacgggaacctgttcttcaagtagcgtccttaccatctcacctataaagaactttgtgcatgcgggagagatgcttattcttttgacttcgcccctctaaaacttgtaatatataaattgcactataaatgatatcaaaaggaaaatttatcaaccacaaacttgtagat

SEQ ID NO: 9087 - DNA, 780 bp, Oryza sativa
ctatctctgccgaaaatgatcagcggggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacgttcggctctggtctttttacacgtcatgggagcttggctgggtcttgggggcagcaccttcttcgtcggctgcacttggcgattcgccagcggcatggcttcagctgcttgcatcaccgcttgcgcagctgcagcggaagcggcggccttgtcatagtcggcttgtatctccagccttcgctttgtgtcctcttcgccacgtgcatggccgtcgatgatgcgaaacaagcgctcgatggtctggggctctttccttgctattcttcttgtgaggtcgcttggaaggagccctgccgaagcagcattgatgacggacgcctctgtgatgtcttgcacttggcag

SEQ ID NO: 9088 - DNA, 381 bp, Oryza sativa
caagtggtcaccaaattgggaagggccgttccaaatcgataaggttgtgtctaagggagcttatatgttgcaagggcttgatggagaggtttatggacgagcgctaaatggcaaatacttgaagaaatattacccaagcgtttgggttaatgcatgatcggctggtgttgccgatacatgatagacgatgtgtttacatcacctcgagatggccgatatgattatatcgcccttagttgttttcatattgtaatcgggtgtgtcttgccgatatacaatggccgatatagtaatatcgcccttagcagttttattatcataatcggcttatgttttgccgatgtatgacgggccgatatgattgtatcgcccttattggat

SEQ ID NO: 9089 - DNA, 1233 bp, Oryza sativa
tgtcatccactttaagagttctcgatttgtgtttcacgaagtttcggtggtcaaccggcgacataccgacggttagacaagtgccatcgcgccggtcgaattgcggaaggacgcgggtcagatcggcgcgggcgacaggcgcggcaggcgacatcgatgttcagaccgggtgatctataccggtcagaccgacggcatccacttggtcagaccggtagatcaatctcggtcagaccgatctccatcgaattcgagggtaacttttattttcgctaaaagttttcggtttttgggtataccaaccattcactcccctcttgttggcttagttcttgctatttgatcctacaagtggtatcagagccaggctaggttaacatctctggcccgatggacacgtgtgaaggcctgatggaccttgggtgcctgcggggcccgcatacctgatggaccgtgggccggtggggcccggatacggtgaaggggcggtgaagggctaagggacactaatgtgtgaagcggagattgttgaatagtcccacattggttgtggaagggcaaagaacctaagatataagtgggggagcccctcacctcaatggctagcttttggggtgggaaaggccctttacgatcctacaattggtatcagagccatgttttcttctttggatttttatcgatctagagtttttgccatggctactcccgctcgtttttcaactaagcctcatgttttcgatggaacggatttttctcattggtgtagtaggatgcaatcttacatcatggctgaagattatgatatttggagaaaagtttctcatgcttatgtgattcctgaagctattaatactgctgctgaaaaaactgcttttgaacaaaattgcaaagctcacaacattcttttgagtggtatttctcgttcggattatgatcgtgttgctcatcttcaaactgctaatgagatttgggttgctttaagtaattttcatcaaggaacaaataacattaaagagcttcgtcgagatgtttttaaaaaggagtacattaaatttgagatgaaacctggagaagctttggatgactatctttctaggtttaacaaaattttgagtgatcttagatctgttgattcttcttatgatgctaattatccacaatctgagatttctcgtcactttttgaatggtctcgatatgtctatttgggagatgaaagttacatctattc

SEQ ID NO: 9090 - DNA, 335 bp, Oryza sativa
agttggtatcagagcccccttgaccctaggacgagccgtagatcccaagccttagcaatattttcaaatttttaaatcctttgttatttgagaaaactgtctagtctctctctgacttgctgcttcatttatcgccaaaatctgacctttaaaagtggttttttctttctgtttttgtttgtagatggccggcagcgtcagccgtcgtggtttggacatgactggcttcgtcttggagctgcggggcatgtgcgtggtcctggggtatccacatggagtggactaccaggccaggccgcttccggagcaggagggtgacgatgcagagccccacg

SEQ ID NO: 9091 - DNA, 1826 bp, Oryza sativa
  unsure (1)..(1826): unsure at all n locations
nnnnnnnnnnnnnnnnnnnnnnnnnnnnnnnnnnnnnnnnaaatattttatatttctatacattggcccgtttggcttatctcaaactcctaaatttaacttcaggagttggatctagagtggagttgtggagtagcccgaaaccagctcctcttctctagtttattttacaaaagcactctagttagctccgatccctttttgtgtaaagctgaaactgtttggttgggctccagctccaagatgagctggagcgagagatagagaaagaggtggtgacgtgccaaacaggcccacacaccagcaaaaatgcccgtgcattacaatgtatcaagtcaacccttcgctcattcatcttctcatacattgcaacaagaaaaactaatattataataaaaatcacatgattaggttatgatatcgatgtcaatatagttttgaagatgatgcggtgaatttgtttggacaatggattaaattcctgcctttacttcaaataagctacaaccacttattataaaattctttcaaagagagcaaacatgcagaccacttcatagcgacgggcgtgtccagcaagaacagatccaatatacatcgtcaccacggagaccaacaccatgtaaacttctcacagcatgactgccagcaggcaccacatgtaggcgtaagcgttaacgaaggaacgttaacatagagatcaaactaagaaggcaggtagatcgccactacccaccttgcagcacgggatgacttattgttgacttccccgaccatgatgggcgttgaacggttggagtccgatgaccattattggtggcactagcattatactccctctaatgttttaacttttttctaagttaaacttctgtatatttgatcaaatctatgaaaaaatatagtaacattttcaatacaaaataaaccaatttaataaaaccaattatattcaatgctagatttaataaaagcattttggtgttgtaggtgttgctatatttcgttataaatttaattaaaattaaataagcttaacataggaaaaaaaatcaaagtgtataatatggtacagcagcagccgccgcagtctccgtgcatcttcatatgtgatttcctttgccttcaacggagggcggcccgaggggtggcgaagatggatgtgaagtgtcactcgaactcctagaagtggtaagagtcgaagcgctagaacatatgcgcaagtatatagtgggtacttcggtgacctaccacaaaaagcttcgaatcgtttaagcctaattgtgccataatttgacaatgtggtgctacagtaaatatttgctaatgatggattaattaggcttaataaattcgtctcgcagttttctggcggaatctgtaatttgttttgttattagactacgtttaatacttcaaatatatgtccgtatatccgattcgacaaccaaacccaaaatttttcccttatttggggctgatggatggtgtactctagtgatgtacaggatccggcatgcaatttggatgaactacagttattacattcaagaatcaagatggaaattgctgttctttttccgaatacatcgcaccatgtcgtctgaagaagctgatgcttgttcagtcttacagccacttgtttaatgcttcagttcagtaaaagaatactgacctcctaactaacttgatcttaagggtcaacactttccagatttccagttaattagatcatctgatctttacaaaataagtacttactccctccgtattttaatgtatgacgccgttgactttttgattaacgtttgaccattcgtcttatt

SEQ ID NO: 9092 - DNA, 751 bp, Oryza sativa
catacattaaaatacggagagagtatatgattctgaatattgcaaaacaggacatgaagtatttagggatactactgtactcgaggaagaactaaaagttgatgaaaactaagttgtcattactgaggagtcaaaaaaaaaaaaactaacacttctctctttttcgttaaacaaaagctccagatatgataaatgacagtgtatgaagtcttttactctattttttcagacaaaaactcattctggcaaatgagtctattgtctgaaacaacctaaactcagattctctcttctgtgtttcctttttgagatacttcattttcttggtatatgcttagaatcaaggacagaatcctcaaattacaaaactattcccttttcctgtgacacgattttgcagtccacacgaacaggcccatctggatattggccgtttacaggccgtgtccttgaagaggccgtgctggcgcggcccggcccgttttggcacgaagcaatgaagcacgatgggccgtacggcccaagtcacttctgacagcagctggctatatatacaaaggtagccggaaacgcgtcttcccttttccgtttgagcggtcgagtcgcaaattccccatccaaaacaccactctcctcctccagtccagtaagcccctcttctcctcccttcccccaattccatccactgctctcaaatctcaatactactactgttctatcgaatcgattcgaaatccacaccgctactacg

SEQ ID NO: 9093 - DNA, 781 bp, Oryza sativa
  unsure (1)..(781): unsure at all n locations
nnnnnnnnnnnnnnnnnnnnnnnnnnnnnnnnnnnnnnnncgtctcgtgtcagggttgtggatatataatgcatacctcttatccttggggtcgtgagatatatggatacagtataccctcaagtatatgggaaggtacctctgaattgaggaaatcggctgatcagtaaggaatcgtttctttgaatagaaggtgttagagtcctattcggaggagataaggatttttgtgatatcgtgtaaggacaggtatctccgagttctacttggacgacaagataatctgcggtacaaatagaggaccactagaggggggtaaggcatcgaatcttagcgtaagacacccaccatagcaaaaccaatccagaggacttgaagcaaactcaccgataggtcttgtcgagccattctcgacacgcatctcatcggtaatctcgggattctgttgttctctattgtactctgtggttttctttataagcccatataaactagattaaggctattacctcacgagagacctaaaccaatataatctttgttccatgtgtgcttgttgtcgtatcgtgtagattctcatatcaacgtaccccaataccctcagaatacggtccgcgggtatcatccgtcaatagtaagatcattttccatcaatcataaagaacgtactcggaatagtttcactgcccacaagtaactccacatttaacacccaattagcatctaatgaattccctccatagctgatgaagatacaactagctcggatataacatgacta

SEQ ID NO: 9094 - DNA, 7046 bp, Oryza sativa
  unsure (1)..(7046): unsure at all n locations
nnnnnnnnnnnnnnnnnnnnnnnnnnnnnnnnnnnnnnagcatagaaatttcatcatgcaataacatatcccacacaagttaagaattcagagactagccaagtgtaatacatgtcccgggctcaataaccgcgagcacggctattcgaatagttttggtttactcacactgcagtggatgtacactttacccacactccatgactgcccaacacatgagccttgtctcaacacatgagacgcgtcacggcaaagcctttcgataacctcgcattggcagtacccgctccatgaacttttcatcctcatgcactctaggcgtacacggtttctagcaatgagaggagttctggcgcacccgggaagggaagttttacacccatgtaattaagttataactaggctcaactcaacacacgacagtcctagcaatggcgacaccattgtagagcccctgccatacacatgagaaaccactatgcatggatactgcctccgctcggctatttactccgctaggtctaaccccattcgagaaatgtggttgtacgaggtcgtttcatgcttaacttcatggctcggtccttaattgaccggggacggtactagcctttcccggataccacccaaatccaccatccgccccggtctaaaacataggtttttaattcctttcttgtcaccattatcatggcaatgtggtgctcatgcctccacatgccgcatctcaattaccttcccaaaggtaattgcccaagcatatagcatttgataaatatgaatatgcaagattctagaatagcattctctaagcaagtgtcataattgactagggactcatacgtaattatggttacaaggaattgaagataaacaataacaaggcatggcataatcacaagtgggatgttcatcattgcatgcaatcttatttgtaaacaaaattaatttcacaattgggatcaacgtgatcaaggaatagtgatgacttgccttgctcgagatcttgtaggtcttgaccttcgcctggatccgcggctccctcgggctctatagttacgtgcgaaaattgatttgaattcggttagaattcaaataaaaacccaaataaatccaaatgaaagtcgaaagcgaaagtcaattcctttatattaattttactattcgcgaactaaagcaaacccaatttcgaattaaactattttgcgggtataaatatttgttgtcataagtttttaatttaatctacccgagcattacatccatataataggttagaaatttctatcgcgagctaaaaaacggacgaaatcctagaaatattataagacctaatttagtctatgactaaatgactaaatatgatacacggctaaaatccctagtttctaccgttaatcgattacttatagggattacccaaaaataatctataataatttatgataattcctatatttatttaattacatctaaattattaccgcgaattgatctcctatagatattactaaaaatgatctatagcaatctataaggattcatctaattggttaattcgtaaataattagttctataatcaaattctagtactttaggtatttaaatagtaggagttcacctaacgatattttcattaatcctataatcaaattctagttattttaaattttctacacttccctaatctccctctaatttcctatttatttcctttttatttttcttttcttccctttctttttttcttttctttttctctctctcctctttttccctctttctcttttctctctctctttctttcctctcggtttctctccttctttctttcttctctccctcggcttctccctacatctctctctctcggctctctctctctacccggcggcacggcaacaaacagggggggcagcggctcaccgacggcggcggtgacgacggcgcacggcgcggcgcacttgggcggcggcgcggaggcactaaagcggcggcacgacagcacgaggacggcggcgcggcggcacgacggcggcggtgcgtggagaaggggagagggaggggaaagatggggaatgggtgtggggaggcttggggatggagggaaggggtttttatagggcgtggagaggaagaaagagaggggaagggggaagagaatgaaacgacggcggcgcggggcgcgacgcggcgggcgcgcggcgcgaggcgacgagacggcgcgcggctaggggtagaggaggggctgggctagggccacgtcgaacacctggcggccgatgaatagtgctctttttctattaaactgattttagtgtatttcccatataaatttgattccaaaattcctaatttttgcatatatgcatttactcaacatgtgtgttattccaaccaatggattcaccctagattaatattactcatatattatttatataatttatttgaagtcttaattagggttaattatcgtatttaaattcaattgatccaaatatggtcgcgacaatattttatttacttctatccccacctaatccttttttttaatttatattcattttaccaatttatttttagggttgatttctaattaactatcctttactcacgattaataaacttcgaaatcaaaatcaaataaaatgatcgaacaaaatcagcatgatgcaatttattaaaaagtttttgaaggcccatatttctagagtttagatttttgtcggtcgaattttcagggtgttacagtgttcgtcccgtcgtgaaagcacgtccgccaccacatttgtggagcccggcttgtattccacgacaaagtcaaaaccgaggagcttactagcccactggtgctgagggacggtggagaggcgctggtctaagaggaagcggcgcccccaataagtatggccgccaatgacgcaccgcctggacgaggccgatcaattcgcgttcgtaggcggcgagcttggcgtggcgcggcgcgatcgtcttgctgaagaatgcgaccggcccggcgccttgatgaagcacagcgcccggacctgagctcgatgcgtcgcactccacaatgaactccttgttgaaatccgggagctggaggactggagctgccgtgagtgcgtgttgtagttgtcgaaacgccgatgccactgtctcggaccagtggaagccttccttccgcagtagcgtcgtgaggggcgcggcgatggtgccgagtcgcggatgaaacggcggtagtagcccgccaagccgaggaagccccgaactgcgcacgcatttttgggcagcggccagtccaggacggcctggatcttgctccggtccatggcaacgccggcgcttgagataacgtgtcccaagtacgagatggaggagaggccaaactcacacttggatcgcttgaggcggagttggtgatcctgcagtgtctgcaacacggtgcgcacgtggcgaaggtgttccgaccatgacgaactgtaaattaatatatcgtcaaagaaaaccaacacgaaccggcggaggaacggaaagagaacgtcgttcatgaaagcctggaatgtggccgacgcattcgtcaagccgaacggcatgaccaagaactcaaataggccttggtgcgttcggaacgccgtcttgtgcacgtcctccgggtgcatccgcacttggtggtagccggaacgcatgtcaagcttggtgaagaacttggcgcctcgcagctcgtcgaacagctcctcagccaccggaatcgagaacttgtctttgacggtcttgtcgttgagggcgcggtagtcgatgcagaacctccacgtgccattccttttcttgatcagtagggccggggaggagaacgccgacgaactcgggcggatcacgccttgctgtagcatcgtgtcgcactggcgctccaactcatctttctggatgtgggcgtagcggtacgggcgcaccgcgacggctgagacgccgtgttccaggcggatgcgatggcagagatggcgctcagaaggtaggccttgtggttcggtgaagaggtcctgaaagctgtcgagcagctcggacatgagttcgcccgtcgcgccgtcgatggtggccgcctagagaggtggtgcaggtgcgtctatgctggtccagatgacgcgattgttgggtgagccgaaggcaagggactgcttggcgaagtcccagagcgtcggtccgagagagccaagccattgggcacccaagacgacgtcgtagccgccgagaggaagcgcgtagaaatcgatgacgaaagtgtggtcgccgatggtgacacgctgggacggaaaacagcctggcgaggtgatgcgatcgccgtttgcaactgcgacgctgaggccgtggcgcggttccaggggaacacgggcgcggcgggcggcaacgtcgctgataaaattatgtgtggagccggagtcgaggagggcgacgaggtccgttgcgccgatgcgggcctgcaccttgatcgtgttgaatgtgggcgtgcggacgccggccagagcatgcagcgagatgctaggctcatctagcgtgagcgcatgcgccgtcggtgttctcctcagcttcctctgggaagctgatgacctcgacgacgaaggatttcttgcaacgatgtcccgccacgtacttctcgtcgcagttgtagcagaggccctcggaacggcgttgggccatctccgccggcgacaagcgcttgcgagggagagccgacaccaggggctgtttgctggtcgatgccgatgacgcggcgtccggcgccgtagacgcggcagatgcggcggacacgggcgccggcagggcagggagcgaaggccgtggtgtgcggccagagcgagccggcacggggtccgttgtgccgagttgaacccgctgctcatacgcccgggcgagcatgatcgtgtcgtccagtgaactcggccggcagagagctacatctgtcttgaggggattgacgaggcctgccgtgaacaattgcacctgctggttctcggatagtttggcgtcgcggcaagccaaggcgaggaagctattgatgtagtcgtccactgtgccggtgcgccaaagtgtcgtgagttcgccgagcgggctgtccgtcatgggtggcccaaagcgagtgtgcaccaacttgacgaagcgctgccacgatggttcgccggaattgggttacaatctgtagtaccataactgagcatcaccgagaagatgcaaagatgcataccagacgcgacgtgactccggtgtcttctggccacggaagaacgtctcacagcgattcagccagggaagcggatcgcctttgccgtcgtaagttggaaactccaacttggcacgaggaagaaaactgttgtcgacggtggagtcgtcgcccgactgcttgtcattgtcgccggtgggtggcggagcgccgcgcggcgcgtgcgtagcggaccccgacgtctctggcacgggcgacgagcgatggctggcctcgacgcgctggacggccagattgagggcgcggacttgctcggagtactcgaacgcggacgcctggacttgtgtgacgcggtcaggcaaactgctgagcttgggcgccaggggaaccaaaggttcgaggacgctcatcttcctggccaagtctgagatttgggccgccatggatgtcaggttcttggcgatttcgtcgagctgtgcttgagtggaagccatgggaacggaaccagagaaatctgataccaagttgtcacggacgaggagattggaaggaggattgcgacggaggaagtatttaaaggctgtaacagaacgtggtcctggacctcgtcggcgcggaggagccgtgttcggcaccgcaccggcaaggcaggaactgatactagattaatctgaactttgattgattacttccaacgaaagcagcttacaatttataagggagctaagggatagaatcctaacaactcaagagataaagatgactaacaaactcctaaactgaacagactaaaccgattactattcctcgtcacggttgtgtcggcggaactctgcgacggcgccgtgcacaatgcaatccccacatgacaatctcggcaagcagccaagcacacccaggagcataatgctctacctggagtcctggacagaccagcaatgatgaggttacaaaatcacgcacccaccgaaaaaactggcacaagattaacatattggggaaaaaaatgtaaagaggtagacaggtccaactgtatgtctgcagataattttccaattccatcggtttaccactacagacgccaccgcgagatacaaagcttcaagacactgttttcaagtcacaagcaccacatgcatgacagataaatataactgaaaaaagaagacggtacatgtcttgcgcaattgcaggtgttatgctggaacagggttacaagcttctatcttgtttctttaggttaagaaatccatcacattgcgtgatggctggatggcggcaggaccaagggaacgaaaaagctagtaagggcgatatcgccggccatgactcccttcgccacctctgctgccaccatccctccggtcaccccgacgcggtgggggcggaggagggattccacctggttgttgcctgtcaagacattacaaacagaactgttaggaaatgaagatgtatggtaagacttgtttgtgagttgtgactctaggacagcattatcttacagaacatatcccagacgaccgtcagggagcaccattggtaccatcctcattccagctggtgctggtcctctaccatatatcataggctgtaacaaaaatgttgatagagacaatgactaaattgtcaatatgcagtggtggatgcaggatttctagcatgggtattcagagttacttaaagcatatttcatggaaaaggacagtatatgaactaccaaaatcaatgtacaatggatgacaatgcaatttaatttaaggtgttacaaaatcattaaagaaactactccgtctgtcccaaattataagggctatatttttttacacg

SEQ ID NO: 9095 - DNA, 1439 bp, Oryza sativa
gttactaatatacagagtagtggtggtaactgcaaaggtcccataaaatcattgcagcaaatgatcaaatcacatctgctttccacacaaagcacctacctagattaagatcaagtttaataaataatgataaaggataacaacatggagaaaacattaccatcaatttcatacttttcgcttcctttaactgccttcaatgcacttgatctttcagcaaaatgaacaaacccaaaatctctcttattcccagccttagcaggcggtaaaacgacttttgtgacctctccatgaatttcaaagatctccttaatcttctctttagaagcattctctggtaagttcttcacatatatagtcttcacctgtaaaagaaaaggccaatcagacaaatgttcctagggctcaacaaaacaaaattatatgacatttccaagctaattatctctatgaatataaaaaaatcaacaagctaagggtgccttgtacgaataggacaatccatccataacagaaacaaccttgcacaggttgagccagcgggcagtggtattgaatgagtagaataacttccaagtcaaacactcaatctaactagtatttcagattgctttaatctacatacaacaaagtgtcagattgctttaatctacatacaacaaagtgttgtcagttatacaatccttaaagtgccatgtagaaactaaaatcatgatgcagctgcatcctggaaatacatcaataaaatgatggttattttggttcaacaatggtaatcagtagttccagataacaaaaactaatgtgaatgagaaatgattaacataagaattacaaaatatttcatgtttctttgatcatttgccagttcctttagcaaattatggcacaaaagaaacaaatccaattcctcttttacaagtgagttaccccaataaaatagcaatataaacagttttttttcccaagggaccctagttcaatttgcagagctgcagtgcatccgttgagcatagaaagcgctgacttttcatttacagtgtatacctgggcagctgcagaagaagaatctgatgatgatgaacccttaggttcagcccagctgacggtcaactggctaccatcaaccttaaagtttggtgctgacaatttctgcttggcatagtctgcacaagcatggttataatactcaacaaagaggaacccacggttacggcttggatcatgtaaatcctgcaggaccaaaacaaggtctcaattagcaaattcggggccttcttagtgcaaagtacaaccatgaaatcacagacacgccttgaacatctcaatgttcacaacacctgggcccttcccctggattatgtttctcagctcgtcctcactcaaccccttgggtacattgccaacaaatagcctgtgctttgcctgtgacaatgagc

SEQ ID NO: 9096 - DNA, 634 bp, Oryza sativa
  unsure (1)..(634): unsure at all n locations
nnnnnnnnnnnnnnnnnnnnnnnnnnnnnnnnnnnnnnnnattcctggacgaggattttatgcacaaataagttcggttaattactagtgaatttccgggcgtgacattatgtcgtgggcttagcctaaggggatgtgtgccctagggcaaccctaggatgtccctaatcatatttattcagtagctgtcatagtttagagtcgagttttgtttagattgatctgtcaagaacagttttgccgctaaatcagtttgtgaaaccccaaattcgagtgcttaatcattcatatgctattgtgttgcaatctatcttgtttttacttgtgttcttcaatttgtatacaggaattagccttctcggcgaggtcaaccgggttttggcacggctgataaccagaggagacgttgtgctgcgattgcggggctcaagagcgtgttcgttcagaagccggatcgagttgtgtcacaacaccactaaatcgactgtttatcaatacctatcagaagatcgggacctaacatcctcatcagttggtatcaaagcgccagattgatcattaggtaatttatctacccataaccagacaattgccacacaaaaatattgcatccattacctagccaatttgagtt

SEQ ID NO: 9097 - DNA, 755 bp, Oryza sativa
tggtcccaacatgccgcgattcttgacagctagagatgcaattggtcagtgaagcaaacgaagcgcctactgccaactccagcgctcggtgcttgccatcatatgctgtcttgtaggtttgttgagcttgttccaaacgatcacggatggcgcgcagaaaatcatcccgttcttggagcgcctgttgtaccgccggcaaccttgtggagcccggctcgtaagctcgaagcgtcggcggctcgcgctcgtcgacaacacgaaacagagacgtccggagtgacgattggtacgacgtgttgtagcagtactctgcccatggcagccatcgaagccactgtcgaggacgatcgccagtgagacaatgtaggtacatggcaatgatcttatttgtcacctcggactggccgtcggattggggatgaaaagctgaggagagattcagctgaaccccagcgagccggaagatctctcgccaaaatgtgctggtgaagacagagtcgcgatcgctgacgatggtcagcggcacaccgtgcaggcgaacaatctccgcaaagaaggcggccgcaaccgaccgtcgccgtgtacgggtgggccaacggaatgaagtgagcaaacttggagaagcgatccaccaccgtcagaatgaccgtcttgccgcgaactcgtggaagcccctcaacgaagtccattgcaatgtcagcccagaccgctgacggtaccgcaataattgcaggaggccggctggctgaagatgc

SEQ ID NO: 9098 - DNA, 870 bp, Oryza sativa
  unsure (1)..(870): unsure at all n locations
ccttctggaacgctgccaactatttggccagctccggattcaaggccatgtaagtcgtgtcaatatgcccagctgccacctgagaatcggtgttaacgacaagccggggagcaccatagcccttgccttgcggagcacctgtaggatagctttgtgttcagtcgtgttattagtggccgagaactccaagcgcgccgcaaatgacgttgtgcggccggtgggcgaagtgattatcgcggctgcaccagtcctagacgcgttgcaggctctgtcagtgcgcgctgtccagatctcctccgtgggggcttcgactgctcggtgcaatgcctagtccattctacaataaaatccgctaggactagcgaatttatggtggaccgcgcgacaaagcagatggtgaaggaggctatctccacggcccacttgctgatacgccctgtggcttcccaattctagaacatgtcccctaacgggtacgacgtaggcacggtgatatcgtgagccaaaaagtaatgcctcagtttgcggtaagccattacaagggcataagctatcttctcgagttccgtaaactgcgtctttggccctgcgagggcctccgacacgtagtacaatgacttcgagctggagttgtcctccaacaccatcactgctgacactgccgctggtgaggcggacagaaaaaagagcagccccttacccagagcggtgttgctagggccgtcagcttggacagatgctctttgaggctctcgaaggcctggtggcactcctccgtccatcacaagggagacgccccccgaagcatagcgannnnnnnnnnnnnnnnnnnnnnnnnnnnnnnnnnnnnnnnnnnnnnnnnnnnnnnnn

SEQ ID NO: 9099 - DNA, 770 bp, Oryza sativa
gcacagtcccgcaagaaaaattatgcagaataccggtcgccgtgacttggaattcccagtgggtgattttgtaaacctcggggtccccccattgcagggtgtacacaggtttcagacgaaaggaaagcttgcacctcggtatgtgggtcctttccgtatccttgctcggcgcggagaggtcacttaccagctggagctgcccgcctccttgggcaacgtgcatgatgtgttccatgtgtcgcaacttaagaaatgtcttcgagtgccatccgagcaggccgactcagagcaaattgaagttcgcgaagatttgacctacgtggagaggccagtgaaaatcctggacaccatggagcgctggaccaggaaccgggtaatccgtttttgcaaggtccagtggagcaaccacgctgaagaagaagctacctgggagcgtgaagacgagctgaaggcagcccatcccgatctcttcgccagttcttccgaatctcggggtcgagattccgtttaaggggggtaggtttgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttgaaatggttttataaaaagaaaaatcccaa

SEQ ID NO: 9100 - DNA, 1164 bp, Oryza sativa
  unsure (1)..(1164): unsure at all n locations
nnnnnnnnnnnnnnnnnnnnnnnnnnnnnnnnnnnnnnnnnnnnnnnnnnnnnnnnttaatgttttttcaaacatggatcatgattttttgcatgaactttgcatttagttatcagatatctagtaaatttgtgagatatatatgcatttgagctgttttcatccgcggggctaaattattgttttatttaattaatttctagcatctttatataaattctatgaaacatgatttaattaactccgaatacccatgctaggaatcctgaagcctcatcttttcgctgatgcttatcagctaaaatttgaattttcaaccttaaatttggagttgattttgaaattttctcattgaagtttatttttcagcctttgtttttagatttgctaagaacacacatgtaaaaattatattcacaaataattcttcgtttgcaattgcttcgtctgcatctgctactgcatgttgacattgtagttgtttctatggacatttttgttacagcctatgatatatggtagaggaccagcaccagctggaatgaggatggtaccaatggtgctccctgacggtcgtctgggatatgttctgtaagataatctctgctgccctagagtcgcaaacaagtcttaccatatacaatatcttcatttccgttcccttggtgccgccaatccagccatcacgcaatgtgatggatttgtttaactaattatgaaacaagataaaagcttagacgctgttccagcataacacctgcaatagcctaagacatgtaccgtcgtcttctttcagttatacttatgtgttacgcatgtggtgcttgtgaattgaaaacagtcgtgttcaagttttgtatctcgcggtcgcggcagcgtctgtagtggtaaaccgatgggatggaagaattatctgcatacaattggacctacctggcagtttttcttcttgtgattatgggctcattggttgctgattatataagcagtaagccagtaacggcttatttttagggataaaaaatgatttgcaagtaaaaattactacatgtgtccttagtgtgacttaaaaaccaaagctaaaaaataaaactacattgaaaaacaaaactttaaaaccaacttttaaaacaagttttgataagccataggacgaatgatgag

SEQ ID NO: 9101 - DNA, 787 bp, Oryza sativa
ccagagccgataaggccttgtcagatccttcagagacgaaagaccatgtaagacctggtcgtgtaagagttctcgccgtgcgtattaaccaagccgtgtaatcggaaattgacttttccaacctcacggctgggggctaggatcagagctatttcaaccaagacaggccaggagtccaagagccttgtcacccgaggacatccctccgacgacaaggctgggggctaggaagagtgtacaactcaaacggctaactaaggtcgttaactgagaacacgctcttacaaacaacacccagagtaagaaacatttgttaaagatatatttctttattcacaaaatattccttacagttagcacataaatattatgtcaaattacgtcttttcccaagatatcttgttacagggtacaaattctaccaagaaggccaacgaaaatcttctcggccagcggcgacattgatctcgcgagatggtcaatctctgccggatttctccgagaacggccaaaaccctcacgaagaaattcgagatccaggcgcgggcggtgatctcgcacacaggccaacacatgccccccggcatatcgactcgctcgacgacactcttgcttcagggcctcgtcgatccgctgaccaatgccgtcgagttgagcgcaggctccattgagccacgagatgtaccggccgccgactcttcaggatcaccgcgggctacccgaagatctcggcacaccctcgccatcgaggtgcagcaattcttcagataagaggagaaccacacct

SEQ ID NO: 9102 - DNA, 798 bp, Oryza sativa
  unsure (1)..(798): unsure at all n locations
tctttacccacaagacacgcctttactctgcattccatggcaattggaacccatcataaaaaacgtgacataaccctttacccatcctagccgtgaccaaaagtaccgatccaaccctgcctacggccggtatcccgggacaggcaggccaggattgagcccctagcaataggatctagaccgggtgcgccacacgcataggggtgagaccacccgtgtactagtccagtgccatggcatctcgactagcgggcaccgacccgtgtagccttcatttgcctagacatctcgattaccgagccacagctcgcgtagccttcatttgcctcagagatatccatcgtcgcaacgacttcatccatctctatccgtgtccttttgttcaggactagactgagcaccgagttaagccttacccattagacatacggttagtacggtagtgctttgcaacagaggcccgagcttaatccttatattggccggggtgctacttcccacaactggcatgcacccaaaccccaccggaaaacaggttttaggggttttgaaagaggaagagacgggtatgtccaattccaccataagccaaccatttcatagtatccaagtgatatgagaattcccaaagtctaaagttataaaaccacctaatattgcctaattaatcagcgaagcatctacctaaattcatactagtggaactataaatagagtacccactagttgggttttatttgnnnnnnnnnnnnnnnnnnnnnnnnnnnnnnnnnnnnnnnnnnnnnnnnnnnnnnnnna

SEQ ID NO: 9103 - DNA, 3981 bp, Oryza sativa
atgccgccgttgttgggcgtctacctcttcaccgaccggccgcctcgtccgccgccgactggtgtttccgcctgcacggctggcctattatgccgccgttgttgggcgtctacctcttcaccgaccggcttgcctccgccgccgccgactggtgttttcgcctatacggttgccggactccgccgctgttaatgggcctcatcatcgacaccaccggcttggttccactggcgccaactggtgtttttgtcaccattgatggactacttcgatcccacatcggctacttctgccatcaccaagggaatactaaaaagctaactcatcattttttcttatatgatattttccttttcctctgcctcactacattaactggttcaccgttgactagtgagtcgggggctacagatgttatatcatattttcaacaattttcataatatttatcttgattgcttgcgatataatctgagtacaaatgtgcctatcgagttatggagttttatcttcctatgttctccgtttggtttgtcgatggatagttgcctttgggccgattcctagcacccgggggctcgttggatggaccgagtaacgcaaggtgctaagtattattcggaataaatcaaaagcataaagataagataaatttattttctgctctttacaattgcaaaagtacccgagtagtaaactccgatccgtgaaactttgttccattaatgacgaactcatgtcactcatatgcatgtctgggaagtgctttggccgactcccgatgcttggggactatgactagtcgggcagagtatttaaacgtaaggagtcatccgctcggggaaatcaaaattgacaagaggagaaatacatatttgtaaatattttaaatacttgaatttttctcgagtattatatttatatcagatactactcatccgatatgtttgttctgtaggatccagatccagatatgcatagaagggattcatggctttaagcttatctcctacgcttcaggaatggattagttagaacatcaccaccggcttgccgtcgtcgccaccgactggtgtcctcgcctatacggttaagtggtcacaccaccgttgttgggcgtctacatcttcaccgaccggcttgccttcgccgccgccgactggtattcctgcctgcatggccggcctattatgccgccgtttgttgggcgtctacgtcttcaccgaccggattgccttcgccgccgccgactggtgtctctgcctgcacggctggcctattatgccgccgtttgttgggcgtctacgctttcaccgaccggcttgccttcgctgccgccgactggtgtctccgcctgcagggctggtttattatgccgccgttgtaggacatctacatcttcttcgaccggccacctcgtatgacgccaactggtgctatcgtcttcacgactggccacgtctccgccactgcaaataggcgtcatcaccttcaacgcaagctgtctacgtctgctgccgactgctggtttatactgctaccactactgatggacgtcatcgttttcattgctggccgccttgtctgacgccgactggctcgttcacctccacggctgcgcgacttcgtcatcattgactggcatcatcgtcatcgctgtttgcttctgttgctgctgactcgtgttcacttcatcacggctatccaactttgtcatcatggtggagcaacttcatctttattatcttcggcaccggcaaactctattgctgctacttcgcaagttttgctacttcaccaaccacgacgtctttgtgaacctcgacatctcggcatgcgatgccgtgttattttactacaacaagtggctctccaatattcaggatttctacttggacatcttcaacacatatcttcaatcagcgctgctatacgtacgaattatttcgtacgatggttgtacgatcaaacggatccctcaggccttagttgatcccatatccaagcccaagctcctgacgtcctggcctgctatctggttggcttgcttggacagccaatgagccaaccaaagcaatttttatttcaatcatatcttaagcaatcctcttcctaatatcttactgtatatagtaattgtacttagcacccaacattgaatttatcatgtggcatggttaagcaaattacgcatacaaatatgttcctcgaaccttggacagtgataacattaaccctagtttcagattaaattaaaaataatggcatatgttttgcaaaggaaaattttagattaaatccataataataaagaaagcatttcatggccatgaacattgcctaggaaaaaaaagaaagagagaataatgtaaaaaaaaaaagatgattgtgaagctaaagaaaatcaagtaaataagatgccatacctttgtcttcgatgcgtatgctattggattagtttcacacttgcaggttagatcagaacatgaaagtcagatttagggtttggtgtagtgaacgtaaagtcaggtttagaggtaaattgggctttagggcccataagtacgcttagactgccgcgcgcgccgtgcgtgctgttttgccgttgccgtccgtgccgttgcgtcttatcgtaacaagatcgtactaaaaagatcgtatgtgtagcattttccatcttcaatcaagcaatgactattcgacgacaagaagctaaagttctcgactctatgttcagttgtttcccaactaatcaaagagtcgggggctacacaaatacatggctcaaaattcgacaagctttatgtcaagatgaattaatcaattaatcagccaacgagtcaactctgggagtcatcaattttgtcttcgctttagagcagtaggtcaagattaaatttacatgtctgggagtttggagtcatcaaccaatcaacttagtttcgacaagttggacaacatcatctactttccttcaagtgaagcatctccaacagctacaacattaaattttattgccatcttcataaatcaagaagcgttgcatcagtcttctttatgcatacacgctcgcatcaaggaaactactcgagctttatatcttctcaacagtttgatggattattatcactgacttcatcatcagcacctctacttcatcggccctgacatctctgccgttgctaatggatgactacgtcttcgcctccagttgcttccgtcattgccggcttgttatttcgccttcacggttgacctattataaaaacgctgatgagcgtcttcgtcattatcattggttgctacattgctattgactggatcaccgacatcgtcatcttcatcaatatcctgtcaagcctcttcaacatagcctattctactgctgtttgatgggcaacttcgtcattatatttgatcacctctattgctaccaatcgtcattactgtcggttacgtttgtcgtcgtcaactattttcttcatcttcatgattggtggatttcgtcatcgcctttgatctgcctcgtctgtcaccaactgattattttgctgccatggctacacaactttatcgctgggcgccttcatcttcattgttagttgatctgtctgctgccgactggtttcttcgcctccatggctatgcgacttcattacttttgattggtatcactatcttcactaccaccaatatttttgccacctctagtggacaatattatctctatattggtcatcttgtctatatgccaactgtgtcagctaccatcaatgaacaattgtgactatgacagaaggacaagctatatgctcaggagcttactagatcaaacacaagtatcataccttcaatttggacttgttccggatacatgcaacatgaattcatgatcatggttctattttctatgctcaaagactagactatttattattccccgtaaaggttatcaaccgaatacttgcgtcagtcaggatt

SEQ ID NO: 9104 - DNA, 3835 bp, Oryza sativa
  unsure (1)..(3835): unsure at all n locations
ctcactatcnggcgaattcgagctcggtacccgtttgcctaaacttaagaaagatcgtgatttggtttgtacaccgtgtcgtcatgctaagatggtttctacttcacatgctcctattgtttctgtgatgacggatgcaccgggacagcttttacatatggacactgttggtccagctagagtgcaatctgttcgaggaaagtggtatgtgttggttattgttgacgatttttctcgatattcttgggttttctttatggcaactaaggacgaagcttttcaacactttcgtggtttgtttcttcgattggagcttgaattttctggttctttgaaaagaattcgaagtgataatggtggagagtttaaaaatgcttcatttgaacaattttgcagcgaaagaggtcttgaacatgaattttcttctcctcgtgttcctcaacaaaatggtgttgttgaaaggaaaaatcgtgttttggttgagatggctagaacgatgttggatgaatacaaaactcctagaaaattttggcatgaggcgattaacactgcatgttatatttcaaatcgagttttcttgcaatctaaacttggaaaaacttcttatgaactactatggagattatgggtaccccatacccacacggcatggttatccgactagtcataggggatagcttatatctatggaatatgtaacagattatgacttgggtattacgtttccttttatattatggagcggcctaaagtcctgatttgataatattgtaaaatagatttaggaaaccgatatcgtattggttaaggtttctatcttataatcctgcccccccatcctatataaggtgggcaggaggccctctagggggcatgagacaactagatcatcagatctataatacatccggcggattcaaatccctaaacaggagtagggtattacctctcatcgagagggcctgaacctgtctaaatcctctgtctctgcatccatccacttttaggtcttgtgcgctaccccgtttgccgaattcatgtttcgacacttcgatttggtcatcaacccgaagtttcacatttgcgtgtttttggttgcaaatgttttgtcttaaaatctggaaagttggataagtttgaggaacgctctaccgacggattgtttcttggttaccccgcacatactcgtggctatcgtgtacttattttggggactaacaaaatcgtggagacttgcgaagtttcttttgatgaggctagtccaggtactagacccgatattgcaggtacactgtcacaggttcagggggaggatggtcgtatttttgaagacgagagcgactatgacgacaacgacgaggtcggctcggccggtcagacagggcgccaggccagtcagaccgctggcacacctccggtcagaccgacgcatgacgtgtggtcagaccggcctgggtcgtcggctgagggttctgttgatgctgctcgagatggtcctccagaaattactacttcgaccaatactgatacagaacgtggatcaacttcagaagttactgctcctttgcacattcaacgacgacatccgccggaacaaattattggtaatataggtgagcggactacaaggtctaaggtaacgactcatgatgtttgtgcaaattctgcatttgttgcttcttttgaacccaaagatgtgatgcattaactgatgaatcgtggattaacgccatgcatgaagaacttgaaaattttgagagaaacaaagtttggactttagttgaaccaccttctggacataatattattagaaccaagtgggttttcaaaaataaacaaaatgaagatggtttgattgtgagaaacaaagctagacttgttgctcaaggttttactaaagttgagggtttggattttgatgaaagttttgctcctgttgctagaattgaggcaactagacttttgttggcttttgctgcttcaaaaggttttaaattgtatcaaatggatgtgaaaagtgcttttctaaatggttttatacaggaggaagtttatgtcaaacaaccaccgggttttgaaaatcctgattttcccaaccatgtttttaaattgtctaaagctttgtatggtttgaaacaagctcctagggcatggtatgataggcttaataactttttgcttgcaaaaggttttacaatgggaaaggttgacaaaacgctttttgttcttaagcatggtgataatcaactttttgtttagatttatgtggatgatatcatctttggttgttcgactcacgctttggttgtagattttgctaagattatgcgcagggaatttgagatgagcatgattggtgagttatcgtactttttgggattgcaaattaagcaaacacctcaaggtacttttgtgcatcaaacgaagtatacgaaggatcttttgagactgttcaagatggagaattgcaagccaatttgaacaccaattggttctacagctgtgttggatcctgatgaagatggtgaagctgttgatcaaaaggaatatagaagtatgattggatctttgttgtatctaactgcttctaggccagacatacaatttgctgtgtgtttgtgtgcacgctttcaagcttctcctcgtgcttcacatcgtcaagcggtcaagcgaataatgaggtatttgaatcatacatgtcacgtccagataaattcatcccgaaataaaaatcattttctaaaaggaataatagaattaattaaaattcgaaaagaaattggcaaacactaaaatacgtacaagaaaagaaaaatttgaatgtggcccggagaatttttgttaaattctccttggtctaaaatgagccctcaaattttacttgaattttcagagcaccggaaatattattaagcaacaaaaacagttaacaaagtttattaaaaagaaaaagctaaaaataatccccctcctcactttgggccaagtctggcccaaagtcctccctctctatctctcggcccgaggccaaagtcctctcttcctccccctctttctctacctctcgacctctccctcggtacctgggcctccccttccccctcggcccagctccctcctctccccctcccacctgggccgtgtcccggcccagccgagcctccccaggccgcgccgcacgcgcccgtcacgcgcgctgaccgcgcgaccgcgtgggtcccaacacccggtcatctccttcctcccgcacgggctcttctctctcccgtgcaaaacctagcgccgttcctcctgcaaatccaccccattcgagccggctctttccaaattgattagggggaattaatcccctttccttcctgttcaattccccccaatttcccccttgattcgtgcccccaatcgtcgggaacgcccgcgccaaccccggtcacctttcatggccgccgaccacgaattccgccgccggtccccgtctctcccgtgggcggctccctcttctcccctataaaatggaacccctcgatccgttctccagttatagcccccctcccgcggtctaccgtgggctcaccacctattcccggcgtgcttctttttgttccgcgccgccggccaacttcaggcggctatgccngctcgcccgtgcggcggctgatgtcgccaccgcattccccggcactacgacgccatccttcttctcagcctcaccgtatcctcgccggaaacccaccggaggtgcgcccccgccggcaatcagtggcatcgccgcactgtaccgcctcccgtcggccgttcgccacacctaaagcgttggccgatgctgctgtcccct

SEQ ID NO: 9105 - DNA, 1590 bp, Oryza sativa
  unsure (1)..(1590): unsure at all n locations
nnnnnnnnnnnnnnnnnnnnnnnnnnnnnnnnnnnnnnnnnnnnnnnnnnnnnnnnnnnnnnnnnnttcggaggatccgctcttgccggaagttgaagcccacgttagcgaaagcgagctaggcaggtgacatcatctttgaccatattgaatcccagtttataaaattatgtggatttaaattatggcattatcgctttatttaaattcccgcgttatcactgttttatttagccatgcctatttacctttgttatgaccatattattattgttattgttattattattaccttgttcaccctaaaacaaacaaaacctaaactagcggtttaattttatgtatatgcttcgcaatttaattatgtaacattaagtggtttttcaactctcgactttgggaatactcatatcacttggacattatggaatggttggattattgtagaaatggacgcacacctccccctctattcaaaaccctcaaaatggttttaggctgggctcagggtgcatggttttgatagtagcaccttggccacataaggaccggtcttcgggcctctgttgcaaagcactaccgtacttccacatgtctagtgggtaaggcttagtttgtggctcagtctggttataaacaaaggtacatggatggagatggacgaagtcgagggtcgatggacatctctaggacaaatgaaggctacacgagctgcggcccggtagtcgaaatgtcatgtcacaaggctggtgtcctgctgctaggggctcagtcctgcctacctgtcctggaggttccggccgtaggtggggttgggtcggtacccttgtctatggctaggatgggttggaaactatgtgtcacatcctgatttttgtttcaggatttataaattatttaataaattattattagaatttatattaaatgttcattaatttacaagtgaagttaaatgtgggaaataaaatttcctaaatataaagcatggatggatttaattttttttttaaattctccatggttaattatactctctggaatattctcggatttttcagagctcaattcctaattttaatcatacaaagagcatttcagtaattacccacatattaaattaatcattaaatggtctaattataattttgttaagtactttgagtgtgcaagtattttcaaaattttcttggaattatttgagcatcggaagtatttttaacaattcaaagatcatttcattgattaatttaattggaaaaagtaaataaaaatcctcctcctcagcttgggccatttttggcccattccttcctttccttcctctctcttccgccggcccaacccgagccttcatcctctcttcttctctcagccaaagtccggttttgctccctcttctaatcaggctgagaaaagaaaagcccggcaagaagtctattatccttcccccgcgctactgttcatcttccagctccagccgccggctgtagctgagccgagccgccttgccgagtcgccttgccgcgcccgttcctccccaatctctccccttttcttccgattgtttgaggggtttttatcctctcg

SEQ ID NO: 9106 - DNA, 1050 bp, Oryza sativa
caagccgatgttgatgaagttgaggaagcttcagctaggttggttttgtcaccagagcaaacagtttttgtgaagccgaaagggacagagaatcggcatcttaagccattgtacattaacggttatgtcaatgggaagccgatgtccaagatgatggttgatggtggggctgctgtgaatttgatgccatatgctacattttggaagctaggcagaaatgctgaagatctcatcaagatgaacatggttctcaaggattttggtagcaatccattagaaataaaaggagttttgaatgtggaactgacagtcagcagcaaaaccgtccctacaacattttttgtcatcgatgggaagggttcctacagcttgctgcttggaagggattggattcatgctaattgttgtattccttcgaccatgcatcaatgcttgattcaatggcaaggcaaaaagattgagattgtgccatccgacaggtcagttaacgttgccagtgccgatttagctctttgggagatggacgatattgattgcttatctggaaaagtttgggatggagatattctaagagtgtccgattgtgatatacagccaattgaagatggagagcccaagttattattttgagggcgtcgtggagggttcaaacgtttacaccaaggacacagtagatgatctcgataacaagcaaggacaggatttcatgtcggccgatgatttggaagaaattgatattggaccaggtgatagaccaaggccgacattcatcagtaagaacttatctccagaatttagaaccaagttgatagagctcttaaaagaatacaaagattgctttgcttgggagtattacgagatgctaggactcagccgatcaattgttgaacatcggctacttatcaaaccgggtgttagactgtaccagcagccaccgagaagatgcaaagccgatatgctcgaacctgttaaggctgagattaaacgattgtatgatgctggttttattcgtccttgtcgatatgtcgagtggggggtaccgagctcgaa

SEQ ID NO: 9107 - DNA, 781 bp, Oryza sativa
tgacggaatttgatcttcggtatgatctaccgaaggcgatcaaggggcagactatagtcgattttattgttgatcatcgtgatgattcaatcggctcggttgagattgtgccttggactttgtttttcgatggatctgtgtgcactcatggttgtggtatcggcttggttacaatttcccctcgggggcaagttttgagttttcttacactattaaaccctatgcgaccaacaatcaggctgagtatgaagcggttctcaaagggttgcaattactcaaggaagttgaagccgatgctgttgagattatgggtgattccttgctggtgattagccaattggcgggagaatacgagtgcaaaaatgatacattaatggtttacaatgagaagtgccgagagttgatgaacgaatttcggctggtgactttgaagcatgtatctcgagaacagaatgttgaagctaatgatttggcccaaggggcatcgggatataagccgatgatgaaggatgtcaaagtagaagttgccacattaacagccgatgattggaggtatgatgtgcatcattatttgcataatccatctcgatcagcttctcggaaattgcgttataaggctttgaagtgtaccttgttggatgattagctttattatcgacgattgatggggtgcttaaatgtttgagtaacgaacaagccaaggttgcaatcggcgagctgcatgaaggaatttgtggaactcatcaaaaggctcataagatgaagtggttgcttcggcgtg

SEQ ID NO: 9108 - DNA, 905 bp, Oryza sativa
actcggagccttgccaccactaccagcagcggcgtcggatgcctcctcgaccaccttctccttcagagaagccgccacctggtgatccgcgagcggtccgatgacgtcagtcaagggaagggcctacgctaagtccgatcacaagctgattccaaatgaaggaggaaaaagacatctaaatagacttacattgatcgcctcgtcgcgttccgcctctcccttttcacaaaggggcacagggatgtcgctcgcggttgtcgcgccgctgatcatcacctgaccaacgcgtcgctccacgccgtcactgctcagagctatcaaagaagaatcattttccgataagtcaaaagcgaacgcgaatacggccatatcaaagtgaatacaagaaacataccccgaggagaaacccgggtcgcgtcatctggcctggaataattatacgccgggtgggctcgagcctgaagcggctggatactcctaccaacgaagtctgcaacgacttcataccccgataagccccgttctcgaagatcatcgatgatgtcgataaacgattggagagagggggtcaaagggggcttggcggtccaaaccggaatcttgtttggctgctcgtcaggaacaatgagggcaggattcgagtccttaatctcgagataaaaccacctgttctgccatttgctgcgagaagaggggcactggaaggggacgtgctgcgagaagaggggcactggaaggggacgtattgcgacttcatcccatcacgaagtcagaacccaacgcagccagacaccttgttgagttccatccacgcaactcgtaataaaagcgaaacaaatctagaaaaggctctactccaatgtaggcctcacaaagatgcacgaaaatgctgagaaatgcgatgg

SEQ ID NO: 9109 - DNA, 755 bp, Oryza sativa
accagccgctcctgccattccagtaagtcttgtctatgaaaatcttgaatcggctgaataactcattttgataatcacctgtcttcaaatttcttcttgcaggccttaagccgatctgtcttctttcgatatcaaagactatcttgatgaacaaacagaagaagacacccccagcaggccaaccattccacattttagttgttaagaaaattttaagaattaaaacactaacttgggtacattgctaggcttgcccataaccgagggcgtggctattcgaatagattatactctgatcagaggtgtacatctttacccacaagacacgtcttcctcacgtgtaaccacgtcccaacataccaccacggcatacggacgtaagacatgacatagtgtcacgcccggaaattcactagtaatttccgaacttatttgtgcataaaatcctcgtccaggaatcagccgaggtacacaaactgacaattttaatatacaaatccatcttaataataacgttacatacttaaaaagaaaagaaaacagcagcggaattaacggtctagcaatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatatagtctcat

SEQ ID NO: 9110 - DNA, 1478 bp, Oryza sativa
  unsure (1)..(1478): unsure at all n locations
nnnnnnnnnnnnnnnnnnnnnnnnnnnnnnnnnnnnnnnnnnnnnnnnnnnnnnnnnnnnnncctctgttgcaaaggactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggcgggattgggtctgtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtactcaagttagtgttttaattcttaaaacctgcttaacaactaaaatgtggaatggttggcctgggttggcataggacgagctgggacccagggtcgggttgccagttcggtctgtatcatcatcggccttgggttaaggcaggttcgtgtgggtacacggccttgattaatacaattgtatagctctagaatcgtgtttacaaaatagctttgagcaactaaatgtctttaaatgctgattactgcaaaccctaatcccttatattataactcccttgtactcctttgcatttattctgcactcgtgggtgtgtcttgttgagtacggtggttgtactcagtcttgctcaatttttcccaaacccagaagaggtgttcctggatgatgaaggctttggtgtctagctcgtgcctgccatcaagcgcatgtggtcgtcgccctagtcttccgctgtttttcgtttgtcttcatgtgtgctgggccttcgccgcccatgtaataaattaactatttacgcttccgcttgttaaactctgaaatgtatcaacttttggtgtaccttgcctcctgggacaaggaataatacacgcacgtaaggaacgcccgttgggttaattccggtcgtgacacccggtcagaccggctgcacaccctcggtcagaccggcctcggaggaatttttctgaaaattctaaaattgattttgcacgtggatatatgcctattggatcttctggtcgtgtgtttcagtactggattactaaatttttattattatctaacccagtactgaagcttcgacttcttctggtcgtgtgtctcagtactggattactaaatttttattattatctaaccccagtactgaagcttcgacttctgtttgtgtgtaggctttggtggcaaggaaggagaacgtgtggatcgtggattcctgttgttcgcggcacatgaccggtgataaa

SEQ ID NO: 9111 - DNA, 851 bp, Oryza sativa
tacatctcttgtggacatgagataaagttggatgggagacaaaccatagttgctacatcaccttccacagatgcacatgatgtaagtactttggtacaacaagtgctaagttctcagatgaagaaagcggggcaaaggtagtgccacaatttatttgaaacaaggtttgtggttaagaaaaagaagatatcgtgttataatcgatagtgggagttacaataaccttgtgagttcagatttagttgagaatcttgagttgcatgcacaaccgcatccttatccatattacatcaaatgggtcaactcttgtgataagttcaagttaaatagaactgtgagaataaaattcttgattggaagttaccatgatactacaaattttgatcttgtgcctttgcaagcttgttctttgatgtttggtcaaccatggatatatgatagtattgttttgcataatgatattgctaatacatacacatttaggcataatggttaaaaaaataaaattgttaacaatgagtaattttgaaattttcatagataatcttgaaaggttgaagaatagaatcaataatattgcgatgccttcaactaactctgagttattaaaaaatgaatgtattgttgtgcctcttgctttggatactaatattttgcaggtgtctgagaaccacaaatgtaactaggaagagaagaaacacagagagaaaaagacctatccatagctccatgcatgcttgaggaatgtttaattgaccaatcgcctataatttctgaagataggaaaaaaggtaatgataatggtgctacaactactcaaggtatgcataattatgatgtgccaactgttg

SEQ ID NO: 9112 - DNA, 4518 bp, Oryza sativa
  unsure (1)..(4518): unsure at all n locations
nnnnnnnnnnnnnnnnnnnnnnnnnnnnnnnnnnnnnnnnnnnnnnnnnnnnnnncgccgccgtcttcctccgctccggtcgccgttcccgtcgtcgccgtcgacccggggtgagccgtagaccgccgtttcgcttcccccttccctcccctctctcgggcgccgctccgccgcgccggtggtcaccggcggcgaccatcggggtgcgggtgcgccgcctcccgtcggctgtgccggcgtggccgccttcgggcgcgtcccgcggctgccatgtggggcccggccgtcagccgcccacgccctcgggtgcggctgacgcgtggggcccacggcgccggccggtgtgagccgcgtgcacccggtccaccgtggaccgtgaggctgccgcgtgggccccactcccgtggacccggtccgcgcgccctctcccctcggctgacgcaataaatccgattttaaattaaaatttaaatgaagaaattcgcaaatatccatttaaagagcatataaacttcaaatgaccataacttggccatttgaactcggaattggaccgttcaagtctctaatttttccttaagaagccaagaacccatttttgtgctttatttcggtttgttatatggagtttagtagagtaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaacttattgcattatcgctttatttaaattccgcgttatcactgttttatttagccatgcctatttacctttgttatgaccttattattattgttattgttattattaccttgttcaccctagaaccaacaaaaccccaactagtggacactctactaatggtaccactagtatgatttaaggtagatgcttcgctttaattaggtaacattaggtggttttataactctagactttgggaatattcatatcacctggacactttggaatggtttggttattgtggaattggcttcacaccgctccttcttttcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggattagagatggacgaagtcgggggtcgatggacatctctaggacaaatgaaggctacacgggctgcggttcggtagtcgagatgtcatggcacagggccggtgtcctgctgctaggggctcagtcctgcctacctgtcccgggagttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaagtaaaatgtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttacaaaatagctttgggcaactaaatatctttaaatgctgtttactgcaaccctaaccctttatattataactcctttgtactcccttgcatttattctgcacttgtgggtgtgtcttgttgagtacggtggttgtactcagtcttgctcaatttttcccaaacctagaagaggagttcctagaggatgaaggctttggtgtctagctcgtgcctgccgtcaagtgcctgtggtcgtcgccctagtcttccgctgtttctcgtttgtctttgcgtgtgctgggccttcgctgcccatgtaataaattaactatttacgcttccgcttgttaaactctgaattgtatcaacttttggtgtaccttgcctcctgggacaaggattaatgcacgcacgtaaggaatgcccgttgggttatttccggtcgtgacaagttggtatcagagcccccttgaccctaggacgagccgtagatcccaagccttagcaatattttcaaaaataaaaatcctttgttatttgtgaaaactgtctagtctctctctgtcttgctgcttcatttatcgccaaaatctgacctttaaaatgtggtttttcttttgttttgtttgtagatggccggcagcgtcagccgtcgtggtctggacatgactggtttcgtcttggagctgcggggcatgtgcgttgtcctggggtatccacatggagtggactaccagggcaggccgcttccggagcaggagggtgacgatgcagagccccacgctgcttgggaggttactgcagtgatcctcactggctctcccgagcggacttcgttggcagtcaccgcgggtggagattctttccccgccgcttgccagaacgccgctctcctcgccatcggcactcttcaccagcgctacccggacgagttgcagcactcgccctaccgctaccaccctcgccgcggaggagcccgcgactacgccatcttccgggatgctagctcggaggatgacgctaccatcatgcacctggcgcgcatggtggaggcgtacgacgcggctcgtatcgacttccatcagatggtgcgccgtgggatggtcgggaacaacatgaagatcctggagctgcgtcaagagaatctgcagctcaagaaggacctagacgcagtggaggcgcagctgcatcagctcaagatcgcccagggagaggtctgccaccccaagcgtcgccgtgtctgccgcagccagaagatcaccgcccgcaagagcacctccaggcccgagcttgttcgtcagtccctggcgtggacttgcttcgtcgagacccctcgtgccgagcccgcgcccgtggttccccaggagggggaagcctccggcgttggtagcacggaggatgcgctgttgctcaccttccgtgctggcccgtcgcagcggtagacgaggagttagtaggcttgcgcgtgtgttctttctcgtttgtcttcttgttgggttgtgtggggcatggttatgccggtgtgtggtataactgtgtcggagcctatctttattttatttgcctaagcaacttgaactttaatgaaccaatttaatagcagtaataaattcaagaattatggtagtcgtgggtggttagctttaattgttagctctctctgtttgctggttctgtgtggggttttcagatggtgacgaccaggagaaatgctaacaccggtgatggcaaccaacctgaaggcagcaaccaccaccaccagggcagcccacctccacctcctcctccgcctccaccaccaccaccagataccaacgccattctcacccaaatcctcgcccagcaggccaacatgatgactgctttcctccaccacatccaaaatccgccacaacataatgctccaccaccacccccacaacactctaaactcgccgagttcctccgcatccgcccacctaccttctctagctccaacaaccccatggatgcgttggattggttgcatgccgtggggaaaaagctagacactgtgcagtgcagcggagctcaattcctaaatgatacaaagaacagttcagtaattatttgatcaataatgatctaattataattgttaagtgcttttatcgtttaaaatccttaaattataaattgttgtttaaaaggaattattagaaatgattttaaaagcttaaaagagaagatctaagtttaatttgctaaatctcaatataaaattgggctagataaaattttattaaatactttgcttgttcctctattttctagaattttctgggaattgtttgagcaagggaagtatttttaataattgaaacaacatttcaccatttattttaattaaaaagttccaaaacccctccctaaagttgttgggccgtttccggcccaactcttctcttcccgcgcgcggccaagccggcccaagtcggcccagccgagccgccccgccccctccttctctagccaccgacatgtggggcccacatgtcggggtcatccctaacctccagccggccggccgcctagccgagcccgagctgccgcctctttccgccaatttcgcctcttccggtcgccctcgagtccgattagttgaggggtttttatccccacatcctcctctatctttcccctcagaatcggagctattcgttgagtattttggccgaat

SEQ ID NO: 9113 - DNA, 994 bp, Oryza sativa
ctaattaaccgtaactctgtttcaggtggttcaagttgctaaatttttctaaaatcaagatctacatgttaaaaatattcacatgtactgtttatgcttgtttttttgtactgttttattgatttttattctttcgctttagtttccgacgttccggaggagagcgtttccgttgaggaaggttccgaagcgtttgcggaagcccaaggcaaatcacacagatcccaaacaaccctttgagcatgttaaacccgtttaaagctattattttatttcaactatgcattattttttaatgtcatcgggtggtgaacctttccccattaattaatggccgaagatgatcttattttcctatgggttataatttgattagcatgaaccttatatattggattggttcagctaaatgctatatgtaagtttgcttagctatgcttagaaacattagctaactaaaggggttaattataaactatattatattatattattattatggttatatttaatggtcgctcacgatggttaatcgtgtgatgttaattaattgataattaaaatctggataaggtgggttgtgagcatatggttttgatggttgtgctcatgacaattaaggaccggttcgcgagctactgttgtgaaacatttaccgtgccaaccacaagccagcgtgggcaacggctttatcttttgtatagcatgattcattatagtgcgccagactgtgaagcggcgagaagtccatgggggttgctggggagtccatgccttgtttataagggggtgattatgatccaggaaaggtgcgctgtaatggcttatgttgtgcaaggggtattgtcacaactcctttccgaggtaccgtggtggtattgaggcacatggtgacatgatgtggggttgtgtcttgtgggtacagtggtacacgtctggccagagtaaaactattcgaatagcagagcccgcggttatgggcgggttgagcaat

SEQ ID NO: 9114 - DNA, 6224 bp, Oryza sativa
  unsure (1)..(6224): unsure at all n locations
nnnnnnnnnnnnnnnnnnnnnnnnnnnnnnnnnnnnnnnnnnnnnnnnnnnnnnnnnnnntcaatgtcctttacactactattcaatattgcagcaggaagccttagatgattagatcacctcatcatacaggaactaaagattattatgcccccttaagacaagaccgtctaaattgcaatacaggaacttaacataaagtattttgtcacagaacattaagcagctaaaacatagctaaacaacagagaccactcactccatcatagcccaaattaagatttatcttatccaaatgcgtttgccaccatcacttctggaatttttagtgatcaaaggaaagtatagaaaccgagaattattatatgttcaagaagcaaaaccactgagtacatgatgaaacaagatctacaggaactaacctgcaaagcatttttctatatatataattttgacaacggaaataggagtttatttcagagaaaagaagtgctaagattttccgcacctaatgatcagtgatctcaactggatgcatgctcttcagaggtacatagatggattgcattaattaaagtccaatttatttcaggctaagaagataaggacacaaaatggtaaaagtgcaaatcagtaagtataaaaatgccaacttgaattaatatactcatacgaattntctgtaaaatactttagtttgcatatattcagaacatatgaagtacttgcattctctgcatttgtaaatgcccctaaaaggattggaatgaacattaatccacaaattttatatacttaatttagtagtctgagtaagtaattatccaaattctatagttcaacatataaattttctgctgagctcaacacctataaggtatgttcaagacttctagtggagtaacatccctgtctacgtttcctgatcaggcaagcaaagatgaccgtgatgcactatatatagtcaaaatctaaactttgtacaggattaacaaattcttgaatcaagttatatatctttcttgaaaactgataacaaatgcattttgatcagcaaaataattaagttaaaaagatttgtcagagttatttaagatccaaagcaatgataattaatatacgaaacctgtaaagcttgtatattgaggagatgcgagggtcagcgagaatgagtaccgccgcaaaggggaagtacaacaagcctgcccacccctggacgtgtggccctcgcacctgagcataaacgcatcaaactaatcatgctagctactgcgcacaaagtaagaatgactaattaaaagaaaatacccgtttatcactgaaaatggggatctgcaggaggaccatgcggcgctggacggatccagtcgccccaaggtagggaacagccggatctgacaacccccattcccctccaatgtcgtggcggttagaccgaccaggaggatggaggagacaccagctccggcggctggctatgggaatggagtgcggcggcgccggcgctggcgcctgatgacacaagagggagggcagcgccaatagctagatggacgagggagcccgaatggagagtggagacacggcgatgggagagcgggcgtacgcgggcgagggggagccgggggagagcgagcggcggcgcacgcctgattttgcgagggcgagatgcgagagcggaggaggtgagagaagtctagggtttgtccggaaggggatgagagataaagaccggagattactaagcgcgcgcagggaaacgaaaaattggccccagcccgcgaacacatctgatttttggcctggcctcctcgcgctcgcataaacgaggttaccgacagataggtagtcctaattatcagtaacattaccgacagactttatgtccttatttttctgagaactaccgacagaccagctgtcacaatgctttctcgacagaacatatgacgttgaatagcaatatttcccaacagatatctgtcgcgaattctggtacatggtgtagtgagtttttaataagacaaatggttaaacatgtttaaaaatgtcaacggtgtcaaatatttagagacggagggagtaatctcttcatttccattcccttgatgccgcaaatccagccatcacgcaatgcgatggattttttttaactaattatgaaacaagatagaagcttagacgctggtccagcataacacctgcaatagcctaagacatgtaccgtcgttttctttcagttatacttatgtgccatgcatgtggtgcttgtgaattgaaaacagtcgtgttcaagttttgtatctcgcggtcgcggcagcgtctgtagtggtaaaccgatgggatgaaagaattatctgcagacatacagttggacctacctgccagtttttcttcttgtgattttgggtcattggttgctgcttatataagccgtaacagcttatttttagggataaaaaatgatttgcaagtaaaaattactacatgtgtccttagtgatttaaaagccaaagctgaaaaataaaactacattgaaaaaaaaatcaaaaaaccaactttaaaatcaaattttaaaattcaagttttgataagccattaattggacgaatgatgacgctcctttttaccccatcattgctcctctgtccaggaagagtattgtagcgtgcttgccaagatgtaaggcaataggatggacgaatttcttctgttacaaacaaatttggtataaaattttgaaggcaatcaatctgattaaataaacttaagtcgaccaacaacatttaaatagtctcgtttgacagattacaatgctaatcaaaacaatgtgaaaaaattgtgaatctaaaatcagggaggcgcctccccgtcaaccaccggtgctccacgacgtccttcgccgtcagcctcttcccgtcatcatcttgtcaaaggcaagcagtcaaaggttaacagctgccgccgagtctgcaccccttgaaccgccctccgcggaaggcaaaggaaatcacatatgaagatgcacggaggcggtgataccctgaaccctctgatggctgtggctgctgctgttgtaccatattatacactttgatttttttccctatgttaagcttatttaattttaattaaatttataacgaaatatagcaacacctacaacaccaaattgcttttattaaatctagcattgaatataattggttttattaaattggtttattttatgttgaaaatgttactatatttttctatagatttgatcaaatatacataagtttaacttagaaaaaaattgaaaacgttagagggagtataatgctagtgccaccaataatgatcatcagactccaaccgtccaacgccactcatggttggggatgtcaacattaagtcatcccgtgctgcaaggtgggttgtggcgatctacctgccttcttcgttcgatctctatgttaacgttccttcattaacgctgacgcctacatgtggtgcctgctagcagtcatgctgcgagaagtctacatggtgttggtctgagtggtgacgatgtatattggatctgttattgccggatgcgcccgtcgctatgacatggtctgaatgtttgctctctttgagagaattttgtaataagtggttatagcttatttgaagtaaaggcttgaatttattccattatccaaaaaattcaccgcatcatcttcaaaactatattgacattgaaacgtaacctaatcatgtgatttttttaattattatattagtttttcttgttgcaatgtatgagaagatgaataagcgaaaggttgacttgatacattgtaatgcatgggcatttttgctggtgtatgggcctgtttggcatggcaccacctcttgctctagctcttgctccaacttgtcttggagctggagcccaaccaaaaggtttctgcttgacaaaaaaaaaggatcggagctaactagagtgctcttataaaataaactagaaaagttgagctaggtttaggctactccacaactccactctatatccaactcctgaagttaaatttaggagtttaagcccaaccaaatgggcctatgtatagaaatataaaatattttgagaacaaatgttagacatttccttcttggcacatattggaacccaataatgcataggtggcaagccaatctatctctgtaaactatgcaagattacactaaaatctttgcaaggataatgactttttttactttagatatagctaagcaatgttacagtacatgcacatcaatgaaatatttccaagccacgtgctacaatcaaaacaaccatagacaatatataacatgacctgagttccacacaacaacaatagattacacagttttgtactacaatacacaaaaatcgattcaaattacagaaaacataaataggagatacatacttgaaaaacacaatttactttaaatgaaatgacaccgattgataacattgattatatcatgcctaccacaaaatacatatttttgtttgtagctcctatcttcctattgtccaccttctagttaagtggagtggctggtgcagaaagcatcgcactgcttcttgcactgatgctggcaccaaagtgcttaggagttccctcgatagtaatctactcacagtgttgaggacttacactataatttccctatccacacttccttgatcttctcagcataacaaatcgttctgctacctccttcatatcaggtcgctcttcaaccttttctttcaaacactccattgccaacctgccaatttcttctaggattaggatatcttcttcatttgcaatctccttgtcgaacattatcctcccactgttctcttgatcataggcattttggaactcaatgatgaggctacaattttcaccatatattgttggctttctacatatgagctctagcagtacaactccaaaactgtatacatcactcttttgtgttaaatggccggtcttatggaatactggatctatgtagcccatgcttcctacaacaaacatggtgaaatctttgtctacattaagaagcttagatgttccaaaatatgagatcttggggataaacttatctgttaaaagtatgttggccggcttgacatcaccatgtcgtatggtacgacttgttgatgagtgcatgtaccttagaccttcagctgattcaattgcgatgtctaggcgtaagcccaacgggagagggatgttggcatcaccatggagaatgtcttgcagattccccttagcggcaaactcatacaccaacattggaacatccacttccaagcaacaacccaaaagcttgataatgttattatgcatcatttgcgattggatgatcacttcatttgtgaaatcatcctttcgagcttcatttacttcgattgacgtcttcactgcaaccggagtattgtcttcaagagtccctttgtacaccttaccaaagcttccttgaccaagaacttctgaattattctttgtgattttctttagctcatctttggtgaaaatcttgatattgtccactttctgtagcactgaaccaccattctttttgaaatattcattcatttttcgctttttgtgcatcattagcgtgaaaagaacagcaacaattaggaaggaaaatcccaaagtgattcctacgaaagttaaaaaaaacttattagcaaacataacaaatccatatatgagttgcagtattattttttaatagaaatactccctctatcccaaaatataaggctcaaccactcataacacaaagaccaagaaataatttaatcaccttcttgattggatcacatccatacatgcaagcaatttgattggaggatttaacggtagatgatttaaaataaaccaaatttaaagaaccaagaggtgatggctaatgtatgcaagccttatattgtgagacatggaaaaaaagtggttgtgccttatattttgggtagagggagtatgaatgaaggctcattttatttgataaatattattgtgaacaactaatgttatattaatattggcgtgcacaatatattgctgtaactaatctttagtgcaggttccttacacaatatacaattttctggttatgtttcaaaatatcttgcatgtattttttttgaaaagtcattctatgtgggaattagagagaaatcacttacaaacaaaataaca

SEQ ID NO: 9115 - DNA, 11585 bp, Oryza sativa
ttaaataaggatgtttgaattgcccaaaatgagtaagttggtaaagaaaataaataagggatggttatgatttttttaaaccacttagtttatattgctccaatggtttaccaacaatattgtcgctttctacaatatgccactggatttatcaattgtttctacaatatatgaacatttaaaaaaaaatcaaaatacccttgtagacaagcatccaaaggttgacaattgatttatctcattatacgtttaaaaaattatgaaatttttggtgtagtttccttacacaacatagaattttctgtttatgtttcaaaatttcttgcatgtattttttgaaaagtctttttatgtggcattagagagaaataacttacacaaaaaaatgaaaatattttgtgtagcacatgaaagatgatttgtacagaaatacaacaccacagaaaagtatactatgtgagacataacagaaatattatattttatagaaaaataataaaatgtaaaaagcgtgaaacttatacaaacttatattcttatattatgtgctaggaggctaatttttttaaattgttgattttttttttagttttgtcaattaactgccaacccttatatttttaggcattataagaaattctttgtttggctgaatggtaaattgtagaaataattgaaaaacatagtcgatgggaaatcattgaattggtgtaaactcaagacatatatatagtatattatttcatatattttttaaaaattttgaggtgcatatgtacctagggcaagccttgctgcaagagggaattttgagctgcactcttgtttcttggggccttcaccactccactggtaacccacacggcagtggcattcataatcccctgggatgttgttgcagacaccgtagcagggatatttcttcttgttggacacatcacactcgttgatgtctgtgcatataaaagggagcatatatattagttgttagatcaactgttactagtaaaaaaagaattaattttcgtaggctttggcttctttttcctttttctttttgacaggaacctagctcaaaatgaaaatcacctgtcaagatggcttaggctgtcccaggattataaaccatctatgaaaacctattttttaattggcaaattcttaaaaaaccgcctataaaatttgtagctcttcatgaaatctacattgaaagttttctttccattttagatagtacatttagatgtctaaatattcgttacaaactcttcagacctatttttgaaaatgaacttttgagtatttcaaatgatcttggatgaagacattctatattaaaattgtagagcataactagatctacaactttgtactagtaaatatttttataagctctagtatctatttttgtataagtggttctttaagaaatcaaatttttaggaactcatagaaaattcattttaagtcctattgaggttaactaaagttctccaagatcgttctagtaagacttaggctctgtttgagtctcctgaagatgaagatgaagataaaaatgaagattaagtgttttacgtaaaacaatgtggtaataacttgtgattaattgagttttaattattataaacatgaaaaaatggattaatctgatattttgaacaacttttatatagaaaattttcacacgaaacgcactgtttagcagtttgaaaagcatgccacaaaaatccaaaactttatctcccatgtgttgggttcttaaacatgaccttagtaactccctccgtcccaaaatataacaacttcgagcctccagatctttatcccaaaatataacaacttctacaccaatattctcttctcaagcaatcataatctcctatcattcaaatttcccatggagctccacttttcatccaaacacaaccgtcccctatttaattctacatactttcttaataaccatatccaaccctaaatatgcttatattctagaaggagggagtaatatttttcttagaacattttttttagtatggtcattcactaatgtcacgttagataacatatcaactcatatagaggtaaatgataagtaaacaattatactaacataaatataaatgaaaaatattgtaagggtcatatatagctttggtcacctcatttgaacttaaaatgaactttccataaatctttaaagtttagacattttcaaagaataacaagttttttcagatggacttcctaaagaaatgtcattttagacgattctcgtatggaaaggctcgcaaaaatcaacttttgaggcggttctcttgaaaataccacccttaaaaataatagcactactacaataggaaaggagtagtatcttgatatatatgaagtcgtatgatgaaaaaatctttttatgaaaattggagagctctacaactatatagttgaatgttttttcattcgagactttttacgggtcctgatattcgttacgaaatctcaaatctattgttgaataaacaaacttttatgtttttaaatgaactcagatggagctgttccctatatcaaaattgtagagctcgatgtgatctacaaatttgtggttgataaattttccttttgatatcatttatagtgcaatttatatattacaagttttagagaggcgaagtcaaaagaataagcatctctcccacatgcacaaagttctttataggcgagatggtaaggacgctacttgaagaagaggtccccgttcaaatcctatataccacacgtgtgcaaaattacgcaactcgtgaaacttgcgacatgcggccgtgtatatatagttgcttactaaaatacaaaatatgtttttccttttttttgcgcctaaatcaaatagcgaaaagatcaaatgaaacctggtagattttttttagataatgaatttaaacaccaacagggttgatgtacacaacgaaaggtaaaaataaaggtaaaatggtggcactatttagcaaaactgttagctaataaaataaaaacattaatcttacccttgcaaccttggtccttgtcgtaggggttaccctcgtagccttgcttgcacttgcagtagtatccgggaccgttggtggagttgacgcactcgctgttgtcgctcacacacgcgtacccagccggtttcttctcctgcacctccagtggagggcaggtaacggagtcacggatggcccagtccagccacaccggcatggttcggttgaggtccatcttgagatcggcgctacggaactcgtactcgttcttgtcgacgaggaaggagtagtcgcaggggctgaagtctacctggaagccacgcgtccagggcccgaaggagacgacgttgtcggtgaggcccggcgagatgtcgacatggcagcagccgacgccggcgcaccggccatcctgcgcgctccgggagtcgttgcagtaggtgacgcagccggtgtagaagagtccgctgtagtgggtgttgctgccaccgctgttcccattctgtgtgtaggacagggtgttgcacccgatcacaacgaacatgttgcggctgtcggagatgcggtacacgccgttgttgttgaggtctacatcgccgtagaacctcctggtgacgttgtcgccggcgtcgtagcacttgtacgccacgggaagcatcaccttcacctccgggagctgttccaccgacaggctctgcacatggatgctgccgttggcggcggcgagggtcggcaccaggtcgccgttgccgtttcgggtgttgcaggcgatctcgaagccctccccacgggagcagttggggccgatgccgaacgggtagggaatgtcgacgtcgccgcacctagcctggcagccggcaggccggccggtgacgacgctctcgtcgccggcggcggaagccaaaagcagcaggctggcaagtagccagcatgtggccatcgacgtgtatacgtttatatacgacgtagtagtattaactcgtttctttctttttcctagcttggtttgaatcagctggagtagctagcacactcgcctatgtcccccgggcatgtacttatatagcagccgatcccatccatcatccagcctgttctgcaagttgtcatgctcttcctcatattataattcctccgtcccagattcccttgagtactagtaatgcttgagtactagtattgtaatgcttgagtactagtattgtaagtggcactacttaattagatccttaaagtatggtaaaatatattcagtacgcgctctctatttggttttatcaagaggccctttcgtaagtcgtccgattagttgaaaaacaagaccacttgcaagaaaaaaaggaccatatgctatttgctacatgtcatgtcgattcgcatgcatgctatgaggttaataccattacactaatacattttatttttggtacaaaatctttgataacttatatgttttagactgcatattatttgtaagatccgtagcaacataccgttagaagtgttacttccatatttttaaaaagttactttcctccagcagtgtagttacttttaatattatcataaagagttactttctatatgacgccatattttaattttttaaaaaatataacacagtgattactttaaataacgaatatatgtatttacttgaaaatcttttctacactttgcttgtaaatttattccacatattttttttatttcaactcagtcataatgtaattacttttagtgctaaagagaattacttctattatatagctaagttacttctgcaatgtaaatataaattactttcaaattaataaaatgtttgaatatattaaccgttggtctcgttttgtcatatattttgagtggagtacaatggtgcaaatatatttttaaaataatatacagtttaaaagataaaagttatcaaagaggtttagaaaaatgtgcactattgttttttttagctaaagaggattcatatgtgagatagagtggtcgttgctttaaccaaactagcgaccggtaactgtgtagtcgtgtcctggcttgcgtggtgtaacgtcccgattttcgttcgggattaaaaatcattaataatgcattttctagaaattaaattaaagttaaagcaatttaattaagtgaaataatgggagaattaaaatttttccttaaaaatcattggctgaggatattttgtaatattctttgtgccctaaaataccctccggatttttccatgaatttttggagctcaaaaaataatttccatgaatttttggagctcaaaaaataattttaaagtcacaaagttcattaaactcatttatataaaaagaaaacgaattaaatcttctcccctccctcccttgggctcggcccaagtctccttccccctccactggccgctctcttcttctcctccttcctttgggtcgtcagcccagccggcctctctctcgtgcgaagttcgtttcgcctccctcctctacccgagccgccaataggtgggccccacctgtcggggttatccccttcctccaaccacccagccgccatggccggtcattgccacccacgtcccgccgaatccggcgccctcccgctcgcgtcctcaagcccaaaccgagtggaatcggttcccctccatctcccccactctcccccacttcccccctcaaaaatcgtcggccgttgttgcttcgattccgccatgtccggccatgttctccacctccgagcttataaaaatgcaccccggcctcccttcatccgtttcctcaactcgccgctccttcccgcgcctcctacctcccccagtctgccgagcccacgcctcgccacttgtgctggcagctccgctgcatcaagccctatcccagccgctgctccgctccaccaaactgccgcctaaacgctttcttccctgtgcacctgagccaccaccaacttacaccacctccagccgccagccactgccgccctagtggccgccgcgctgcgccaccgccgtcatcggcatcgctgtgccgagctccaccccggcagccgctcctctgcctccaaccaccaccaaaacacaaccccaccgcaaaacccacgccgccactgcccttgccgcctccgaccagcaatcatcgccgtcttagccgctgtcgtcgctcgccatcacctccgtcggcttcgccgtcgagtaccgcacctcggccacctcctggccctagtcatccaccgctggagtcctcttctccccgtcgaggtgagttttttccccgtcgccggcctccggccgctatttcccaccgccttgtgcctcccctttcccgtctaacccctcccttctcctcctcagctcgcggccgtgcctgtccgccccttcccaagcgccacccaccgtcgtgcacttggcgaggactcccacctccttttccttttcaccggccgcgctgcgctgccgctgcccacgtcatcgccgccggtggccgcgccgccgcgtgccgtcgctcggctgggctgtcctgagctgtgcccatgccatgccgtgcttgcccgtggccgcccgatcggccgccctcactaatctaggccatccacgtgttgccatggtgccaccccatgtcggtgccctcgtggcaccacgtcggccttcccgtctgccgtggtcaccacgtggccgccacatggtgtgcccgcggaccggtccaccgtgcacccgcttcccttgagccaccgacaggtggggcccgcttgccggtgccaccaattcccctcggtgacgtcataattcacattaattgtgcaaattatagaaattcatttaaaatgtctcaaaacttctaaaattcataactaattcatacgaactccatattgggccattcaacttgcaaaattcatctaaaaatgagctatacatgtttgtttactttttatgtactgtttacttggtttttattagagttttttctcattttgtgtgccagcgcgtagattccgccggttcagaagtttgctttcgcctcagataagagttcagaagattgttttgaagaagcaaggcaagtcacacattccccttaagcatttttagcctaatttataaatgttttatcgtttacaaataaatatgcatgtttttctaattacatgggaatatggtttacctattgttggctgttgttaaacaccgattctataccaccaacatctgcataaagttcaaataataaaacattcagcatagtgataggtgcttaatctcacatattccacaagtgttggtgtatatttgtatgcagatgataaaccctgaagttgaaaggaaaatcagactaaagtgagaagaaacatgtatccatacaaggatgggttgtgaaattcctcaaaatatcaaagactcagcccaaaactccgagaaatggataaaggaggaccaggggaggagatgggccgaaggccaggccaggtgggcccagcccaggttcgagcgaaccccttggttcggctgaaccaaaatctcagccgtttaggctggggtttggcgtggacggtcctggtcatctcctgatggcggttgctgggcatttctgacaattcgcattgtgtaagcgtcatacctacctctatataaggagcttcactctttcactctcacacacacttccaagcttgtgctgaattataagaggctctattgtactatattgtatactagaataggaagagattagagtagaagaagtcggatgaattctggagttgtcggtaatcttctctcatttctcttattctgtttattactctgaattcaatataatattcttcttgagtaatttagatttatctcgtgagaattatctcttggttagttcctaaatagcatacgagacaattgttcactatagttcatttatttatagtgattgctttagtgtttgattggcactagagtagttattaattgcgtagacgcggtgtctgggtaattaatcttcagtggttgctgcgtatcccatagtacatttgaggtaggtgtagaggtggtgacagccctagacactatttctctagacactgttaaacttaagtattgcgttaggattaaatttaagctttccctagacactgtttctcactagtaaatctactctatcctggcctatcatttgcttgctgtccttggatgaaccggaggaagatctgaccacatatgctcccttggattcgataccctttggaatactccgtaggggaagtgctacatcggtatatctgtgcccttgcggattttatctgtgatccaatttggaggtagttttgcaataatgcacccgaccacaaatttgtcgggtaagatacacttcaagagttcgagttctttagccagtactcacccagaagcatttcatagctgtcagccaaagagtgacccttatctgcaatctctaaaaatgcacaccggtgaatttatccggcctcagtgcattggcaaaaccagcttacgagcgacggcgcagcacagagtaggaggcaaacccaaaacaaacaaaactgaatttcccgtagcaaaacaaaactacaaaaggaggctgaatctgcgcaagggtgaggaaccaattttgcggaccattcgacgcgtacgttgtgcatgcgcgccacttgccctgcctggccaggcgaggcgagcgagcgcgcgcatgtgttccccctcttccctccacctcacatgcttcatgtagctaggagggtatcttcccttttaaggaggtccccctcttctagaataaacaaggtggtactaaactctctatgcatgccatcccatgagctggttttttgtgattttctaaagaattaatcttcgaatgggctaaggctcatctattaattccaataagtgcgagaccgcacggtctcgtggaatggaagagcgagaccgttcggtctcgctgaagcaatgagcgacactgtctaacggctccttttcattagtgattaattactcaattaacaattaactaataaaaaattagtgattaattatctgattagcgattaagtaataattaattaattactaatcagataattaatcactaattaaatcggcatgacacggtatcgctgttgcttccgcaagaccgaacagtctcgctcttccatttcggtctcgcgctttataccgcccgtgacgttgttcctgcgtcattttcacgtaattgttatgtgagaccgacattatatttctgtaaaaatttttgtatcccgaatatttctgagaaaaaatagaataaacagtatattttgaaatttgattcccagtgtttcagggattgtttagctagcttgctaccactttcatccttatgaatttttacatcaccagattttgctaggggaacaaaacatactcttgtcattatcaccataccaaaatttattatttctggtaattcttcttataaaacattgccggaatttggtaaagctacaaaccaagcatgaccaacgttaaaaaaatttggtaattacgctataatttaccaaaatttaccaatgcagatttcgaattttagcaagaggttcgttttggtgacaaactgaacaactactaccgcttgttgggcgagaatcctcttgctcggttgcccaatttgaagagaaaaaatgggcatacttgctacggcatgcatgcaagacgagtactaactagtttctttttctttttttctcatcactttaaatgttttttctcctaaactacctacccgatttatgatccgatcataccattgaatttgttgcaattaaatctttataataagatatcacatgattatattttcataaaataaaaatatatgttttagactgttaaaacttaatgtttcctgtgtagtaacgacatgtttcaaagtgtgcattcgctatatttcacagaatttattgaagtacttgccccaactctttctcctctctatctatgcatgcatgcatggatttagcaaccttcaaaatgagttttctcctaaactacttataatctatgatccgataataccgttgtattcgttataactaaatctttacaagaagatctcgtatgattatgttctaataaaaaaacatatatttcaatttgttaatactcactgtttcatacgtgatagcaacatatttcatcatatgtcttcactgtgtttcaaaaaaaagtttaaatattcgttataactaaatcttcacaacaaaatctcgcctgattatgttctgataaaaaaaagcatatgtttcagtttgttaatactcattgtttcatatgtgatagcaacatgtttcaacatatgtcttcactgtgtttcaaaaaaaagtttaaatgttgctgtgactgattttttttactatatataacttaatgtttcactggtagttaactgtaacataacatttgactgatggagtttttttttcccctactctccctcctctctatccatgcatggatgcatgaattcaaaatgaattttctcctaaactacttatctaatatactatccgataacactcttatattcgttgtaattaaatcttcacgacaagatatggcgtgattatgttctgatgtaaaaaaacatatgttttagtccgttaatacttaatgtttcatagcaacatgttaatttcaatgtgtgttttagctgtgtttaaaaaaaataaatgttctagtgactgttttttcatttcaccgtatataacttaatgtttcactggtggtcaaccgccgtatttgacaatatttgactaatgtttcactggtggtcaaccgccgtatttgacaatatttgacttaccgatttttttgagagggtcggacgcccgatttggaagtacctccctcgttgggtagtgctagccggtttttgaaccggtgctaatagcacgattctgcatttgtgtgacacctcattttctctagtgccactttaggtgtttatcctatctggtaagctatatttattgtcacggaacattgggaataccctaaaatcacacacacacacacacagcatatcttttatttgtgccatggtcacttttgttgacggaatttcccacatatctgtggattgtttctctgcatgtcgatcgaaatatgagtctagatcaactctcaagtgatgggggtaattactatccgcagtagttagcttttaatgatggggtaattgctatcagcagtatgccatatgataggaacggggttgcgggtataataattaatttcgcatcatgaattatatatatggccttgtcaagttgtcatcttcaagacttcaattacatataataagagtcacttcaataagtacctgtccgtcaaagtatattaaggactagatgagcttgaagaaaaagtaaagaatttagattggtataagattaatttttacgagtaccattcggtttgtagaaagaaagtatacgaaggatcctataaattagtttgtatagagaaaatataggattttttccatctaatcaaaccttttgaaaaaaaat

SEQ ID NO: 9116 - DNA, 1574 bp, Oryza sativa
  unsure (1)..(1574): unsure at all n locations
nnnnnnnnnnnnnnnnnnnnnnnnnnnnnnnnnnnnnnnnnnnnnnnnnnnnnnnnnnnnaatggactaggcattgcaccgagcagtcgaagcccccacggaggagatctggacagcgcgcactgacagagcctgcaacgcgtctaggactggtgcagccgcgataatcacttcgcccaccggccgcacaacgtcatttgcggcgcgcttggagttctcggccactaataacacgactgaacacaaagctatcctacaggtgctccgcaaggcaagggctatggtgctccccggcttgtcgttaacaccgattctcaggtggcagctgggcatattgacacgacttacatggccttgaatccggagctggccaaatagttggcagcgttccagaaggctgaagcacacttccggggcatcgtggtcaccggagtgccacgagcaacaagagccgatgtagacaccctagccaagatggctgcggccaattcactcatgcccccgcatgttctctacgaggtactgcgctccccggcagtgcagggcggggagcccccgcaccccccccccccgcgcccgatggtgaaggtcgtgataatcaacgcggagcccaattgaagattgccgactgtggatatcttcgctgggcggacggagccatcctccgctgcggagcatcagcgcctccgccatcacgcaagaggctacgtgttcattgaggacgccttatacaagatggggtctgcgcgcctcttttccgatgcattagccggagtcaaggagctgagctccttaaggacatccgcgagaggcactgctgaacccacctcgccccgagcgccttggcagacaaaacgctttcggcagggcctatactggcccacaattgtggcagataggagcacttggttcgccattgccaaggctgccgacatagctcacgccaattccgccagtatagcctttcgtgcgttggggcatcgacatagtcagtcctctaccgcgcgcattaaagcgcaccaagcatccgccaaccacccctgacgccacggctcagccggcaaggcgaagacgggagcatgctattatccgggggatgccggagccaggaaccccggggcgcgccatactgtcaccttaatagtaagagagctagtaaatccagttgattttattccaacaatgccgatttcgaattttagcaagaggttcgtttaggtgacaaactgaacaactactgccacttgttgggtagttctagccggtttttgaaccggtgctaatagcacgatcattttgcatttgtgtgacaccttattttctctagtgccactttcggtgtttatcctacggaaaaagtacacattacccccccttccccccgaactatcacggttgaccaaattacccccctaaccacaaaaccagacattactcaccctgaactttcagtaccgacgaattaacccctcgaccctattcagactggttttttcctacgtggcgtacgcgtggcaatccaatcagtattttcttttttaaaaaatggtgggacccacgtgtcatacctaccc

SEQ ID NO: 9117 - DNA, 5888 bp, Oryza sativa
cgcctccttcgacggcgatgctgcagcaccagccaaagagacggtgccgcctgcctggcaactgtgcccgaggccagcgcccagtgaggtggccagcgtgaagagagctctgtcaagaaagcatggctcgttccggcgtcacccagccaccgctcgcgcccggcccctgtgtcgccccatgtctccgtgagagagagtgagtgaagagagagatagaggggaagggtaggtatgacatgtgggtcccaccatttttaaaaaagaaaatgttgactggattgccacgcgtacattacgtaggacaaaaccgctctaaattggctcgaggggggtaattcgtccggtattgaaagttcagagtgagtaatgtctggttttaaggttcaggggtaattccgtcgaccacgatagttggggggagggggttaatttgtactttttccttatcgggtaagctatctttattgtcatgaaacattaggaataccctaaaatctcagacacacatagcatatctttaatttgtgcgttggtcacttttgttgacggaatttcccatgtatctgtggattgttttctctgcatgtcgattgaaatatgagtctagctcaaatctcatgtgatgggggtaattactatccgcggtagttagtttttaatgataggggtgttagagcgaggctaataatatagccgatctgctggctataaggttttttttagcattctcttaatctacctatataatagttagctctttataattaatgcatgatccacttgtctctctcacagaatttcttggttctggtgttcaagctagctgtaagtttacagcccgcttctcctctctcttttctcttttctcttccagctcagcatttagccagcatttagcatttagtcagtatgccatatgataggaacagggttgtgggtataataattaatttcgtatcatgaattagctagttatatatatagtctttccaagttgtcatcttcaagacttcaattacatataataagagtattgaagtacctgtccgtcaaagtatattaaggattagatgggcttgaagaaaaaataaataatttcgattggtataagattaatttttacgagtatcattcggtttgtagaaacaaagtatatgaaaaggatcctataaattagtttgtactagaaaaatacctgtgcgttgtaatggatgaatgctattgtaatattattattattatctttatcgggtatgggtgaatgctactgtaatcttattatttttatacgttttagtttaggtaaaatttactgtggaaattcgcttggattttttttaagaaaatcatgagttgcaattaggagtccgactttcatctcaagttagcatgcagagttttttaaacaagattttttatatgactctttttgtatttttaaaagcaaattagcttaaaatccaacttaaacacttatctgtatttcgaaaagcgaatgaacttataaactgactcaaacacgaatgacgtaccaaaataccgacgaaaacatttaaaactggctcaaacacaaatgacgtaccaaaataccggtaaaattatttttaatttttataataatagagatagagaaaatatatgatttttccatctaatcaaaccttctgaaaaaaaccatatatatgtatatatatatatatatttatatatatttggcgaacgctttacatatatatatttattcgtcactttttctatttttatgcgcttaaattacttcaaaccgaatatacccaagaaggaagtcattaggtgatgcctagctagcttgcttcttgcccagcgaagattgcgcgcgagtgcatagtcacgtgttcgatcagcgtggctggcggatcggagtacagtacagataactaacctcgagaccttgaagacatgtacccaaaacatattttgctagtcattcaataaggaaatggactcactgcttttagtcaaattggtagctgtgccatctccctcaattcacaataaaaacaaaaaaacgcgacccgaggttatgatgcaattagtaaatctcggctcttcagcgtgtttaattaattgaagcccccataattaagcatccacgttgtccgctggttcagtcaaataaattttagaatgacctactgatataaggttggtcagtcaaaaataaaacgacaagcttagctgaaatttgtatgttttggcagttgacgaaagcgatgtgagaattaattactcacaaaaaatgtaaatttaacactacgcatcgatctgtctaccagctgttgtcagccctgttccgtggttcaatgatctggcagctgatcagcgcatgcgacaagactaatcgaaggcatgcatgccgtggagtgttcgaccctccttcttcctcctcttcttgttgttgttgaaacgggatcaattaatcatatataattaattaaccgttattcaattaaacgcattaaaattaaaaaatcgtaaaaataagtgcaatacattaaaagtggctaaaaatataatagaattttaaaaatcatatataattaaccgtggcctgattaagagcataaaaataaaaatcagaaaaatatgtaaaatacattctgtcgatgtttgagatcccgactacggtattttgtatagtaagaggatcgttggtaccagggtatatgcaagattgaagtaaaagatataaagataaggatttttatacaggttcgggccccttatctaacaggtaatagccctacaccagtataatatttaggattacctatctattcacttggcggcctgaaatatcatgacgtagtcgacaacggatagtcttcctcctcgaatccacactcggcgagatcagagatagcgctagatccctcttgttagcctccgtagacaccatattaggtttgtctaggcttatctctgatgttgatatccggcagcttgtcttgtcgtgcgttagcttgatctattgtatgtcgtgtcttgattttgttctttcctcccctcctcctaggggacctatttatacccataggtgtccccttgtccaagtataactaaagagaccaatatggatacaatccgagcagttgttatagtttccatatagaactctattcgtccttccctatctgcagctccttctatatatgaggtacgattccgtataagacttggtacatggtgggccctgccgagcttagtcaactactattaggtatgtggtatccataaccaaaagaggttaaaaattataataaattcttaaaaatcgtatataattaaccatgctcctattaagtccattaaagataaaagcaatcataaaaataaggagaatagattaaaaagaagttaaaaattataacaaaatttttaaatcatatataatcaaccgtaaggctagctaggataaataagaaaatcataaaaataaggagaatacattacgaataatttacatcgtccacacaccaacctaggataaataatttacataagacttgttgtattagtcacattatacaaccaatctcatagcgtgatggttgacacaaagtactttctccttatgaatgctccttcactgtgatcattgttgcgaataatttacataagtaagggatattctcatttgataagaggatgcttgggtcaaccgtcaccacgaacggaggttacccgtcaaacttatcgtaatcttcatctgtcttatcctcctttttccttgggagaaccatgtggcactttggcttgtcgagccctttccccttctttggtttgctacacatgtcctttacatagaaaacttgtgttacatcattggctaagatgaatggttcatctgagtacctaatgttgttaaggtcaattgttgtcatcccacactcatcaaccattacgcctccactagtcagcctaacccattggcaccgaaacggatgagaccttaaaatgtgttgcttttgccttccttgtccatggcatcgatacaaacaacgttgttttggttcatgctctttttgtcttgagctcttgtataaaatgtatacccattgatctcatatccttggaatgtcaagactaagcaaaatggtcccctcaccaaccaggctagttgttggtcaatcgtctcgtgtcagggttgtggatatataatgcatacctcttatccttggggtcgtgagatatatggatacagtataccctcaagtatatgggaaggtacctctgaattgaggaaatcggctgatcagtaaggaatcgtttctttgaatagaaggtgttagagtcctattcggaggagataaggatttttgtgatatcgtgtaaggacaggtatctccgagttctacttggacgacaagataatctgcggtacaaatagaggaccactagaggggggtaaggcatcgaatcttagcgtaagacacccaccatagcaaaaccaatccagaggacttgaagcaaactcaccgataggtcttgtcgagccattctcgacacgcatctcatcggtaatctcgggattctgttgttctctattgtactctgtggttttctttataagcccatataaactagattaaggctattacctcacgagagacctaaaccaatataatctttgttccatgtgtgcttgttgtcgtatcgtgtagattctcatatcaacgtaccccaataccctcagaatacggtccgcgggtatcatccgtcaatagtaagatcattttccatcaatcataaagaacgtactcggaatagtttcactgccaacagttaactccacatttaacacccatttagcatctaatgaattccctccaatagctgatgaagatacaactagctcggatataaccatgactaccttatgtattaatcaaccaaatgcgcatatgttctatattagatttacttgttatatatttgaacaaatgttgctacacaatgagttccatgtgttttcgcctgcagaggtacttgcttgggcgaaagaaaagtgaccgagcgtaaggaatgcatagatgattaaagaagttgattggggaccaaaccaagactttctccaagtccacttccatctcaccacttcactttttgtccatagaagacaagagataaagttctacacattttggatttggattcaggcctcctgatagcatcaacttcaaacggatcgagccgctgaaatagtaggaattttggaagcgatgagtacttgttgtaaagcttatggagtctactttcagatggttttgatcccacatcaaaattcctacctagctgctgggaatctacaaaacaagccatgtacctcatccagtccgaatctgatttgggtttttgtcttctaattatgtgtcacatcttgattttcgtttcaggatttataaattatttaataaattaataatagaatttatattaaatgatctttaatttacaagtgaagtaaaatgtgggaaataaaatttcctaaatataaagcatggatggatttaattttttattaaattctccatgattaagtaaactctctgaaattttctcggattttttggagctcaattcctaaatgatacaaagaacagttcagtaattatttgattattaatgatctaattatatttggtaagagcttttcttggttaagatccttaaattataaattgttgtttaaaaggaattattagaaatgattttaaaagcctaaaagagaagatctaattttaatttgttaaatttcaatataaaattgggctagataaaattttattaaatactttgcttaattctataattcctagatttttctgggatttatttgagctaaggaa

SEQ ID NO: 9118 - DNA, 9560 bp, Oryza sativa
  unsure (1)..(9560): unsure at all n locations
gtcaggttcgtcttcctcgcgccgccgccgccggccgaaaccctagcgcaagccgccgccgttcctttccaaattcggccgttgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaaagataaaagcgagctaagcctgaaggcttgactcctgcagcgggcgactccattccacaagcatccttgactgcagcgacgaaaccaacctcttcgagacatcttcaactgagaaggacttcaactctggtgtgggggaaaagagagcaagactgagtactacccactgtactcagcaagtcataccagaagagaaggtatgatgcaagatatatccaagggaggctaaaggtttttttgcataaagccggcatttcaagcagtagttgaaagccgtaaaacagttgtagtaattaatccatattaaccaatcactgtccaacgttacaccacgttgcaacaggcccaaaccaccacctgaactaaccagttccaaaagctaactagggtgaaactaatcacggtgaatctggtcgacctcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataaattcttccagggcatcccgcgaaccggtccttaaatgccatgggtgcgactagcaagaccatgcacccacagcccaccatgacgtgtattttaattaaccaacaccattacggtggcactaaatcaaagctataccaataatcaagtctatgctttaatgtgatccccctttgtgcactagttgaactaagcatggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgcaatgtatgacttgccttgctctcgcactgatggaaccacagcaacgtcttcgagaaaccacgaatcgacgaaacgggtgaaatctacgcgacaaacaaagaacacaagcaaaacatgctataagactactgaaacagataacaaagccatttttaatggattctacacatttttatgaatttactgagacttgaatggatttaatcggagctcggatgaattagttatgatttttagaagattctttgtgtttttactattaaagaaaagccttaatcaatttattgcgcaatattgccccagggctgacgtcagcaaggggtggggcggcgccgacatgcgggccccactagtcagcggcactaagagagggagagggggcggctggcaggtgggcccactgggcagcgtcacaagggggaggggaagcggcgaggcgcccggtcggtccggctcggcttcaagccggccggccggttatggcgagggcggcggtggcaagcggccaccgacggcggcggccggcgatgcaggcgacggcgattcacggcgaagcgcatgcggggagcggcggcgcgcgcgagaggaagagaaggggagggagttctcaccggggttcggccggcgcgggaggatacgacggcaaacggcgacggtgagcgaccggagggcgacggcgacgggcggacgggctccgggacaccctaagagaggaagtgagagaggttagatggagagaaggtgtccacggcgagggagagccatggccgacggcggcggctatggtggtactcaccggcgcgcggggagaagcgggccccgacggcgggattggatggggatgcggcggccggggtagctttggcggcggcgaagctagcaacggtggcggattggcttggcagcggctccagcggcggcgagcggcggccggaggagtggaaaaggcggcggcggcaggtatagcggcgcggaagcgatagagggcacgggagggagcggtggaaagaggaaaaggtggaggggagtggagggatggtttatatgggctcgggaggggcggacgaggcccggaaaggtggccgatttggccggcgacgtgtgggaagtggaggaggagagagagagtgggggaaatttcaaatcccccgccgtttgcgggcgcgcgagctggcgggaggtgcgggaaaggtgggcggcgacgtgggcgtgcggtacgggcggagtgggcgcgggaaacggggaaaccggcggcggcggtgccgtcggctagaggaggaagaaggggccgacaggtgggccccacctgtcgatgacccggagagaggagggagggagtgggccggcccaactgaaaggagggcgagcgcgcgggaggcgaacggactgggccgacggcccaagaagagagaaaaaaggaggaaaaagaaaaagaagaaaggattttccagggatttatatattgcacatgcttatttttaatgggttaaaattgtttccaatgctctgaaaattccactaaaaatcctgttagcatattttgacatgtagaatccaagaaaaattccacatgtcgattccaattattatttgcatttattaatttgagaaattagctctaggttaaaataaacaatttcttcggacgatttattttatgaatttagagcaagggaggggtacttcagggcgtgacagccgcgtctttccttctccggtgaaatctttagaggggaaatgatccttgagatctcctcttccttttctcttttggaagcatcgcctaattcggtttggaaactcgtggattcgagttcgattcggatcggtctctttcctccgaaccccgacctttccttctcatcgccggcagccgtgggccttcgccgccgccttccaacccctatataaggatccccgagctgtcctctttctgccgccaccctcgccttcgtctctcgccgtcggaagcgctctagcgccgtgtaacctcgagccaccgtcgtcgccgccgctccagccgtgcgccgccgttgctccagtcgtcgccgtcgctcgaggaggtcgccatcgtggtcgccaagtcgccgccgtcctcgtccgtcccttcgccgccgccgaagaccgccggagcaccgtcgccgtcgtcgacccgatctccgccgccgcttcttcctcgtcgccggcgctgtccgttgttcctccgccgcttctttggtcatcggtgagttcgccgcgtcgccctctacccgttggtgccctccgttcgcgtcgccgcgccgtcgttcgccggcgagcatgcgcgcccgagccacctgagccgccgccggtgctgacgtcatcgctaccgtcatcgctgacgtcatcgggatcgtccgccgtgagccggccgtggaccggatgttctcgcccgtccgttttggatagggttgatctcggccgtccgttcccgtgaaccgccgctgtgcacccggtccaccgcaaaccctagccactgacgcaataatcctccttttcctttttgaaaataattcattattgcgtcataattcaattaaaatccatataaaggttttaatccgatttaatctttaaaaattcataactaattcatcttagctcggtttaatgtggttcaagttgcaaaaattatataaaataaagatctacatattaaaattgtccataaattgaattaaatttatttaattctttttaaatgggctttaattagatttaatcttgtaaaattcataataaattcatttgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcaaaggttcgtgagtgcgccggaagtattcaagaagattaattgaagaccgattattgcaaggcaagtcacactgatcctaaacacaatcctttgaacatgttgatcctatatttaaattctctatttatttcaactgtgcatttattttcgaatgtcattgggtggaattaacctattctttgttatggcccttttgttcttgattactttattccttgataccttgggttattataattggactagttgagctttatatatattggttcaactagatattagatataattgcttagccatgcttagaaacattagcacactattgggataatttatgactcattatttaatgatgatttaatgatagttcacaatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatgattcattgcggagcaccagactgagaagtggcggagataagcccacgggggtcgctggggagtccatgccttgttttataagggggtgattatgatctaggaatggtgcactgtggtgagttgtgttgtgcaaagggtattatcacagcctctattcgggtactttctagtatcgcgacgcatggtagacatgatgttgaggctgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttaaatctgtacagccgggtatggttgttcaggatggttgggcctgtgcagcatgggtgtgctgttcagtgttgattanaatttctgattaattacttcactgttttacttctcttaaatgttttgctaaatgctgcttttgcaaatgagcctatattatgccctcctttggtatccttgtgcacttgcatatttgctgtgtggcttgttgagtatgtcatatgctcattcttgcaataatcaatcaacctcagttgaagacaagttgcgaaggagaagatgtttggcttataccccagttgagctgcctgtgggagtggagccggagcttcggtagattttattttccactgcagtttttttcatggtgaggactaagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacattatgtcgtgggcttagcctaaggggatgtgtgccctaggcaaccctaggatgtccctaatcatatttattcagtagctgtcatagtttagagtcgagttttgtttagattgatctgtcaagaacagttttgccgctaaatcagtttgtgaaaccccaaattcgagtgcttaatcattcatatgctattgtgttgcaatctatcttgtttttacttgtgttcttcaatttgtatacaggaattagccttctcggcgaggtcaaccgggttttggcacggctgataaccagaggagacgttgtgctgcgattgcggggctcaagagcgtgttcgttcagaagccggatcgagttgtgtcacaacaccactaaatcgactgtttatcaatacctatcagaagatcgggacctaacatcctcatcagttggtatcaaagcgccagattgatcattaggtaatttatctacccataaccagacaattgccacacaaaaatattgcatccattacctagccaatttgagttgttgcgttgttctattagtttttgtgttgttgaattttagattgcatcgtcgtgttgagtgctggtttagttttagatttaatttttcgttttgagtattgcatctgttcctcacttaggtttagggttcatcactcaaatctgtgtgagttttacgttttgggtccagcttttttatctcgtcggttgttgccgagaccttaaaaaatgggatctaatcatcatcgggtttccgttttttagtttggagaagtattcatcgagtggttttgaagtttctcgatttctagggttgcggtgtgcccgtgcttctgtgtgctgtgagaatgaaaagaagaaaagtatgagattggttgtttactgtggattggttttgttggagataatatagatcgattttagttggtttccaaatttttagggagatctgtttatcttcaacgcccacccatctctctctcccacttgaccaagcccgtccccaccgtccacctcatcgagaaccgggtaccgacctctccacctacgtgtaccaggtattgagtacgtagttttccttatatcatatatttatggtatcggatttgagaggtattccatttttgaggtgatccaattttagttttgcactttgcatttgagtccatgtaatatttatatttatatttgagtccttggttgaggttaatgatcggttcctgttgaaaaaaatgaaaaggcagaaatgtgcagagaaaaagaaataaaaagccgaacctacaataaaaagaaaaaacggcataaaggtagttaaaaaaagccgcacaaaaaaaggaacataaagaaatttgtttaaaaaataaatcatcctttcagtatgttttgagagtgtagagttgtgcattgattcatatctagtccttagtgttgttgggtgtttgcttgagctagaattgagtgtaagctaggccaacacattgactagtacattgaactattattcatatttgcattttctgattagcataattgcgttcctttgctactatatattgggcctcccaagctccacatatatacttttggtcagcaccgctttgatccttgcaatcgccacatcacgtcattagaggtgtcaagaaccagccaccggttgtctgtccttagcattgctggtaagacacttgtaagagcttggtaagacgctgccatttactagcctccactacaatccgtgttctgtagttaatagggataatactattctgttgttctctgttttctactaacgatggcaggttacatctcttgtggacatgagataaagttggatgggagacaaaccatagttgctacatcaccttccacagatgcacatgatgtaagtactttggtacaacaagtgctaagttctcagatggagaaagcggggcaaaggtagtgccacaatttatttgaaacaaggtttgtggttaagaaaaagaagatatcgtgttataatcgatagtgggagttacaataaccttgtgagttcagatttagttgagaatcttgagttgcatgcacaaccgcatccttatccatattacatcaaatgggtcaactcttgtgataagttcaagttaaatagaactgtgagaataaaattcttgattggaagttaccatgatactacaaattttgatcttgtgcctttgcaagcttgttctttgatgtttggtcaaccatggatatatgatagtattgttttgcataatgatattgctaatacatacacatttaggcataatggttaaaaaaataaaattgttaacaatgagtaattttgaaattttcatagataatcttgaaaggttgaagaatagaatcaataatattgcgatgccttcaactaactctgagttattaaaaaatgaatgtattgttgtgcctcttgctttggatactaatattttgcaggtgtctgagaaccacaaatgtaactaggaagagaagaaacacagagagaaaaagacctatccatagctccatgcatgcttgaggaatgtttaattgaccaatcgcctataatttctgaagataggaaaaaaggtaatgataatggtgctacaactactcaaggtatgcataattatgatgtgccaactgttgacggtcgttacagacaaatttcgaccgccaatagcactaaaataatggagaactaacaattcttagaatgaatgtttgttttcaaatgatatagttccacttgtactcggagaataacatgttgtagggatttatcaaataaaataaagagaaagtgaagaaaccttactcctaagcaagcaaatggataagatgggcccacaagtcaggtgtaacagtcggaaactaactttaactgccacaaccgcctaaaggacccacttgccagccactgtactgaaggagaggtcggtcggagccgaccctgaaccaggggcaagccggctcggtctccccttccacgtggacgtccagaattgcttctcaatgacggttatgagggtaaaatggacatttcgcatgggagaaaccgtcatactagccctattaaaggaggagctcacttcacttctcaacacagtcaagcaagctcaattcctctacattagtattagtagtatagtgctaagtggagtagtgtcgcgtcccaaaacgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaatacacaaagttgaaatggttttataaaaagaaaaatcccaaaaagtcttctttccccccccttcccttcttgggccggctcggcccagctccctccccctctctcctctccccagcggcccatcggctctctccccgcgcgcgcgccgctgacgggcgggcccgcccgccaccctcgctgacgggtgggtcccacctgtcatctcccacctcgcgccgagcccgccgcccgcccgtgccctagcgccgccgccgccgccgaatacgtcgcattccgtcgtccccgagcgcaataaagaaggggaaatcactccccgtgattacctcgctgtttcccccctcttttccatatctttcttcctaggatgcggacggattcaatcccgtaatcatcgccggcgcatcaatggcggccga

SEQ ID NO: 9119 - DNA, 6623 bp, Oryza sativa
ctggttaacaactaaaatgtggaatggttggcctgggttggcatagaccgagttggacccaagggtcgggttgcaagttcggtctgtatcatcatcggcccttgggttaagccaggttcgtgtgggtacacggccttgattaatacaatttgtatagttataggatcgcgtttacaaaagagctttgagcaactaaatttctttaaatgctgattactgcaaccctaaccctttatattataactctcttgtactcccttgcatttattatgcacttgtgggtgtgtcttgttgagtacggtggttatactcagtcttgctcaatttttcccaagcccagaagaggagctccttgaagatgaaggctttggtgtctagctcgtgcctgccgtcaagcgcctgtggtcgtcgccctagtcttccgctgtttctcgtttgtctttgtgtgctgggccttcgctgcccgtgtaataattctatttacgcttccgcttgttaaactctgaattgtatcaactttcggtgtaccttgcctcctaggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgtcttgctgcttcatttatcgccaaaatctaacctttaaaatgttgtttttctttttgtttttgtttgtagatggccggcagcgtcacccgtcgtggtttggacatgactggcttcgtcttggagctgcggggcatgtgcgtggtcttggggtatccacatggagtggattaccaggccaggccgctcccggagcaggagggtgaggacgcggagccccacgctggttgggaggtcactgcagtgatcctttctggctctcccgagcggacctcgctggcagtcaccgcgggtggagattccttccccgccgcttgccagaacgccgctctcctcgccatcggcactcttcaccagcgctacccggacgagttgcagcactcgccctaccgctaccaccctcatcgcggaggagcccgcgactacgccaccttccgggatgctagctcggaggatgacgctaccatcgtgcacctggcacgcatggtggaggcgtacgacgcggctcgtatcgacttccatcagatggtgcgccgcgggatggtcgagaacaacatgaagatcctggagctgcgtcaggagaatctgcagcttaagaaggacctagacgcggtggaggcgcagctgcatcagctcaagatcgcccagggagaggactgccgccccaagcgtcgccgcgtctgccgcagccagaagatcaccgcccgcaagagcacctccaggcccgagcttgttcgtcagtccctggcatggacctgcttcgtcgagacccctcatgccgagcctgcgcccgtggttccccaggagggggaagcctccggcgtaggtagcacggaggatgcgctgttgctcaccttccgtcctggcccgtcgcagcggtagacgagcagttagtaggcttgcgcgtgtgttctttctcgtttgtctttttgagtcgtgtggggcatggttatgccggtgtgtggtataactatgtcggagcctgtcttattttatttgcttaagcaacttgaactataatgaaccaatttaataggcagtaaataaattcaatgaattaatggtacgtcgaggtgtagccgtaaatttgttaagctctttctgatttgctggttctgtgtggggttttcagatggtgacgaccaagagaaatgttaacaccggtgatggcaatcaacctgaaggcagcaaccacaaccaccagtgcaacccaccttcaccttccccttctgctacaccaccaccaccacacaccaacgccattctcacccaaatcctcgcccagcaggccaacatgatgactgctttcctccccacatccaaaatccgccacaacataatgctccaccaccacccccacaacactctaaactcgccgagttcctccgcatccgcccacctaccttctctagctccaacaaccccatggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcaacctattacttgggcccgcttcaccgccgctttccggagaacccatgtgcccgccggagtcgtggcccttaagaaaagagaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgttcgtctagtctccggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatctctatccagggggatcctcctcacagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggccagcagcgtctgtgcttcaactgcttcgagcctgggcactttgtggataaatgcccaaagccgaggcgtcagcaaggccaagcgcctccccgctccaacaacggtgggaaggacgtcatacgaggtcgtgtgaaccacgtgacggccgaggacgtgctgacaactccagacgtcatcgttggtacgttcctcatccattccatccctgctaccattttgttcgactctggagcttcccactcgtttatatctgtgccattcgtggggagaaatcagttgggggtagaaaggcttagaaaccctctgctaatcaccacccctggaggggttatgacagcaaagtactatagtcctgccgtccctatagaaatccaggggattccttttccctcggacctgattctgctagacaccaagaacttggatgtgatccttggaatgaattggttggctcaattccaaggagtagtggattgcgcgggacgcacggtcactctgtaccgagggccggaacaaccggttgttttctttgcacccccaacctctgtcagaagttcagaagtgcatcagatagggctgtcagaaatccccatagtcagagagttcggagacgtgtttccggaagaactacctggtatgccgcccaagcgagagattgagttccggatagatcttgctccaggaaccactcctctgtacaagcgaccctaccgaatggcagcaaatgaactggccgaagtaaagaaacagttggaagagttgaaggaaaaggggtatatacgtctgagtactttcccatggggtgctcctgtgatttttgtggagaagaaagacaagacgaagaggatgtgcgttgactacagagctctcaatgaagtcaccatcaagaacaagtaccctcttccccggatcgatgatctgttcgatcagcttaaaggtgccactgtattctccaagatcgatcttcgttccggatatcaccaattacgtatttgtgaagaagatattccgaagaccgcattcaccacgcgatacgggctgtatgaattcacggtgatgtcgttcggtctaaccaatgcacctgccttcttcatgaacttaatgaacaaagtgttcatggaatacttggacaagtttgttgtggttttcatcgatgacattctgatatactcacaatcagaggaagaccatcagcaccatctccgtctggtgttgggaaagttgcgggaacatcaattgtatgccaagcttagcaagtgtgagttctggttgcccgaagtcaaattcttggggcatgtgatatctgctaagggagttgctgtggaccccgaaacagtgaccgccgtcaccgattggaagcaacccaagacagttactcaagtccgcagtttcttaggtttggcaggatactaccggagattcatcgagaacttctccaaaatcgctcgacccatgacacagttgttgaagaaagaagagaaatttgtgtggagcccgcaatgcgagaaggcgttccaaactctcaaagaaaagctggtttcctcgccggtgttaatcttgccggatactcgcaaggacttcatggtgtactgtgatgcttcgcgccaaggattggggtgcgtgctcatgcaggacggtcatgtggtggcctatgcctcacgccagctacggcctcatgaaggcaactaccctacccatgatctggagttagccgcggtggtgcatgctctaaaaatctggcggcactatctcattgggaatcgctgtgaaatatatactgatcataagagtttgaaatacatcttcactcagtcggatctgaatcttcggcaaaggagatggttagaactcatcaaggattatgatgtgggaattcactatcatcctggtaaggccaacgtggttgccgacgctctaagtcggaaaagccattgcaacactcttgacgtccgtggcattccacccgaacttaatcaacagatggaagccctgaacctaagcatagttggtcgtggattcttggctgcgctggaagccaagcccaccttgctcgatcaaatccgcgaggctcagaagaatgacccggacatgcatggactcctcaagaatatgaaacagggtaaagccgctggtttcacagaggatgaacacggaaccctatggaacggaaagcgggtatgcgttcccgataacagagaacttaaacagctgatacttcaggaagctcacgagagcccttattccattcacccgggcagtacaaagatgtacctagacttgaaggagaaatactggtgggttagcatgaagcgggaaattgcagagtttgtggccctatgtgatgtgtgccagcgtgtcaaggcagagcactagcgaccggccggacttctccaacctctccaagtaccagaatggaaatgggatgaaattgggatggatttcatcaccggacttccaaaaacccaaggtggatatgattctatatgggtattatggatcgattaaccaaggtagctcaatttattcctgtgaagaccacctatggagggaacaaactagccgagctctacttcgctaggatcgtgagtctacatggcgttcccaagaaaatcgtatctgataggggaagccaattcacctctcacttttggaagaagctccaagaagagctgggtacccgattaaatttcagcaccgcgtatcacccgcaaacagatggacagaccgagcgtctaaatcagatcctagaagatatgcttcgcgcatgtgtactagatttcgggaagacctgggataagagtctcccctatgccgagttctcctacaataacagctatcaagccagcatacaaatggcaccttatgaagcgttgtacgggcgcaaatgccggacaccgctcttgtgggaccaagttggagaaagccaagtgttcgggactgatatcctgagagaagctgaagctaaagtcagaatctttcgggataatctaaaggtggcacagtcccggcagaaaagttatgcagataaccgtcgccgtgacctggaattcgcagtgggtgattttgtataccttcgggtcacgccattgcggggtgtgcacaggtttcagacaaaggggaagctcgcacctcggtatgtgggtcctttccgtatcattgctcggcgcggagaagtcgcttaccagttggagctgcccgcctccttgggcaacgtgcacgatgtgttccatgtgtcgcaactcaagaaatgtcttcgagtgccatccgagcaggccgactcagagcaaattgaagttcgcgaagacttgacctacgtggagaggccagtgaaaatcctggacacaatggaacgcaggaccaggaaccgggtaatccatttttgcaaggtccagtggagcaaccacgccgaggaagaagctacttgggagcgtgaagacgagctgaaggcagcccatcccgatctcttcgctagttcttccgaatctcggggtcgagattccgtttaaggggggtaggtttgtcgcgtcccaaaacgactctaaaatacatcctcgaaattatgcctagaataattaaaatccgtgtgaaagcctccaacaattaaaatgtgcaaagttaaaagtcgaataaggcttggaggatttttgtatatttcctaaaagcctaaaatgcgtaaataaattttagtggaattttcagagcacaaataataattattaagaaataaacaaagttaaaaaggttttacaaaaagaaaaaccctaaaa

SEQ ID NO: 9120 - DNA, 1014 bp, Oryza sativa
gggtgtgtcttgttaagaacgggggttgtactcagtattgctcaatttttcccaaacccagaagagaagttcctgaagaatgaaggttttggtgtctagctcgtgcctgccgtcaagcgcctgtggtcgtcgccatagtcttccgctgtttctcgtttgtctctgtgtgtgctgggcattcgctgcccatgtaataaattaagtatgtacgcttccgcttgttaaactctgaaatgtatcaacttttggtgtaccttgcatcctgggacaaggattaatgcacgcacgtaaggaacgcccgttgggttatttctggtcgtaacacctgctcccggccacgcttacgtgaccgcctccgggcgcgcggtgtgaccgccgggtggggcccggccgtcagccgcccgtgccctcgggtgcagctgacgcgtggggcccacggcgccggtcggtgtgagcccgggtgtgtccggtccaccgtggaccgtgaggctgccgcgtgggccccactcccatggacccggtccgcgcgccatctcccctggttaacgcaataaatcctttttaaattaaaatttaaatgaagaaattcgcaaatattcacttaaagagcatataaacttcaaatggccataacttggccatttgaactcggaattggaccgttcaagtctctaattttttctttagaagtcaagaacccatttttgtgctttgttcctgcttgttatatggagtttattagagtaaaagcctttttcctttttgttggtcgtgtagacgctgcagcttcagaagatccgctcttcgtggaggttgaagccgacgtttgggaaagcgagcaaggtaagtcacatcatccttgaacatattgaatcccagtttataaaattattttgatttaaattaatgcattatcgctttatttaaattcctgcgttatcactgttttatttagccatgcctatttacctttgttatgaccttattattattgctattgttattattaccttg

SEQ ID NO: 9121 - DNA, 1534 bp, Oryza sativa
  unsure (1)..(1534): unsure at all n locations
nnnnnnnnnnnnnnnnnnnnnnnnnnnnnnnnnnnnnnnnaagttgctaaatttttctaaaatcaagatctacatgttaaaaatattcacatgtactgtttatgcttgttttttactgttttgttgatttttattctttcgctttagtttccgacgttccggaggagagcgttttcgttgagcaaggttcggaagtgtttgcggaagctcaaggcaagtcacacagatcccaaataaccctttgagcatgttgaacccgtttaaagctattattttatttcaactatgcattattttttaatgtcatcgggtggtgagcctttccccgttaattaatggccgaagatgatcttattttcctatgggttataatttgattagcatgaaccttatatattggtttggttcagctaaatgctatatgtatgtttgcttagccatgcttagaaacattagctaattaaaggggattaaatataaattatattatattattcttattaattatggttatatttaatggtagctcacgatgataattaaaacctggttaaggtgggttgtgagcatatggttttgatggttgtgctcatggtaattaaggaccggttcgcgagctactgttgtgaaacatttaccgtgccaaccacaagccagcatgggcaacggctttaccttttgtatagcatggttcattatagtgtgccagactgtgaagcggcgagaagtccgtgggggtcgctggggagtccatttgcctctggttttgagggggagattatgatccaggaacggtgcactgttttgagttgtgttgtgcaaagagtattgtcacgatttccccctttgcaatgccgtggtggtatttcggngcatggcaacatgtgtggaatcgtgtcttgtgggtacagtggtacacctctggccagagtaaaactattcgaatagccgtgcccgcggttatgggcgagttgagcaatgtttttcgtgattagtctcacatctctcacaataattatggatgttatacctggtaataatttgcttagctcctggtttggagttaaatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccctcctttggtatccttgtgcacttgcatatttgctgtgtggcttgttgagtatgtcatatgctcattcttgcaataatcaatcaacctcagttgaagacaagttgcgaaggagaagatgtttggcttataccccagttgagctgcctgtgggagtggagccggagcttcggtagattttattttccactgcagtttttttcatggtgaggactaagtgcctcttaagtaagtatttatcgttttagttaatnnnnnnnnnnnnnnnnnnnnnnnnnnnnnnnnnnnnnnnnnnnnnnnnnnnnnnnnn

SEQ ID NO: 9122 - DNA, 1230 bp, Oryza sativa
  unsure (1)..(1230): unsure at all n locations
gctctgacttcgtaggctgtgttggtggtctaggctttgagattcgatgagctatggctccgcggggggtcccttatataccgtaggttgggcgatatctgagtaggactcgnatgtaccaaccctgatacgatacgtaggtacccaattcttgttcgagaaggtttctccttgtttgttgtctttacgaagaatttccttaagtgctagaggatttatccatatacacgtggatataccttgtcgatacgtgacgtatatcgtagggtgaagggtatgcctaacccgtaaccctgacagtagccnccgacttctgctcaaaaatgaactcgtgagaccgtttgcgactccaggtgtcgagaacgttgccattccaggtgcgagaaccaaggagatgacgtgtaatcgagcgcaccgtttgaagtccaacggtcacgaatgaattttgaactgaagtccaaaaaccaccatgcacaacggacatagaaatctccggcggggatttctcctatttccttggaattcgcaccgtcgggagtgcgtctatttaaaggtatttagggcgtgagctttgaggtccgcctacttcattaagtatacactgctcctttgcattcctcgccttcctcgccgccgcaaaaagccctagcctcaccgattcatcgtccgtttccggcgatcttccggcgatctcccgacggccatggatcttgggaagtcgacctccaccgccgcgaccctgaagaaacttcaggaggagggtggcctccctggccacgacaaggcagagagggaagcagggggtactactccccagcccgtcctaggtcgcatggttgcgattgaggattacattgtctgcgggtttcttcctcccccctctgaattccttttgctggtcttaaacttctatgggctttcacttttgcacttgaatcccaactccatcgcatttctcagcattttcgtgcatctttgtgaggcctacattggagtagagccttttctagatttgtttcgcttttattacgagttgcgttggatggaactcaacaaggtgtctggctgcgttgggttctgacttcgtgatgggatgaagtcgcaatacgtccccttccagtgcccctcttctcgcagcacgtccccttccagtgcccctcttctcgcagcaaatggcagaacaggtggttttatctcgagattaaggactcgaatcctgccctcatgggg

SEQ ID NO: 9123 - DNA, 428 bp, Oryza sativa
cgccgcgtctgccgcagccagaagatcaccgcccgcaagagcacctctaggcccgagcttgttcgtcagtccctggcgtggacttgcttcgtggagacccctcgtgccgagcccgcgcccgtggttccccaggagggggaagcctccggcgttggtagcacggaggatgcgctgttgctcaccttccgccctggcccgtcgcagcggtagacgagcagttagtaggcttgcgcgtgtgttctttcttgtttgtcttcttgttggggtgtgtggcataactgtgtcggagcctgtctttattttatttgcctaagcaacttgaactttaatgaaccaatttaatagcagtaataaattcaagaattatggtagtcgtgggtggttagatttaaatgtcagctctctctgtttgctggttctgtgtgggg

SEQ ID NO: 9124 - DNA, 677 bp, Oryza sativa
  unsure (1)..(677): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtgtgtgagtgaagtgaagatgtgaaatgtccattctaccctccaaccgccattagggagtcatctggactgtccctgccaagccgcatatcagacagctgtgggagtggttcggccgaacccatgtatggcccaataggcccacttttcggcctgttgctcctcctcagcctcccatatctatttcttcgagtggaaggaccatttgttgatgttttgtgtagttattggcccactcgttgtatggataggatttcacctccacttaagtctgattttcatcccaacttcggcggtttattacctgcaggcacatatgcaccaacactcgtggaatatgttagaaataaacctaatcactatgttggatactttattctttctgtttatgcaggtattgacggcataaatttggcatttaatagccgccaacaannnnnnnnnnnnnnnnnnnnnnnnnnnnnnnnnnnnnnnnnnnnnnnnnnnnnnnnnnnnn

SEQ ID NO: 9125 - DNA, 710 bp, Oryza sativa
  unsure (1)..(710): unsure at all n locations
nnnnnnnnnnnnnnnnnnnnnnnnnnnnnnnnnnnnnnnnnnnnnnnnnnnnnnnnttctagaaattaaattaaagttaaagcaatttaattaagtgaaataatgggagaattaaaatttttccttaaaaatcattggctgaggatattttgtaatattctttgtgccctaaaataccctccggatttttccatgaatttttggagctcaaaaaataatttccatgaatttttggagctcaaaaaataattttaaagtcacaaagttcattaaactcatttatataaaaagaaaacgaattaaatcttctcccctccctcccttgggctcggcccaagtctccttccccctccactggccgctctcttcttctcctccttcctttgggtcgtcagcccagccggcctctctctcgtgcgaagttcgtttcgcctccctcctctacccgagccgccaataggtgggccccacctgtcggggttatccccttcctccaaccacccagccgccatggccggtcattgccacccacgtcccgccgaatccggcgcccttccgctcgcgttctaagcccaaaccgagtggaaacggtttcccttcatcttccccactcttccccacttncccccttaaaaatcgtcggccgttggtgcttcgattccgccatgttcggccatgttctccacctccgagcttataaaaatgcaccc

SEQ ID NO: 9126 - DNA, 538 bp, Oryza sativa
tacgcattttaggcttttaggaaatatacaaaaatcctccaagccttattcgacttttaactttgcacattttaattgttggaggctttcacacggattttaattattctaggcataatttcgaggatgtattttagagtcgttttgggacgcgacaggaggcggcgttcccgcgcccctatggtcgccggcgacggccataggcacggtggagcggcggccaagagaggggaatggaagggggaaaagaggcggcggtccacggctcaccccgggtcgacggcaacggcaaaggaggcggccggagtggagggagacggtggcgcggctcgggtggacgggaacggcggcgttccggcggtcggcgaggtcggcgagatggtggacggggtcggcggcggtgcggcaaagccggaggagacgacgccgaggcgggagatggtcctggcgagtggagagggccggctggaggtcgacggcgacggcggaaagagaagatgacggcgcgagctcgattccggcggggagaaagggcggc

SEQ ID NO: 9127 - DNA, 826 bp, Oryza sativa
  unsure (1)..(826): unsure at all n locations
tcggtacccttcaccagcgctacccggacgagttgcagcactcgccctaccgctaccaccctcatcgcggaggagcccgcgactacgccaccttccgggatgctagctcggaggatgacgctaccatcgtgcacctggcacgcatggtggaggcgtacgacgcggctcgtatcgacttccatcagatggtgcgccgcgggatggtcgagaacaacttgaagatcctggagctgcgtcaggagaacctgcagcttaagaaggacctagacgcggtggaggcgcagctgcatcagctcaagatcgcccagggagaggactgccgccccaagcgtcgccgcgtctgccgcagccagaagatcaccgcccgcaagagcacctccaggcccgagcttgttcgtcagtccctggcatggacctgcttcgtcgagacccctcatgccgagcctgcgcccgtggttccccaggagggggaagcctccggcgtaggtagcacggaggatgcgctgttgctcaccttccgtcctggcccgtcgcagcggtagacgagcagttagtaggcttgcgcgtgtgttctttctcgtttgtctttttgagtcgtgtggggcatggttatgccggtgtgtggtataactatgtcggagcctgtcttattttatttgcttaagcaacttgaactataatgaaccaatttaatagcagtaataaattcaagaattatggtagtcgtggtcagcgttaattgttagctctctctgtttgctggtnnnnnnnnnnnnnnnnnnnnnnnnnnnnnnnnnnnnnnnnnnnnnnnnnnnnnnnnnnnnnn

SEQ ID NO: 9128 - DNA, 2022 bp, Oryza sativa
  unsure (1)..(2022): unsure at all n locations
tacaattgatgttcccgcaactttcccaacaccagacgaatggtgctgatggctttcctctgatggtgagtatatcagaatgtcatcaatgaaaaccaccacaaacttatccaagtattccatgaacactttgttcattaagttcatgaagaaggcaggtgcattggttaaaccgaacgacatcactgtgaattcatacagtccgtatcgcgtggtgaatgcggtcttaggaatgtcttcttcacgaatacgtaattggtgatatccggaacgaagatcaatcttggagaatacagtggcacctttaagctgatcgaacatatcatcgatacggggaagagggtacttgtttttgatggtgacttcattgagagctctgtagtcaacgcacatcctcttcatcttgtctttcttctccacaaaaatcacaggagcaccccagggggaactactcgaacgtatataccccttttatttcaactcttccaactgtttcttgacttcggccagttcatttgctgccatacggtagggtcgcttgtacaaaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggttgttccggccctcggtacagagtgacagtgcgtctcgcgcaatccactactccttggaattgagccaaccaattcatcctaaggatcacatccaagttcttggtgtctagaagaatcagatccgagggaaaaggaatcccctgaatttctatagggacggcatggctatagtactttgctgtcataacccctccaggggtggtgattagcagagggtttctaagcctttctacccccaactgatttccccacaatggcacaaatataaacgagtgggaagctccagagtcgaacaaaatggtagcagggatggaatggatgaggaacgtaccaacgatgacgtctggagttgtcagcacgtcctcggccgtcacgtggttcacacgacctcgtatgacgtccttcccaccgttgttggagcgggaaggcgctgggccttgctgacgcctcggctttgggcattaatccacaaagtgcccagcctcgaagcagttgaagcacaaacgctgttggccttgagcgtccttgcggccttgaccaggctgcacagttggcgtaggaggacggggcgcacgagtccctggttgattctgctgctgctgcggctgtgggacgcgcaccacaaattgaggtcggggcgcggagcgaggttgctgctgctgttgttgctgctgcgaggaggatccccctggatagggattggtgtagcggaccctttggttagcaccctgttgattgcggaaattcgccaagcggcgcttgtgcgactccagttccttgtgcttggcttccaagcggatgctcttgtccatcagacgttggaaatccggatagtccccggagactaggcgcacggacagctcagggtccattcctgccaagaacttctcatgcttttcctcatcttcccgtacatcctccggggcgtaccgggccaggttgttcaactcatgcaaatactccatcacagagcggttgccttgcttcaactctcggaattcccttttcttaagggccacgactccggcgggacatgggtcctccgaaaagcggcggtgaagcgggctcaagtaataggctgccgctctggctgtgtagcctggaaatggtcccaccataaagatgcgggcccctgcagctggtgggcggcgaagatgactttctcctcatcgctgcactgcacagtgtctagctttttccccacggcatgcaaccaatccaannnnnnnnnnnnnnnnnnnnnnnnnnnnnnnnnnnnnnnnnnnnnnnnnnnnnnnnnnnnnnnnnnnnnnnnnnnn

SEQ ID NO: 9129 - DNA, 3601 bp, Oryza sativa
ctcctccgtttcgcccgccgaccgccggaacgccgccgtcctcgtcgacccgagccgcgccgccgtcttcctccgctccggtcgtcgtttccgccgccctcgtcgtcccggggtgagccgtggaccgctccgttcgcttcccccttccctcctctctctcgggtgcgccgccttccgtcggccgtgccggcgaggccgccttcgggcgcgccccgcggctgccaggtgggctcggccgtcagccgcccgcgcccgcgggagcggatgacgcgtgggacccacggcgccggccggcgcgagccgcgtgcgcccggtccaccgtggaccgtgaggctgccgcgtgggccccactcccgtggacccggtccgtgcgctccctccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatatggagttatttagagtaaaagccttttcttttccgttggtcgtgtagacgctgcagcttcggaggatacgctcttcgtggaagttgaagccgacgtttgggaaagtgagcaaggcaagtcacatcatctttgagcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagaacaaacaaaacctcaactagtggtttaattttaggtagatgcttcgcaatttaattaggtaacattaggtggtttttcaactatagtctgtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtactcaagttagtgttttaattcttaaaacctgcttaacaactaaaatgtggaatggttggcctgggttggcataggacgagccgggacccagggtcgggttgccagttcggtctgtatcatcatcggccttgggttaaggcaggttcgtgtgggtacacggccttgattaatacaatttgtatagttataggatcgcgtttacaaaagaggtttgagcaactaaatttctttaaatgctgattactgcaaccctaaccctttatattataagtcccttgtactcccttgcatttattatgcacttgtgggtgtgtcttgttgagtacggtggttgtactcagtcttgctcaatttttcccaagcccagaagaggagctccttgaagatgaaggctttggtgtctagctcgtgcctgccgtcaagcgcttgtggtcgtcgccctagtcttccgctgtttctcgtttgtctttgtgtgctgggccttcgctgcccgtgtaataattctatttacgcttccgcttgttaaactctgaattgtatcaactttcggtgtaccttgcctcctgggacaaggatggatgcacgcacgtcaggaacgcccgttgggttatttccggtcgtgacaagtagtatagaatagtgttcggaaatcctcggaatcttcggaagagtttcggatggctctacgctcttataatctcttctgtaatactttccaaattaatgaaatactcttctttatatatatttggtactttgcttagtctaagtaccggtcttactttatttatgcattatattcattgtgtgggtagcctaccagagaggtgtaatggtgcggatttaatgtttgatttatcaattgctctatgtcgggtgcatgggtatagaatagtatgtagtaatgtaagcatggtgcttagattattaaatatcattaattgggcatatatgccgcgggacagtagaggtgggccgctgatggtgacagctcagtacgagtattcctccacgatagtatatattcctaagacaatttctggggagggtactcctccgtatttagccccggttggacggccatgacaggttgtcgtaagaaactctagaagtaccaggaggacactgtttgggggtattaacctgtcacgcccggaatttctatccaaaattccaaacgcttacatgtgtgttaaaccctcgtccaggaatcaagcgaggcacacaatgacaatattgataatagagtacaaataactatcaaatattcgcaaataaaaattattacagaggtagatagttcctctcaaagaataaaacattctacgcagcggaaaataaaactataacaaactacggaacagctatggcgactccactccacaggctactcaaccgagaacaagcctagtcctccagatcatcaccttcactgagaaactcctcttctgatgaatgaatattgcaagaatgagcatatgacatactcaacaagccacacagcaaatatgcaagtgcacaggataacagaggatggcataatataactcatttgcagaaaacagcatttaataaatatttaagagaataataaaacagttgaataattaatcaatattaaataaacaccatacaacacacccgtgttgcataggccgaaccacatttgaacaaccaaccccggttgaacaaattaaccctccaaaacaggaatttgccattccaaaccaggaattaaattaattatcacattattaccatcaatgagtagtgtgagactaatcacgaaaaacattgctcaactcacccataaccgcgggtacggctattcgaatagattaaactctgatcagagatgtaccactgtacccacaagacacaaccccacatcatgttaccatgtgcctcatcgtgagctaccattaaatataaccattattaacaataataattatgtaatataatttatatttaaccccttttagttagctaatgtttctaagcatggctaagcaaacctatatatagcatttagctgaaccaatccaatatataaggttcatgctaatcaaattataacccataggaaaataaagtcatcttcggccattaataactgggaaaggttcaccacccgatgacattcgaaaacaatgcatagttgaaataaaataatagctttaaacgggatcaacatgctcaaaggggtgtttgggatctgtgtgacttgccttgggcttccacaaacgcttcggaaccttcctcaacggaaacgctctcctccggaacgtcggaaactaaagcaaataaacaaaatcaacaaaacagtacaaaaacaagcataaacagtacatgtggatatttttaacatgtagatcttgattttagaaaaatttataaacttgaaccacctaaaacggatctacggttatttagttatgattttccgaagg

SEQ ID NO: 9130 - DNA, 11518 bp, Oryza sativa
ctcgctcccaagtggcttcttcttctgaatgattactccactgaaccttgcaaaaccgtataacgcgattcctggttttcctctcgcttacttccaagattctgactggcttctcaacataagttaaatcttcttgaagctctatacgatcaggatctgcttcctccgtaggtacacgtaaacatttcttcaactgagacactgaaacacgtcatgtattcccgccattgacggaggcaactctaactgataagctacttcacctcttcgactcacaatcttaaaaggtcccacaaaacgcggtgccaatttccctttggtttggaaacgatgaactcctcgtaacggcgtaacccgaaggtatacataatctccttcttcgaaagccaaatctctgcgacgattgtcggcatagctcttctgacgtgactgggcaacacgcaacctctcttggataatctttactttttcttctgcctctcacaatatgtctgtcccaaaaacttgacgttcatcggtttgatcccaaaggagcggcgtacgacactttcgaccatataatgcttcattcggagacatttgcaaactagcttgataactattgttatatgagaattccgcgtacggcaaattcttatcccaacttccaccaaaatctagaacacaagctctcaacatatcttctaaaatttggtttactctttccgtctgaccatctgtttgagggtgataggcagtactgaaattcaaacgggtacccaattctgattgtaatttctgccaaaacttcgaagtaaactggctacctctatctgacactatcttcctaggaacaccatgcaaacatactactctggccatgtataactctgcaagcttattccccgtataggttgttatcgcgtcccaaaacgactctaaaatacatcctcaaaattgtgccgagaataattaaaacccatgtgaaagcctccaacaattaaaatgtgcaaatttaaaagtcaagtaaggcttggaggatttttgtatatttcctaaaagcctaaaatgtgtaaataaattttagtggaattttcagagcacaaataataattgagaagaaataaacaaagttaaaaaggttttataaaaagaaaaaccctaaaaagtcttcttttccccccttcccttcttgggccggctcggcccagttctctccctctctctcctctcccccgcgggccatcgggcttctcccccgcgcgcgcgccgcagacagcggccccgccgtgccctagcgccggcgccgccgcggattccgccgcatccggccgtccccgcgcgcaataaagagggggaaatcactccccgtgattcccttcctctttttcccctctttccctatctctctccctcggattcgctcggatttaatcccgcaaagttcgccggcgcatcaatggagcccgagatcgccgcgccggtttccttcctccccggccgccctctctcgctcccgtccctatataatcgatcaccgtgctccgctcctccgtttccgccgctcaccgctcactctcccagtcggaatcgtgcccgcgccgtcgtcctctctctccgccgtcgccgccgagctccggttcgccgccgtcgtcgccccggacctcctcccgcttcggcatcgcccccttcggcttcgccgcgtcctcgccgacctcgtccgctcctcggtttcgcccgccgaccatcggagcgccatcgtcctcgtcgtcccgagccgcgccggcgccttcctccgcttcggccgccgttcccgtcgtcgccgtcgacccgtggtgagccgaagaccgccgcttcgctccgtgttctctcctctctctcgggcgccgctccgttgcgccggtggtcgccggcggtgaccatcgaggcgcgggcgcgccgcctcccgtcggccgtgccggtgaggtcgccttcgggcgcgccccgcggctgccatgtggggcccggccgtcagccgcccacgccctcgggtgcggctgacgcgtgggacccacggcgccggccggcgtgagccgcgtgcacccggtccaccgtggaccgtggggctgccgcgtgggccccactcccgtggacccggtccgcgcgccctctcccctcggctgacgcaataaatccgattttaaattaaaatttaaatgaagaaattcgcaaatatccatttaaagagcatataaacttcaaatggccataacttggccatttgaactcggaattggaccgttcaagtctctaatttttccttaagaagtcaagaacctatttttgtgctttgtttctgctgttatatggagttatttagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattatcgctttatttaaattcccgcattatcactattttatttagccatgcctatttacctttgttacgaccttattattattgttattgttattattaccttgttcaccctagaataaacaaaacctcaactagtggacaccctactcatggcaccactagtttaattttaggtagatgcttcgcaatttaattaggtaacattaggtggtttttcaactttagactttgggaaatattcatatcacctggatacctcggaatggtctggatattgtggaattggattcacaccgctccttctattcaaaatccccaaaatggttttgggctgggctcggggtgcatggttttgatagtagcacctcggccatataaggaccggtcttcgggcctctgttgcaaagcactaccgtactttcacatgtctagtgggtaaggcttagtttgtggctcagtctagttataaacaaaagtacacggatggagatggatgaagtcgggggtcgatggacattctccagggcaaatgaaggctacacgagctgcggcccggtagtcgagatgtcatggcacagggccggtgtcctgctgctgggggctcagtcctgcctgcctgtcccgggggttccggccgtaggtgggattgggtcggtactcttgtctatggctaggatgggttggaaactatgtcacgtctttcgtctgtataccgtggtggtatgtggcacgtggttgcacgtgaggaagatgtgtcttgtgggtaaagatgtacacctctgatcagagtataatctatttgaatagccgcgccctcggttatgggcaagccgagcaatgtacccaagttagtgttttaattcttaaaacctgcttaacaactaaaaggtggaatggttggcctgggttggcttgggacgagctgggaccctgggtcgggttgccagttcggtctgaatcatcataggccttgggttaaggcaggttcgtgtgggttcacggccttgtttaataatatggtatagctctagaatcgtgtttaccaaatagctttgagcaactaaatgtctttaaatgctgtttactgcaacatgctcaaagggttgtttgggatctgtgtgacttgccttgggcttccgcaaacgcttcggaaccttcctcaacggaaacgctctcctctggaacgtcggaaactaaagcaaataaacaaaatcaataaaacagtacaaaacaagcataaacagtacatgtggatatttttaacatgtagatcttgattttaaaaaaatttataaacttgaaccacctaaaacggatctacggttatttagttatgattttctgaagttttaatctattagaaaattgggaaaaaggaaaaagagagagagatgacgtcagccctaaggatgatgacgtcagccctggcgatgacgtcagcatgacgtcagcacgacggccggctcgggtcgacgagctcgccggcgtttggttgatcggccgcgggattggagaccatctacgcgtagaggacaacgaggcgaacccgttggttctcaccacgacgtccaacggtgcacgacggcggccggcgacgagaagaggtggcgcgacggttcggcttgacggcgacgagggtgctccggtggtcggcggcgaaaaaggatgggcggccgagcttcctctcaccacggcgcacctaacggcggtgacggcaagcggcggcgacggcggagacggcgcggcgacgttgccgaagacggccggcggcggcggcggacttgaaacacgtcgcggcggcgctaggaggcacgggagagctcgggagagggggcaaacggaagaggacgacgaggagaagctatatatgagctcggattgaagagatcgaactccaaacgagaggaatcgattcgggaagatttaaaactcggttttagggttaaaaacaaaacgaattcgattcggttaaaatactcaacggatttctttgtttcttgaggggaaagaaagaggagaccgagaggaacaaaacccctcaatcaatcggaagaatccgggtcggatttgggcggaaacggcggcgcaaaacggcggctcggcggcttgcgcggcggcggccggaggtaggggatggacctgacaggtgggccccacctgtcggcctccacgagagggggagcgggcagcggcggcttgggccggcgtgggccgcgcgcggggagagagaggaaagagagagttgggccgaaaacggcccaaggaccaaagaaggggttttttgaactttttcaaataaaacaatttgtgaaatgttgtttcaattattaaaaaaatacctcccttgctcaaataattcccagaaaattctagaaaatagaggagcaagcatagtatttaataaaattttatctagctcatttttatgttgaaaattttcctagaaaattagggtttagcttgtaggcttttaaaaataatttctaaaaaattccaattaaacaacaatttatatatttaagatttttagggcgtgacataaccacatgattgtatattagtggatgtaaactaggatttgagtgtatattagaagcataggaattgagtgctttatatttcttcttccacttagttagacttacctattatgaggattgaatagctttgcttcgtgtcactctaccgctatattacatttaaccattgtttaggctttgacaattataagtagtatatgtataaagtgcattagcgaggttcactcttattatcttctcttggtattaaaaatgcgataccttggaatacttccgggtaaaatgctacaatggtatatccgtgcgcttgcggattagttttgtaaccatacatataccatgactatttctggcgccattgctgggaatgaagatttctagtaatgtcgttaagaaatatcaacaccaactatgtccactacttatgctacattagagcaacgcatagtggaaacaattgttgaaatacctttgtcataaaacaatttgcttgatgtttcttgtgataaagaatagttgtgtgatgtttcacttctatccatgccacaactagtgaatgaacatgttagttctatagtagagccaccatgtgttgagttcaaacatgttattcacattgctagcgagaataaagagcttaaattgctatcttctttaaatacttggggctatattcaatttgatgatgtttgtccactcaactgcttacagaagaaattatttgctagatttgaattgccatgcccttctgatgtgatttttcatgttattggcaattatgatagtaaaggagaatataatgtgcatgaagtatatgtttgttcgaatttgactatacctccttttcatgatgaaatgtattgtctagaggaccgcatgcgtataagtaattctctatctagttcctctagttgtttaaatgagctacaggttggtttgcaagaagaggagtgttgtggtttttcgactacaaagattttaggatccaaccaaatggccatcaagaaatgttcctcaccagatgttgtgatagataaagataagttcaatacgctccatgacaaggcgaaatcgaggacgatgaggatgatgaggacacaactagcttagatataaccatgaataccttatgtattaatcaaccaaaggtacatatgttctatgttggaggtatgtcataagggccttcggccgacctgccgaaaccatccaaaatagcaaacatcggctaaatcccagacgtgtgccattggcgaagccaaggggcaaagtccttgggcgaagcagaatgacgaagaccaagggggtttcaccatcatgactgggtgaagccatggaatgaagaccgaagggttcggctctaggctcattgatcaaccaaagatccaccacgggcgaaggctgtaagtcgaagcacaaagccatcgcccaaagtagcaaatgccttcggctaaaggcttaggaggcccagcagcccatagaggcccttcgctagctaatgggccggcctaagggggccgcctcaaggtccatgaatacaaaagacactgtatacctattataatgtccctatcataagggtaaccatgtaaattcccctatactaaccaaaccctagagagtatgagcctatacaaggattataaatagccccctagggccatgtaatggggaatcccaaaaatttttatcaattaatacattgctttactattccaaccacacatcaagtttaccgcgtccttcgacgtgaagcagttgtcattcgacaacacctggcgccgtccgtggggaacccagagcaaaaccacagatgccaccaaaaaagaccgtgaaagagagagttgtgcctaggcgaaaggggggcgaaggcgaagaggagatggcgggtgaagagggagtagagcttttgaccgcctaagacggtggcgtaccgccaccgagggcgatgcaggctgtccagccttcagccccgccgcggccccaaccgtaccagtaccgtccaaggcagtggcttcgacctcacatgccgcggtttgaacagccacaacggcgaaggcccctttgacaaccaccgtcatctagtctcaagcatggtcttcgccccttgtagtgcttcggacacaaaatacactagcttatggcccacttcggatgcttgtaccagagccacactgaccacatgtcacgcccagaaattcactagtaatttccgaacttatttgtgcataaaatcctcgtccaggaatcagccgaggtacacaaactgacaatttaatatacaaatccatcataataataacgttacatacttacaaaagaaaagaaaacagcagcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacagcaaatatgcaagtgcacatggataccaaaggatggcataatatagggctcatttgtaaaagcagcatttagcaaacatttgagaattataaaacaatagagtaattaatcatcaatattaatcaacactgaacaacacacccatgctgcacaggtccaaccatcctgaacagccatacccggctgtacagatctatctccaaaccaggagctaatcaaattattacgagttataacatcatttattatggtgagaagtgtgagactaatcacgaaagacattgttagacctgcccataaccgcgggcacaactattcgaatagttttactctggccagaggtgtaccactgtacccataagacacagccccacaacatgtcaccatgtgcctcaataccaccacggtacctcggaaaggagctgtgacagtacccctcgcacaacacaatcctccacagtgcaccgttcctggatcataatcacccccttataaaacaaggcatggactccccagcgacccccgtgggcttatctccgccacttctcagtctggtgctccgcaatgaaccatgctatacaaaaggtaaagccgttgcccacgctggcttgtagttggcacggttaatgtttcacaaccgaaaatcgtaaaccggtccttaattgtcatgagcacgagtctcaaaaccatgtgctcacaacccaccattatcaagttttagttggcaatttaattaattaaccaatcacgattgaccatcgtgaactatcattaagccatcattaaataatagtgaatcataagttatcccaatagtgtgctaatatttctaagcatggctaagcaatcatatctactatctagctgaaccaatatataaagctcaactagtcaagttataataacccaaggtatcaaggaataaagtaatcaagaacgaaagggctataacaaacaataggttaattccacccaatgacattcgaaaataaatgcaataattgaatagaaacaatagctttaaacgggatcaacatgctcaaagggttgtttgggatctgtgtgacttgccttgcaatattcggtcttcaattaatcttcttaatacttccggcgcactcacgaaccttcgcaacgacggaaacgacaagctatcacgcaaaacgaggaaaaagactaataaaaaccaaatagacaatacataaaaagtaaacaaacatgtagatcataattttagatgaattatgagacttgaacggccttattcggacttcatatgaatttattacgaattttacaagattaaatctaattaaagcctatttaaaaaggattaaataaatttaattcaatttatggataattttaatatgtagatctttattttatacaacttttgcaaattgaaccacattaaactgagttacaaagaattagttatgaatttttaaagattaaaccggattaaagcatttttatggattttaattgaattatgacgcaataatgaattatttttgaaaaggaaaagggaattattgcatcatcggctagggttcacggaggaccgggttaatggcgatagttcacgaaaacgaacggccgagattcatctatccaaaacggacggccaagatccatcggtccacgaccgggccacggggaacgacgacgatgacgtcagcggtgacgtcaccaccggcggccgctcgggcgtgcatgctcgccggcgaacgacggcacgacagcgcgaacggagggaaccaacacgtagagggcaacgcggcgaactcaccggtgaccaaaacaacggcggaagatcaacggacggcgacggcgacgaggaagagcggcggcgacgatcgggtcaacggcggcaacgatgctctggcagctgacagcgacggcgaaagggcggacgaggacggcgacgcgacagtgaccacggcagtgacctccccgagcgacgacgacgtctggagcgacggcggcgcacggctggagcggtggcgacgacggcggcgcgaggcggcacggcgctagagctctaccggctacgagagactaagacgagggtggaggcgggtagaggggagcttgggggtcaatttataggagctagggagcggcggcgaaggcccacggcgaccggcgacgggaatgaaggtttagggttcggaggagagaaatcgatccgaatcgaactcaaatccggcgatttccaaagcgatttagacgatgtttccaaaagggaaaaggtagagtggatcacagggatcctttcccctcaatcaatttcaccggaaacggaaagggacgaccggatttgaaaagcggcggtggctagggtttcggccggcagtggcgcgaggtagacgatgaccccggcatgagggccccacctatcagtggcagacgcgcgtgcgcgggcggcttggctgcaggccggcttgggccgagggagagagagagagggattgggccgactttcggcccaaagccaaaggaggatttttaaaaacctttttgaatttaaattattcattaaatgcaattccatttattaaaaatacttccttagctcaaataaatcccagaaaaatctaggaattatagaattaagcaaagtatttaatgaaattttatatggccccattttatattggaatttaacaaattaaaattagatcttcttttctaggcttttaaaatcatttctaataattccttttagacaacaatttataatttaaggatttttaaacaagaaaagaacttaacaattattattagatcattaatgattaattactgaactgttctttgtatcatttaggaattgagctccgaaaaatccgggaaaatttcagagagtataattaatcatggagaatttaataaaaattaaatccatccatgctttaaatttaggaaattttatttcccacatttaacttcacttgtaaatttatgaacatttaatataaattcttttaatattaaattgtttataaaccctaaaacgaaaatctagctgtgacaacaacccaaaagcttgataatgttattatgcatcatttgcgattggatgatcacttcatttgtgaaatcatcctttcgagcttcatttacttcgattgacgtcttcactgcaaccgtagtattgtcttcaagagtctctttgtacaccttaccaaagcttcattgaccaagaacttctgaattattctttgtgattttctttagctcatctttggtgaaaatcttgatattgtccactttctgtagcactgaaccaccattctttttgaaatattcattcatttttcgcttttggtgcatcactagcgtgaaaagaacaacaacaattaggaaggaaaatcccaaagtgatgcctacgaaagttaaaaaaacttattagcatccccgcaaaaaaaatacttattagcaaacataacaaatccatatatgagttccagtattattttttaatagaaatactccctctatcccaaaatataagactcaccactcgtaacacaaagaccaagaaataatttaatcaccttcttgattggatcacatacatacatgcaagcaatgtgattggaggatttaatggtagatgattcaaaataaaacaaatttgaagaaccaagaggtgatggttaatgtatgcatgccttatatcatgagacgtgggaaaaaagtggttgtgccttatatttttggtagagggagtatgaatgaagactcattttatttgataaattttattgtgaacaactaatgttatattaatattggcatgcacaatatatcgctgtaactaatctttagtgcagtttccttacacaacatataattttctgtttatgtttcaaaatttcctgcatgttttttttttttgaaaagtctttctatgtggcattagagagaaatctcctacaaaaaaaaagaacaaaaatattttgtgtagcacat

SEQ ID NO: 9131 - DNA, 7155 bp, Oryza sativa
  unsure (1)..(7155): unsure at all n locations
nnnnnnnnnnnnnnnnnnnnnnnnnnnnnnnnnnnnnccccattttatattggaatttaacaaattaaaattagatcttcttttctaggcttttaaaatcatttctaataattccttttagacaacaatttataatttaaggatttttaaacaagaaaagaacttaacaattattattagatcattaatgattaattactgaactgttctttgtatcatttaggaattgagctccgaaaaatccgggaaaatttcagagagtataattaatcatggagaatttaataaaaattaaatccatccatgctttaaatttaggaaattttatttcccacatttaacttcacttgtaaatttatgaacatttaatataaattcttttaatattaaattgtttataaaccctaaaacgaaaatctagctgtgacaacaacccaaaagcttgataatgttattatgcatcatttgcgattggatgatcacttcatttgtgaaatcatcctttcgagcttcatttacttcgattgacgtcttcactgcaaccgtagtattgtcttcaagagtctctttgtacaccttaccaaagcttccttgaccaagaacttctgaattattctttgtgattttctttagctcatctttggtgaaaatcttgatattgtccactttctgtagcactgaaccaccattctttttgaaatattcattcatttttcgcttttggtgcatcactagcgtgaaaagaacaacaacaattaggaaggaaaatcccaaagtgatgcctacgaaagttaaaaaaacttattagcatccccgcaaaaaaaatacttattagcaaacataacaaatccatatatgagttccagtattattttttaatagaaatactccctctatcccaaaatataagactcaccactcgtaacacaaagaccaagaaataatttaatcaccttcttgattggatcacatccatacatgcaagcaatttgattggaggatttaatggtagatgatttaaaataaacaaatttaaagaaccaagaggtgatggctaatgtatgcaagccttatattgtgagacatggaaaaaaagtggttgtgccttatattttgggtagagggagtatgaatgaaggctcattttatttgataaatattattgtgaacaactaatgttatattaatattggcgtgcacaatatattgctgtaactaatctttagtgcagtttccttacacaatatacaattttctgtttatgtttcaaaatttcttgcatgtattttttttgaaaagtcattctatgtggcattagagagaaatcacttacaaacaaaataacaaaaatattttgtgtagcacatgaaagatgatttgtataaaaatatacaaacgatgcagaaaagtagtctatgtaaataacagacatattatattttacaaaaaataataaaatgcaaaaagcatgaaacttatacacacttatattcttatatcatgtgctaggaggctaattttttaaaattgttgatttttttttttagttttttcaattaactgtcaacccttatatttttaggcattataagaaattctttgtttggttgaatggtatattgtagaaacaattaaaaacatagtcaatgggaaatcattgaattggtgtaaactcaatgtgacatatatatagtatattattttatatttttttaaaaaaatgctgaggtgcatatgtaccaagggcaagccttgctgcaagagggaattttgcgctgcactcttgtttcttggggccttcaccactccactggtatcctacacggcagtggcactcataatcccctgggatgttgttgcagacgccgtagcagggatatttcttcttgttggacacatcacactcgttgatgtctgtgcatataaaaaggatcatatatattagtcgttagatcaactgtcactagtaaaaaaaaatcgtaggcttaggcttctttttcttttctcttgacaggcaactcaaaatgaaaatcacctgtgtgaagatggcttaggctgtccaggattataaaccacgtatgaaatcctattttttaactggcaaattcttaggaaaccgcctataaaatttgtcgctcttcacgaaatctacattgaaagttttttttcatcattttagataatacgtttagatcgatgtctaaatatatatatgcgttacaaactctcagatctatttttgaaaatgaacttttgagtatttcaaacgatcttggataaagacattctatattaaaattgtagaacttaactagatctacaactttgtagtaaatatctttataagctctagtatctatttttctataagcagttctttaaaaaatcaaaatttaagaaatttatagataattcattttaagtcctattgaggtaaactaaagttctccgagatcgttctagtacttcttatagtaaaacttagttaatatttttcttagaacatttattttagaatggttattcactaatgtcacgttagataacataccaactcatttagaggtaaatgataagtaaacaattatactaactgaaatataaatacaaaaatattgtaagggtcatatataactttggttcacctcatttgaacttaaaatgaactttctataaatctttaaagtttagacattttcaaagaataacaagttttttcagatgggcttcctacagaaatgtcatttttggcgattctcatatggaaaggcacgcaaaaattaatttttgaggcggttctcttgaaaataccacccttaaaaataatagcactactacaataggaaaggagtagtatcttgatatatatgaagtcgtatgatgaaaatctttttataaaattggaagagctctacaactatatagtgaaatgttttttcattcgaaacttttacgggtcatgatattcgttacaaaatctcaaatctattgttgaataaacaaacttttatgtttttaaatgaactcagatggagctgtgctctatatcgaaattgtagagctcgatgtgatctacaagtttgtggttgataaattttccttttgatatcatttatagtgcaatttatatattacaagttttagaggggcgaagtcaaaagaataagcttctctcccacatgcacaaagttctttataggcgagatggtaaggacgctacttgaagaacatgttcccgttcaaatcctatatatcacacacacacacaaaattatgcaacttgtgaaacttgcaacacacggccgtgtatatatagacgcttactaaaatacacaatacgtttttccctttttttgcgcctaaatcaaatagcgaaaagatcaaatcaaacctggtaaaaaaaatttagttaatgaatttaaacaccaacagggttggtgcacacacagcgaaaggtcagagtaaattgcacccatggtataaaaacttggtaggtgagtgcgatttagtgtaaggacttgaataatgagtagactggtacataaacttgacaatcatgtgcattttaggccaaaacactaatacgtacctttttttaagcagttttaatacatacctttgattaatcctggtattataagctttgctagaccgctggctcatggatttattttcgtgtttcaccatgttcataacccgcgataatgaatatgttgattagtcatgcatttacttttgataatcatatatctttcggttttaaattgacagattattttattattataacttaccaattgaaagcaacatataatacttgtagatccttttcgagatggtttgagtggcggctttttttatatggcgtaaaaagtatggtgtagaatatagaccttttaaccaaaagtccaaaatgcacgcactagccaagttattgcacttatatgctcatttctcaagtttttgcgctagatcgcacccacctacctttatgtaccgtagacgtaatttactcgaaaggaaaaaataaaatggtggcactatttagcagaactgttaactaggagtaataaaataaaacattaatcttacccttgcaaccttggtccttgtcgtaggggttaccctcgtaaccttgcttgcacttgcagtagtatccgggaccgttggtggagttgacgcactcgctgctgtcgctcacacatgcgtacccagccggtttcttctcctgcacatccagtggagggcaggtaatggagtcgcggatggccctctttcggagaccaaaaatcccagcaacttacccgcacgaacgccaaaaacacacttatctggattcgtcttcatgcctaccgagcacaggttgtcgaatgtatcttgaaggccagacgcatggtcgaatgccttgcggctttttacgatgatgtcgtcgacatatgcttcaacattccgccccaactgtgaacaaaggactttgcagatgagcctagagaaagtagccccagcatttctcagtccaaaaggcatcctaatgtggcagaaggtgctgaatagtgtgatgaaagttgtcttcagtatgtctctgggttcgtaaagatttgatgatacccggagtaggcatccaaaaaactcataagtacacagcccacggtcgaatcaaccaattgatcaatccttgggagtgggaagtcatctttcgaacaagccttgttcagatccgtgaaatcaacacacatccgccacttgccattggacttcttgactaacactgggttcgccaaccactccgggtggttgatctcccgaatcacaccagccttgagcagcttttagacttctgtcttcactgcctgttggcggtctatcgacattttgcgtagcttctacttctttggcttgcatatagctttactactagatggtgtatgatgaggtcgggccaaacgcccacaacctcgtttgatccccagacgaagatgttgatgtttttcttgagcacggccaagatgttattcgtttcttcttcacttatatcgccgcctagggaaaccacctttgttggttcagcctcgtcaacttggaccttgatcaccttgccatgtggggacggcttcggcacgattcttgctcgctcaccatcttcagcttgtacattgtctacttctctacttatcactgttgtttcgctccctagcacggccaaagactgcagccccttgactacgattaccccggccggaccaggcatcttcagcttgaggtagttgtggtgcgcgatagcttcaaacttgttcaacgtggcggtgccgaagatggcgttgtagttgtacgaaatatcaatgacaccgaagagaatcatctgctcgtgtctgttgggacccgcgccgaacgccggagctaagtgaacttggcctaggacttgcaccgcttcgcccccaaagccgtgaagcaaagtgagcgcctgagagagagccaaggtcaggaaccccatcctagtgtatgcttcggcgaagatgacatatgccgaactgccgccatccacaaggattcgacgtactttaaatctagctatctctgccgaaatgatcagcgggtcttggtgtaggaacaagaccccctcggcgtttctctgttgtgcaccgcccgaagctgcgtttttctttgcagcttcacagctgtgagggtggatctgctcttgttatcacttggataacactttgcgggatgtcttgctgttgttcggcctgagggattatgtcctgaacaggttcacagggcacctcttcggccttcacttgctgtggtcttggctcctgttggttgccttgctgccgaatgtttcggcattgctcggtggagtgcaaagagcgcccgtggaacatgcagtagagatccttcttggccttcttgcgaaagggttgctggtgattggtgtcctggtgtgtgtcaagcaccttgtggagggtctacacctcttcgactgccactcacaacctttccacgttcggctctggtctttttacacgtcatgggagcttggctgggtcttgggggcagcaccttcttcgtcggctgcacttggcgattcgccagcggcatggcttcagctgcttgcatcaccgcttgcgcagctgcagcggaagcggcggccttgtcatagtcggcttgtatctccagccttcgctttgtgtcctcttcgccacgtgcatggccgtcgatgatgcgaaacaagcgctcgatggtctggggctctttccttgctattcttcttgtgaggtcgcttgtaaggagccctgccgaagcagcattgatgacggacgcctctgtgatgtcttgcacttggcagcgtgcttgcgagaagtgtcgaatgtactccttgttgtttctccgtcttctagcaaatgccgaagaggtcttgctgcgttttcggctcctcataggtgcctcagaagttaagaacaaagacttcacagagttgctcccatgagtatataatattagatagcaaattgaaataccaagagcgggcgatcccgtcaagcgcaacatgtattaccttcgccttggtattgtcattgccgtgagccacttcgattgcggactcgtagattgacaagaactcacttgggtctgattcacgcgagtatattgcaacgggtgggtacttgaattggggtgggatgggatgattcttgagcacccaactaacggtggcctcttttcgcccccgcctctcatcgttgcaccttggaaagatgagttcaagctcggttatgggatggcgaatggcgaagtcatcgcctgcacccgtggttgggccatcgctttcggctagggtccggttctgaacagtgctccttgcatgttggctgaaactacctgtgtcaccatgcctaggtcgaactgtggtgcttggatccaggccacgccctgattcgactggttcgcttgctgtgtggagccgaaaccggtgattatcccataaacatcagttgttgatgcttgggtcatggtgttctgttcgaagctcagtgcttgctaccaggctattgtcccttgacttggttgattgattgccgcgccgaattgacttatcggttgccaggtcggagccccctggcttgactgattcgcttggtgcattgcaccgaattg

SEQ ID NO: 9132 - DNA, 1801 bp, Oryza sativa
ttataagaaattctttgtttggttgaatggtatattgtagaaacaattaaaaacatagtcaatgggaaatcattgaattggtgtaaactcaatgtgacatatatatagtatattattttatatttttttaaaaaaatgctgaggtgcatatgtaccaagggcaagccttgctgcaagagggaattttgcgctgcactcttgtttcttggggccttcaccactccactggtatcctacacggcagtggcactcataatcccctgggatgttgttgcagacgccgtagcagggatatttcttcttgttggacacatcacactcgttgatgtctgtgcatataaaaaggatcatatatattagtcgttagatcaactgtcactagtaaaaaaaaatcgtaggcttaggcttctttttattttctcttgacaggcaactcaaaatgaaaatcacctgtgtgaagatggcttcggctgtccaggattataaaccacgtataaaatattttttaactggcaaattcttaggaaaccgcctataaaaattgtcgctcttcacgaaatctacattgaaactttttttcaacattttggataatacgtttagatctatttcttttacaaactctcagatctatttttgaaaacgaacttttgagtatttcaaacgatcttggataaagacattctatattaaaattgtagagcttaactagatctacaactttgtagtaaatatctttataagctctagtatctatttttgtataagcagttctttaagaaatcaaaattttagaaatttatagataattcattttaagtcctattgaggtaaactaaagttctccgagatcgttctagtacttcttatagtaaaacttagttaatatttttcttagaacatttcttttagtatggtcattcactaatgtcacgttagataacataccaactcatttagaggtaaatgataagtaaacaattatactaactgaaatataaataaaaaaatattgtaagggtcatatataactttggttcacctcatttgaacttaaaatgaactttctataaatctttaaagtttagacattttcaaagaataacaagttttttcagatgggcttcctacagaaatgtcattttttggcgattctcatatggaaaggcacgcaaaaattaatttttgaggcggttctcttgaaaataccacccttaaaaataatagcactactacaataggaaaggagtagtatcttgatatatatgaagtcgtatgatgaaaatctttttatgaaaattggagagctctacaactatatagttgaatgttttttcattcgagactttttacgggtcctgatattcgttacaaaatctcaaatctattgttgaataaacaaacttttatgtttttaaatgaactcagatggagctgtgctctatatcgaaattgtagagctcgatgtgatctacaagtttgtggttgataaattttccttttgatatcatttatagtgcaatttatatattacaagttttagaggggcgaagtcaaaagaataagcatctctcccgcatgcacaaagttctttataggtgagatggtaaggacgctacttgaagaacaggttcccgttcaaatcctatatatcacacacacgcaaaattacgcaacttgtgaaacttgcaacacacgggcgtgtatatatagatgcttactaaaatacacaatacgtttttccctttttttgcgcctaattcaaatagtgaaaagatcaaatgaaacctggtaaaaaaaa

SEQ ID NO: 9133 - DNA, 786 bp, Oryza sativa
  unsure (1)..(786): unsure at all n locations
nnnnnnnnnnnnnnnnnnnnnnnnnnnnnnnnnnnnnnnnnnnnnnnnnnnnnnnnnnnnnnnaaaaagaaaaagaaaaaaggattttccaggggtttaataattgcttgtgctcaattttaattggttaaaattatttctagagctctgaaaatttcactaaaaatcctgttagcatattttgacatgtagaacccaagaaaaattccacatgctaattccgattattaattgaatttattaaattagggtttctctcttgccattactcaaacaatttattggggtcatttattaatacgatttaggcttgggagaagaactttatggtgtgacacggcgataccctgaaccctctgatggctgctgtggctgctgctgctgtaccatattatacactttgattttttttcctatgttaaacttctttaattttaatcaaatttataacgaaatatagcaacacctacaacaccaaattgcttttattaaatctagcattgaatataattggttttattaacttggtttattttgtgttgaaaatgctactatatttttctatagatttgatcaaatatatagaagtttaacttagaaaaaagtcaaaacgttagagggagtataatgctagtgccaccaataatgatcatcggactccaaccttcgaacaccactcatggttggggaagtcaacattaagtcatcccgtgctgcaaggtgagtaatggcgatctacctgccttcttagttcgatctctatgttaacgttcctttgttaacact

SEQ ID NO: 9134 - DNA, 359 bp, Oryza sativa
caatactctctatatccggtctacgggtatcccccgtcgacaccatccattgagcaagctttgcgtgaagaagagattgaagaagatgttgatcaagccgcagccgaagtaagtgacacagaaaaaactccatcggcttcatccaaacaaactcctccaactccttctgccccagctcatttctcaagggtaaacatctctctctgatttccttttaaaactatttcattcacagccgatcacttataaatctcatctttgtagaaaaagaaaactgctgtaagaaattggcagcaacaacacttaaaccagctccaccagaaagactattgtgtataattattttcattaatccaatc

SEQ ID NO: 9135 - DNA, 409 bp, Oryza sativa
gagtccctagtcgattatgacatttgcttaaaaatgctacactagaatattgcatagtcatatttgtcaaatattatatgcttgggcaatgtcgtaggctctccggaccttccattatatttgagagatgaagtgaataatccaagtcatcaaaaaagcataatgaaacatccgacgccttgagagaggaattttggagacattgctaggcccttagcctgccagtcaacttcagcctgagatgtgcccgtcaaaccactcgaaggcggcgaccagatgtgttacacattcaggagacttgacaaaaatggctaaagatctacaacctctcaaatattcctaactcatactcatgtgaatctagttcccaggatgtgcactagattcacactttcatcttaagcatgat

SEQ ID NO: 9136 - DNA, 38631 bp, Oryza sativa
  unsure (1)..(38631): unsure at all n locations
ctaacaaactctaagatactataagtctttgcggcagacttttgcccacatttatctataaggaatttacataacatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccaaccgatcctaaccgtagccgatctggattccagccgatccctgctctgcttccgaactcgatctccgcctccaactccgctttgatcaagtcctctttcctgacatagatgttaccaaatttggttgttaacaaggtgcccaatcgatgagagcatacagattaacagggcatgtcagttggttacatgatgatgtgccatttagtcaacacaaacacaccaatttatttaattattttttctttctaaaatgttcctaatgcttatgaaatgattggtaatttggtattttgtcagtttgatggtcttgacatgttcatagagatggaaaatttagtttgaatttgtaatttggttagggcagcacatatttgctttcattctatttatatattaatttaaattaggttgcctaaaaaaataaatttgtttagcaaatgaccggcatacacatattttcatgttgctaggccttttaaggcaatgttggatggtaccggttagtaactaatccttcacgcacgtaaaatatagcaacccattagcacatgattaattaggtattaggttaaaacccttaaaaaatgaattaatatgattttttaaagcaaattttctatagattttttttaaaaaaacgcatcatttacaatttggggaacatgcacggttgtgcgcggaacgagagagtaaaagttgggacaagatagtatttaacttagcttaaactggcttacatggagcaccctctcaacttttatcctagattcgccactgcttatgcattatactaggacgtttggcgtgccttgccgcgccgtaatggcagtgaagagtaatgttaagtttggaagagtgtaagcaaacattgaagatcagttgaaagcaaaatagagtgtcgcgagaacagacgtaaaatgatatgttacatagtgcatgcgatggaattgtatattcgaaccaggagaattacgtatgactctaatggagtagccaaaaaaagatcacataggagatctatagcataagtggtttggctatgtggttggtgagaacatatatagaaggaactattctgctatggagctggatgatatgggtggcgcctacgaaattcaagaggaagacgccgtggtggccttgccggcgacccgccttcaacaggtccgctatctgtgtctgtttgccgagatacccactggaatgtctttataactggcagtcgacggttgtctttctcatattgctttaaaacttctccatcgatctcattgtcgctgtcttcatcagtgtagtcaaaaagcttttcaatgtgaattaatatgacaaataaatctgcattgcgtttccagccttggtcagatgattgttcctctccttgaacctcctcaatattccaatccattagtttggggatgagattgcggtcagttgtccatgcagacaatctgaaaatcgacaggttttgtatatgatgctcttcataaagctcttcaaccatacaactaccgtctagtaattctttcatggcctgcttgttccataattctggtggtattccttcgagtgcaagtatgactctttggcgcagtgggtttgggacactatgaaggttcatcttgaaaggttcatcttgaaaggctcaaaatgcagctgagttgtttggaatgtgtaggatttctgggcaaacgccttttgagatctctcatattgcttgtctgagtccatgaatagcacaatgtacattttgtgcctgaacggcagtaaggcaaaatcatcaatctggcagtcacacacgaagcctatcatagctgatattttcgttgtgtttggattgccagctccaagaacggtgacaaccacagcgtcctggtaaatgacatcggcaaatagctgtgaaatttctccgcggcttgaaaattttgtcgctaacagtggacggctactgccataggacaatggtcgtggttgtctctggctagggtggttatcttgatgggcctccatagtgttctaggaaagaaatagaagacctgttggttaacgcgtgcccattgcagagatcaaaaaaatgtttagtttgtttgctctaatactttcctatattgttctattacagatgtttggatctgacccacttctgtatagggagaggagggataggaatgaacatatggagattactgaagataataagctgcagttgttacctggggagggaggctgaagagcttgtgaaagctgttcttgctgacgggaaggcgaagagcagcagatatgtggtggggaggtgcaagtagcggcgaagaggagaagataagtgtggtagagatagaaataataggatgtgctgtatggcatctcgctgcaaatatgtcatgtctcttcaaaggcagcatgtacgggcaagcgatggtgtggatggagtgtgtaaagaatgcgtaggctgttgtttcagtatggagttggttgatgggtgaatttccctagcattcaataccatatatatatatatatatatatatgtatgtctgtatgtgtgtgtgtgtgtgttttggttctttgtactatacagcggtgtggtatggtctatagatgttttgtatggaagaaacatatattcaggtttagtatctggatggtgattaacttttatttcctgaaagcaggccgatagtggtcagtaagcgcacaaatatcctgggtcgatgaatgtgaactaaactggatgcttgaataaacctggtaatgctcagtcagacgaagtagttttagatagctatcagcattcagtattttcacggtggaggcatgataatatagaatcctggttacatgcataaagagcaattcatacaaagttttttcgcaaaagaattgctgctacagacagtcgggcaatttaatagcagcacagtttgcagaagcacgacagaacgggatatattgttctccttcgatgaagctgattgaggctgcaattgtggaacccaaaagtaagaggtctcttgcataacatattaggcctagttgatggcactggaaggacagaaagaaagcgcaaatttaggacaaagatgtggactgtaaatctgaagcgtttgaccatagggcccaaaaaatattttggagcttgctatacctgccaccagcgccatcgtcaccatcgtctttgaacaacttcttagcagcgcctatgccaggagatggtctagtcctgttatttgtgatttgttattagcctgatgcagaattttctatctagcaatatttagaaggagcaaaatagagcttaccttttttttagcttttggaagcgctttgtttagtgccagatggaggagatttctgtggcaggctggcatgatcagcgccctagtccatagaaaaagaagttcagtactcagttttgaaagatgtttgattaaaagaaaactgagaagcaaaataacctcatcctctacgtcctcttcatcctgaacatctgcatgggtctttgaaacacattctatgtccaactccttctttttcgatacagcagttgatgggctggttggtccagtctgtgcatcactaaggccaactgatggagttggtgatagagccatggaagctgggagagaagatgcttgagatgcagatggcgactgaagcaagggaaggccgtgggaagaagcacctccaaggatcctgttcacctggaacgcaacattgccagtaaaggcagtgttctctatgatactaacattcgaagaaaattctttctcaagtagatcagtgatctcctttggtatgaaatcagtggtagctggattctgctgcaacagcgtctccactgaacgaccaatgagccgctgtgccaaacgaccaaagataatgaacgaagtatcagctgtgtcgtcgcctgctaacacactcagcttgaacctgcgaaaagcataatcagtatagatatagcacactaatatatattcaatatgttacatattgaagcccgtggtaactgacccaggcgaagctgaaataactggtgggcatgttggatctccacatctgtatccactaccaaatcgctttgctgtcttgttgcatatgtcacaagcagtgtaccaccaggaactatccatattgatttttctaatgacaacagtgaccaagaactgatgtttctgtttgccagaagtagggtggtgattagcacactattttgcaaaatggcaaacacaataatgagtactgatattagtaaagatttaccttgaacttaaaagggtgcaggtccttgatctcaataattttcttttgttctgcattgtttggagcatcagatgaggctgggaggtcgatatattttatcggttcataatttcctttgatgctgcacagaaccaataagtgtgagtttaaactggtggtaggaatagaaactaacaagatataaatggcaaagaaaggacaaataaggaacctgttttttaaggcagccacctctggtttgtcaaggtttatgtaccacttgcaagcagagttaccagataaagaaacattccctgtacacatattataagaatctcagagaatttgtggaaagctactaataacgatagcaaacgtttctaatgtacttactgccaaatcccctgacaagtgtcccaacaaagattactacttgtgactcttttggccagcctcaagaatgtcatttgcagggaagcttgtagctcggtctccccacagcgcaacatttattgtcacattactattaaaaggtatagtataatggcagaaaaagtatatggatggtaagtgtttgttatgttattagtaaaacagaacaatatacaaaaagcacatattgaaaggaaggagaatattaggcagcggttagctggcgttactggaacagtggcaacaaagttgttagggaagcagagtaaatatcttttggcagatatgaaaaactgagatggaggactaactcggcatcacggatgtagatgctcctcttgaggctttcaccgtctctgatgcatgtctggataggagctactgacgttatctcagtaatgattccaatagcatctgctatgatgacaataggaaggaatagtctcttaggaatgcaatgagaacagtagtaatttataagaacttaactgcaactataatacctgtgaaaaagtctttcctgttcacccggctccttagctaatcatatggcgttaaagagtaaacatacttagggaaatcttctagcacatcattgcattcttccagtgtggaccactttgtgaaagaaattgactgcatattgctcactggcctatactggctggtgcactgccttacacgatagaatgtcagatcatacaccttcccttcagtgatctgaggctggaaaagctcatctaatggtgggaaaatctgggctgcaatactggctccctgtttacacagtagtacaaagggaaaatatgtgtatgaactgtaagcaaagattccaaagaactaaccgtgcgatcaagcagaaccagcccaagatggtgcaaattactttcatcattttggtcacgaaaagcccagaaccttgacacacgaacacgaattgttgggttcccaagactaggttcaagcctattaattagcgtagcctccatttgtacagaaagtttgaaacggatagttcataacggaaattcctaggatatcataggtacggcaaatagtaaaggcatagataagagggatgtaagataggcaacattacatacacaatacaaacaaggcacacctaaaagtgaaaaaaaataggtatacaacagctgcaaaaaaggcgatatagctggtagctaggtgccaacatcctgcagtatagaaagcacaatatattaaagtgtatttggatatagcgtcaatttcatagggatgtcgatggagctaaactatctaaaatataccatcgatctcactacgtccaatacttcttggtaaaccacattcctggtttttgaaccacagacctcatcctcatcctctataaggattctaaggcctactcttgaggttgacctagaagcagcgacttatagttggccatgtgtaaagacaggtttttttagataaaccccaacccgtgaaagagtctgcccctggctcttgttaatcgtcattgcatagcatatgcgcacagggaactgtctcctttgaagtgtaaaaggccacttagaacttgtagttgtaagcgcgattcgagatatgaaagccttctcaccaatgttagaaccagtcaatattacacactctataagtcgatggcctagagaaacaaccaatagtcttgtgccattataaagacccatagattgatttaaatttcgcaacaacataactgtgacaccctttttaagagtaagacgatgtgatgggaaattgttaacattaatagaatctaagaactcagttgggtagagtatatcaaagtcaggcatatggtcacatgcttttgaaattgtatcacagctaagatattctttagcttcggtaggtatcatcttaacaacacaatcatttatttcatcgactgttgagttatttgggcaaacaatagcacgacatgctagataggaatgatctgtgtagctggaggggaaatctggaaagacctcatctataattgcctttactttgtcgccgggtgtctttattagtaaatcattaggaatatctatccatgttggttcagattcatcgttttttttggttgtaggtagcatgccatcaccgagatctaggatccaattaccaaattcttcaaggtctcgtcgggtgcgttcattaagcccattttgaagaagtctcatattaattttcagtcttaaaagagtaacatgccgccagaggggggagttagttatggatgcatcgactatggaagcacgcgagccctttcttatcacttctagtatgtgtcgaaaatcacctccaagcacaactaccttaccgccaaatggcagcctgccattagaaggtttttgctcggatagtaaatcacgcaaagttcgatctaataagtgatgtttcctatgagtcattggagcctcatcccatataataagtgatgttttttgaatcagctcagcaagcatagtacctcttttaatagcgcagatactggtttcatcaatctcaattggtattttaaatcttgaaggagcagtgcgtcctcgaggcagaagcagtgaagcaacacctgaggaagcaacagcaaggacaattttcttttcagatcgtatttttgtaatcaacgcgttccatagaaatgtcttgcttgtacaccgtggccatatacaaaaaagaatccaggtttggaatcgctaacatttcataatcgtcttaaaaatagttttctgatcgacgtttaattatggaattattgatctagcgatggtatctagtgtggcgctgtcaagagctaactcttcctcaatcattctattacctaccacatcatctgaataaatcgctgggcgcggtaaatcgtagtcgtctatggtaccaccactgttggaaaaagcagtctgcacttctttcattaacagtgacatcagcctttcatgggggaccaaataagaagggttcaacagagctattctaagacgtcgttgtatatcgtcggtaaagtacaaccaatatttttcaaacagggatctcacatttccaacagagcagaacatcacaatagtaacaaataactgtcttaattggctagatgatgcagatattatagccttgtcaaatagcaagtaccactcattatcactctcgagtaaccctcttgcttcgcacgcctctctgaacgttgtataaacaacaccgtcgtatgttctaacatcagcatatgacatcgcacctttcactatcatcaatagcattcataggtagtacaattctccgctcgctgggctcacatagtacatcctacctatcttttcgcatggtgttctaggatgccagctacatgagctgttatcccatgtccattcctttgggaaatcgcagtatgtcagtgttcttgcagcactatgttttttattggcctcaaaccattctgtcagcatcattttttgggctgcaggacttgtaagcagcgaattcaggtcagcaccttttttgtatcgaacaaagttctggtatggaagatgcacagttaggcgctcaaccgaaggcaccctatagtggatatcaaactcaaaagcatgccaaagggactcacaagtagaaaggaaccttgcatcaatgtactcttgtatctcattccgtggtgtgctgttactgtttggtgttttctttgatgtgtcattttgtggtgcactattattttcagataactgactcggtaacttactattaacctcatagtacgctttagatctgtcggttccttttgtgacatacttaaagaggtacttaatcatgttagatttattgcaccattcgacatttatatgtgcttggtattttttaagaagttccatgttgtaaggcacaacccattgattatcgatcttcactccatttttaagaacatatcggtcgttatctctacgtttgtaaatagtaaaaccaaactcgtccattattgtctcgtcctgaaaagacttagggaagtgcttagaacactccccttttttcatgcatgggcatgatttgttctggttgccacaagggccatgcatcatgaactcatcaaccaaagcataccccaatggatcagtgaaaatgtcagggatttcagcagaaatgaacccatcaacaataggagcactgaagtcaatagtggatgcagcaagccaaataaggcaatgtatatgagggggcccacgcttctgaaattctactgtgtagagcactatatgataagcacaaaatatcagaaccaaccaaggaagcacagaacaaactaaatagagcaaaaacaaaaagcctaccagcaaggactgggccaaatgtctttccttccttaatgtccgagataaactcgtctactttcatgttgaaaactctaacaatcatatcagaacggtcgcttggtacctggcctggttcaaacaacaatgcatcgtatatttcttgccacttagaattgcaagtaaaagtcacaaataggtcaggtgctccaaatacacggcatatggccattgcatcttggtaattctgtaccatataacgtctgccaccagtaaaactggtgggcagtacatacttctttcctacagaatccccagatgcaagaccatgatcaatggcatcacttatcccttgtacagattctgagcggagttcatgttggttgtcagcaatgtattttagtctagacccttctacagttgagtatgagtcaacacatattgcatcatttagatgaccacatcaagtatagggatttagtttattcaaccggtaatggagtcggtagcggtagtaatcaagcattgtaacatagcgtcgtgaattaccagaaatgctagggaagtcagtgtactttatacctaaatggaacgaaactcctaatgcgcgatcaatcgttgggcgacaggagcagcgatcgatttccctttccgccacttgccgccaccacttgccttttctggcttttctcagcctctttcctattgggcttggcccacgagagcccatccacagcacggaaccgtttttggcttttttttatcgcccttaccagaagcggaagcggatgccgttgcaattttgaacagtaccctcttcttcctctcctggcgatttcgatttctcctgtgattctccgacgatttttctccaacgcaacgtggttcgtctcctgatctcctcgagcatccttggaatcgattcctcctgctatttctcggttattgtagttagggtttaatttttggaagtgattttctgttcccccgagctagcttgatttgattggtgattttttttgttttagttccttgggtttttgggtttagatccatggcgttttgggtttgtccgtcacaaaatcatgccgtgaaaccacatgcaccacgctgtagacgccgccgtagacgtcgtcgccgccgtagacgtcgtcgctgccgcggttgacgtcgtcgccgccgcggttgacgctgccgccgccgccgccgccgtagacaccgtcaccgccgcccgtcgctgctagggttagggcctaaccctagcaaaatcatggatctaaacccaaaacgccattgcttgaatctctgtaagctggagtattgcaatgaactactgtaagcaggagtattgcaaatgggaatatttgtggctgcatatttgctggatattttccatgtgtatcctggagtgagtggacaatttgggtagattgctgcatattgctgaatcaatgcattgatatagctggaatatttgggcagattgctgtaaatgaatgctatttttgactgcatattgctgcacaactgatgactgcatttttttgcaatgtgattttcaatccagagcaatatccagctgcaatcttggagcatatttggctcctgaaatactacatatctcaagttattttgccagcatgattcaagttattcacagagaaatttttctatctccatgccctgcttgacctggtattatcatgaggctttcacatgatgcatggattgctgcaatctgattttgtaggtgtcatcatatagttgttgctttctaataacattcatacttgagtgagattttcagagaaaaaactacagaggatttaataggagcaaaaacatctttgtgcattaacttggtgtactgagttttttgtcagaaatgtactattttgcgttcctccatatgcagttagttttttcccctgaaacgattgtgcgcagatttgctttgttctagacaaatttttgggagaacccaataggggctggttttgaattttgttttctgactcgattttttcagttgattctaggtgtcctcatcaactgattttgtttttgtatttgtaggattagatattcagtaaagtttcagtgtttcgctctgttttttatagtgcaatgggtgcacttttttgtctaaactgtgtgctggtaaatataaacgattaaaccatccagaactgagaaaacctagcagccgcttgtgttgtgtttgattacatactgcagatttatacacctctgcatttctaagtttgtattcctgcagtcatcaactcattatcctcttatactgagttaagttcagtctggttgcaggtagtcacgaagttttgatgatttttgtaaaaattttcatgagcatatattgttgtgattgactggcccatctgcactttttggcatttttgaccactagcactgaatggtgatctttttgccttattgtcatatatgccctcactatttgccatttgtgggttcatgttagcttaactcttttttttgttactgtggatatgcatatgtttgccacctcatcagcactcataagcaatcaacttagacagattttgctttgttctagataatttttgggggaaccagtagtgactgctagtgaattttatttttctgattcgatttcagttgattctgggatcaactgatttttgattctcacatttcagttgattctcatattttatgactagtagtgactagtgtcctcgtcaactaattttgctctcatattcataggattagatgttcaattaagttcaggattttgctctgttttttattggacaatgggtgatttggctaaactatgtgcttgtaaatataaagtattaaagtatatgtgatgggtggtaagtacataacagggggtgcttgacatggtgactaacaggactagtccatacatataaacaattttttgatccagtgttttgctactatgtcctgataatgtacaacatataaaaaattctcactacaccaagtcaccaaaaatgctcatacatgtgtctgaaaaccaaggggtagagagagagagagagagagagagagagagagagagagtaccttcagcatatagagaacgaacagcttggacggaataaaatctcctggatgaatagtatctttttttggcgcttttctgaattccattgtttcatgttttttgcataacctttttgatttccttgccgctatctgcttgtatcaatgatttctaataaatcagttggtcaggagctcaaggtgtctatgtaactgttgcgcagataacaaattccattacgtgactcaggcagtatggatgattttgaggaacatggtattagttatcgtgaagactcggactgtagcgaggcaaattgtgcaatttcagattatgttccaagcaaggatgccactggtgagcactctgcaagcaaagataacagctcggcagaatctgaaagtaacagagttgaaataaagcagtcttcagattctgcaataaaaaaaatggagatatactatttttatgataatgattttactagtctatttccctgtttctctttaaccgctataatgtcccataccatggatcaattaaaccaagcaaagtgtataaacttactaatcgcccgataggtttttttttaattcacatgtttttgtttctatcccctgccaatttcttgtgtttataatgtttcgaagtataaagtgtttaaagtagaatgtttgtaagtataaagtttctgcaactataaatttttggatgttgaaacttttattagtgtaaattttacaagtataaagttcctatataaaaaaatattggaatccgaattgtaatttgaatcgggtatataaacttttgacttataaactttaggtctacaaactttaggtatataaacttcagatgtgtaaactcgaggtgtacaaactttaggtgtataaacttactatttgcccgatagggttttttttaatacacgtctttgtttccatcccctgctaattccttgtgtttataatattttcgaagtataaagtgtttaaagcaaaatatttgtaagtataaagtttctgcaactataaacttttggatgttgaaacttttattagtgtaaagtttacaagtataaagtttctatataaaaaatatttgaatccgaattgtaatttgaatcgggtatataaacttttgacttataaactttaggtctacaaacattaggtgtataaacttcagatgtgtaaactcgaggtgtataaactttaggtgtataaacttactattcgcccgagagggttttattttaatacacatgtctttgtttccatcccccgctaatttcttgtgtttataatattttcaaagtataaagtgtttaaagcagaatgctcgtaagtataaagtttctgccactataaacttttggatgtttaattttttattagtgtaaagtttacatgtataaagtttctatataaaaatttttttgaatccgaattgtaatttgaatcgggtatacaaacttttgacttataaactttaggtctacaaactttaggtgtataaacttcagatgtgtaaactcgaggtatacaaactttaggtgtataaacttactaatcgccggatagggtttttttagaatacacatgttttttttcatcccccgctaatttcttgtgtttataatgttttcgaagtataaagtgtttaaagcggaatgctcataagtatgaagtttctgcaactataaactttcggatgtttaattttttattagtgtaaagtttacaagtataaagtttctatataaaaaaatattttgaatccgaattgtaatttgaatcgggtatataaacttttgacttataaactttaggtctacaaactttaggtttataaacttcacatgtgtaaactcgaggtatacaaactttaggtgtttaaacttattatcgcccgatagagttttttttagaatacacatgttttgtttacatcccccgctaatttcttgtggttataatgtttttgaagtataaagtgtttaaagcagaatactcgtaagtataaagtttctgcgactataaactttcggatgtttaattttttattagtgtaaagtttacaagtataaagtttctatacaaaattttttttgaatccgaattgtaatttgagtcgggtatataaacttttgacttataaactttacgtctacaaactttatgtgtacataaactgttcttcccttgtttgaacttctctatgtagtgtagtttccaatcactgagtcgcacattgtcatttctttagttgcatattccttttttttatgggatttttttgttatgttttgttcatcatggatttcatgtgacccaattttagcaaatttatgtacatcacaactgtcatatatttatgtgcaggaacggctctagtttaatttaaagctttgtttccacaaaactgtcagtagtataaaattgaatattttttcatctctattttctccgcacaacttatcatgttgcttgcccaacttttttctcccatttaagttgtaacaattttaaaaatattttttctcgtcacaggtttcagttcaaggccattttcaatgatcctaatgttctgctagcgaaagtgcaagttggcaatccccttttataaaacaaatacaatgttctctttttttcccacatcatgtttttattgtgcaattcaactatttttatcaacattttttcaacctgtcaattcgccatctacaaaaatgacgagctgatgaactccatagcgcaaacctgaaatctagcaagtgtgtcacattttactttaactttatggtttttttatcttgcattttttttaattcagtacaaatgagtgagaaagctacagcttttgtcatttcaaagttacttcaatttatctctccaccctccgcttatccgcttatccctacgtaccacatcccagaaagtcagtataattgatgaaaaaagctacagtttttgtcatttgaaagttattgatctccccaccctatacttatccctacttaccacatcctagaaaggtaatgccgaaaagaagagcaaatttggtacgtaccatcgcaaagttcctggtgttggaaaataccatcgcaatgagctcgagtagaaaagtaccatccaaattgcccagtttgttagaaatgcccctaccgtcgctttgtccgtttgaagacgtcgttgatgatgcgaaatggcgatgatgcccctgctgtggccacataggagtggtttttgggccgactttcggcccaaagccaaaaggaggatttttaaaactttttcaatttaaattattcatgaaatgcaattccatttattaaaaaatacttccttggctcaaataaatcccagaaaaatctagaaactatagaatcaagtaaagtatttaacaaaattttatctagcccacttttatattggaatttattatttaaaattagatcttctcttctaggcttttaaaattcatttctaatgattccaattaaacaacaatttatatatttaagatttttagggtgtgacaaacctacccccttaaacagaatctcgtcctcgagatttggaagaactagcgaaaagatgcggatgagctgactttaattcatcttctcgttcccaagtagattcttcctctgagtgattactccattgaaccttatagaaacggataactcgattcttggttcttctctcatctgtctctaagatacggattggtttctcaatatatgtcagatcctcttggaccactatctgttccagattagcttcttcggtgggtacccttaaacactttttcaactgtgacacatggaaaacattatggacacctgccaaggattgaggtaactccaactgataagcgacctctcctcttctactgacaatcttataaggtcccacaaaacgcggtgccaattttcctttagtgtgaaaacgatgaaccccttgaagaggcgtgacacgaaggtacacatgatctccttcctcaaaacttaaatctctgcggcgattgttggcataactcttatgacgagaatgagccacacgcaatctttcttgaatgatctttaccttctcttctgcttcccttaggatatcagtcccaaaaacctgacgttctcccatttgatcccacaaaagcggagtgcggcacttccgaccatacagtgcttcataaggagccatttgaagactagcttgataactgttgttgtacgagaattccgcgtaaagcagattcttatcccaacatccaccgaagtctaaagcacaagctctcaacatgtcttccaaaatctgatttaccctttcagtttgtccgtctgtctgcggatggtaagcggtactgaagttcaacttggaacccatctcttcctaaagtttcttccaaaactttgaagtaaactggctacttcgatcggatactattttcttaggaacaccatgcaaacacacaatccttgccatatacaattccgccaaacggcttccagaatatgttgtcctcaccaggatgaaatgagccattttggtaagtttgtcgactatcacccaaatagagtgatggcccgatgatgttctgggtagaccagtgatgaaatccatgccgatttcctcccacttccattctggtatcttcaaaggctgcaacaaacctacgggtttctgatgttctgcctcgactcactaacagacatcacacacagctacatactctgctatctcacgcttcatacttgcccaccaaaatctttccttgaggtcttggtacatcttagtactaccagggtgaatggagtataaagtatcatgagcttccttcagtattgcatctttcaaatctttgttgtctgggacacagattctctcacccaaccatacagttccttgctcatcttccaagaaaccgatagcttttcctcttctcatattcttcttgatctcatgaatatcaggatcattaatttgggcttctctaacttgatcaatgagagtgggcttcgcttctaacgctgcaacgaaacctctactgacaatttccaaatttaatctttcaaattccttgcataacttcaatggcaactgtcgtccttccgtagcattgcaatagcctttcctgctgagagcatctgctacaacattggcctttcctgggtgataatgaattcccatatcatagtccttaatcagttccaaccatctctgttgtctcatgtttagatccgactagataaaaatatacttcaaacttttgtgatcagtgtacacctccgtacgagtaccaaaaagatagtgacgccaaatcttcaacgcatgaaccactgcagctaactcaagatcatgagtagggtagttcttctcatgcggacgtaactaacgagatgcataggcaaccaccttcccatcttgcatcagaacacaacctaacccaagcttagatgcatcacaatacacttggaaacccttcttaggatcatgcaaaatcaaaatgggagctgatattaagcgacttttcaactcttgaaaactctgctcgcactcttctgaccacttgtacttcacatctttctgaagcagtcgtgtcatgggcttggcaatcttggaaaaattctctatgaacctccggtaataacctgcgagacccagaaaactacgaatctctgaaactgtcttcggttgtttccagttggttacggattccacattactaggatcaacggcaactcctccggctgagatgatgtgaccaaggaacttcacttcagacaaccaaaattcacatttgctaaatttggcatacaactgatgttctcgcagcttctctagtgcaagacgaagatgttcttcatgctcttcattggttcgggaatagatgagaatatcatcaataaagacgaccacgaacttgtctaggtattctataaacaccttgttcatcaagttcatgaagaaagcgggggcattggtaagtccaaaagacataacagtacattcaaacaacccatacttagtggtaaaagccgtcttaggtatatcctcctctttaatcctcaactgatgataccctgatcgaagatcgatcttggagaaaacggtggcacctttaagctgatcaaataaatcatcaattctgggcagcgggtacttattcttgatagtgacatcatttagtgcacgatagtccacacacatcctctgggtatgatctttcttttccacaaagatgactggagctccccatggagacgaactcggtctgatgtatcctttctgaagcaaatcatctacttgcctcttgacttctgctaattcattggctgccattctataaggtctcttatggatcggagttgttcctggtaccagatctattctgaattctatatcccttttaggcggcataccaggtaaatcatcagggaacacatcggggtactcccgtactataggaatctcttccaaagttatttggttcagactcgaccttaaaagttcagagggcaatgcatgaacagttacaacttgaccatcattgctggtgagagttacttttctattggcacaatctatcacacctttatatctggctaaccagtccattcctaggatgacatcaagatctttggattctaacagaataaggttggccagaaatggtactccttgaatctctgttctgacagaggggctacgttgtgatgagagtgcttggttactcggagtactaaccatcaaaggacgtctaagatcttctacttccatcccatgatttcccgcaaaactcaaagataaaaaggaatgcgtagcaccagaatcgaaaagcactgttgtaggaactgagttaacagggaatgtacccaaaatcacatctggagcaccttgagcttctgcagcagcaacatgattgacacgagcctttgtcgctggtgcggaggagttgttctgagcagggacaaccttcgcgcggcggggcttcggacacttgtcagcgtaatgtcctaggtcaccacaattgaagcacactccgggcttgctgccttgctccctcttggctagctgattctatgtcagagctgcaacaggacgtggagcttggttgcggttgttgttgccagcattgttgttgaagaactgacgctgcggacgaacaacagactaagaacctccctctagcattgactgaggtcccatagcaagacgctgtctctgactattcccctgctgagccttgaagtgagcaattcggcgtttcttctgctccatgcagttgtacttgtcctcctggcgaatagccttatccactaacttctggaaatcatgataatccccagtcattaatgggtaagaaagctcatcattcagaccttcgaagaacttctcctgacgctcttcatcagtgcgcacatcttctggagcacaacgggccagacgattgaattcatgcaagtattcggtgacagagcgagatccctgaatgagcgccctgaactccttcttcttgagagacaccactcccgatggtatgtgcgtcttccggaaagcagcggtgaactcaagccaagagataggttcagcagtagtcctgttgagacggaagtgatcccaccactcagaggcagggccatgcagctggtgtgaagcaaaagaaaccttctcttgatctgtgcactgaagcaggtccaacttcttctctatggcgtgcaggcaatcaccagcttcaacaggattggtggtgctagagaaagtaggcggcctcacgcgaagaaattctgccagcttattcgggggaggtgcatggttgtttccctggttctgctggttctggagttgctgcatcatcagattcataagctgtgcctgttgagccaggacttgagcaagcgtgggattctctgcattgttgttgttgttgttggggttggggccattcccgttgctgcgagtaagcaccatctggcatagataggagcacaagaagagaaacaggggaaaatctacttacgacagggaattaattttactaacttaacttttattgatcttaactaagttttattattacaaaactgaagacttcctaatactcgaaagcaaacaaaggcacgcatttacatccccccaatgatgtaaatcacatgcatgacccacacacacaaccaaacttaaacaaactaactaacacaacgatctaagacaacgacttgacaaggcgttcaaggtcttccggacatctgagttgattgaaggctctttcggcgcgtccccatcatcttgagttgctccccactcgaccttggaatgggtgcgcttggattcttcttcatcatcatcacttacgttgacgaccggaggatccactggggctggggtagcttctttttccaccacacgaacctttggcgccaactggtagcgagggacaaatagagctctcttccttgcggtaagacgaaccctggccttctgcggtggcgcttctccttttaatgcggctagctccttctccaaacgatccaccttgtcctccagcttgcaaatctttccgcgattccggtcttcacgatcttgagctgctatcacaattttagcgcgggtctcatccatggcccacagcatctcaaccaaatgccttgtggtagcatcattctcaatccctgcaggttcaaggtaactgccacggtcacttccctggggttgacgaggatggtagcggtactcggtgtcggccaaccgatcattgtagctttcgcggagctctcctatggcgatccttgccacctcctaacaagcatgattgtagcttccctctccagcctcgaacatcaccgatgggatatcttcacgattactgttcaaggtgactttgacacgacacttctcttcatcacgatcatgaggaatctgggcatacaaaggggcagtctcaaatcctatgaggaaggacatcgtacgcaactcctgaacaaatcaacatgctaagtttattccattgcagcaagattaaataaaacaatgtggtaacaacttttgttggtaaatgggccattagcacagtaatagatgtacagtactaacaacaccggaataataaataaattttgaattagaacaattaaagagatcatgaactgcatgtgccattagtttggtttaatttaaagagaaagagaggagaacagttctacttttccaatatttttagagggcttctaggggtaaccatttggcataacctagggtcaaggaggctctgataccaacttgtcacgcccggaatttctgtccaaaattccaaacgcttacatgtgtgtaaaccctcatccaagaatcagccgaggcacacaataacaaattgataatagagtacaattattactctaattaataagcgaataaaatgtcattacagaggtagatagttcctttcaatcaataaagttctaagcagcggaaaataaaggaaacagcgcagacgactccactccataggcagcttgaccagggctacgcctaatcatccacaccatcagcatcactgtaaactcctcctctgatgaatgattgtaaggtgagtatatgacatactcagcaagccacgcagcaaatatgcaagtgcacaggataacaaaggatggcatagtatagtctcatttgcataaacagcatttaataaatatttcagaatttaataaaacagtagaatattaattaaacagtattaatccaacgctatacaacataccctgttgcataggcccaaccattctgaacaaccaatcccggctgcacagttctatctccaaaccaggaatatactattccaaaccaggagctatcaagttattaacagcatcatttaatatggtgagaagtgtgaaactaaacatgaaagacattgttagacccgcccataaccgcgggcacagctattcgaatagtttgaactctggccagaggtgtaccactgtacccacaagacacaacctcaacatcatgtcaaccatgcgttgcgatacttgacaagtacctgaatagagattgtaacaataccctctatataatacaattcacagcagtgcaccgttcccggatcataatcacccccttgtaaacaaggtatggactccccagtgactcccgtgggcttatctccaccacttcacagtctggtgctctactaagaaccatactatacagaaagtaaagccgttgcccacgctggcttgtggttggcacggtaaatgtttcacaaccgaaaatcgtgaaccggtccttaattttcatgagcacaaccatcaaaaccatatgtcacaacccaccattatcaggttttagttggcaaattaattaattaaccaatcatgattaaccatcatgaggtatcattaagccatcattaaataatagtgaagcacaagttatcccagtagtgtgctaatgttactaagcatggctaagaaattatatctaatatccagctgaacccatatataaagctcaactagtcaagttataataaccctaggtatcaaggaatagagtaatcaagaacaaaagggctataacaaggcaataggttaattccacccaatgacattcgaaaataaatgcagtagttgaatagaaacaatagctttaaacgggatcaacatgcttaaagggttgtttgggatctgtgtgacttgccttgctggccttgaaattcctcaaaatattctcctgcaaattcggactctccgggaacgttggaatctaaagagaaaagaacaaaatcaccaaaacagcacataaacaagcatgaacaatacatgtggatatttttaacatgtagatctcaattttagaaaaatttagagacttgaaccaactaaatccgagctaagatgaattagttatgaatttttaaagattaaatcgcattaaatcatttatatagattttaatggaattatgacgcaataatgaattattttttaaaaggaaaaggagattattgcgtcagcgggctcggctcacggtggaccgggtgcacagcggcggttcacggaaacgaatggccgagatcgatctatccaaaacggacggccaagatctaacggtctacgaccggtctacggcggacggcgtcgatgacgtcagcggtgatgtcatcaccgacggcggctcggcctcgcgtgctcgccggcgaacgacggcgcggcggcgtgaacgaaggacacctacgggttgcgggcgacgcggtgaactcaccggtgaccaaaacggctgcggatggtcaacggacggcgacggcgacgaggaagaaacggcggcgaccttcggcttgacgacgacggcggggctccggcgatctacagcgacgacggaggggcggacgaggacggcgacgagatgacgatcaggacgacggccttcccgagcgacgacgatgaccggagcgactgtggcacatggctggacgaacagcggtgacggcggcgctaggctacacggcgctagggctctaccgacaatgagagacgaaagcgagggtggcggcgggtagaggagacaccgggggtccttttaaagcggctaaggggcggcggcgaaggcccacggcggccggcggcgcaaaggaaaggttagggttcagagagagagacgaatccgattcgagatcgaatccacgggtttccaaacgattttagccaatgattccaaaagagaaaaggtagaggggatctcggagatcatttcccctctatcaatttcaccggagaaggaaagggatgaacgaatttggaaggagacggcggcgcggctcggttagggttcggtcgggcgacggcgcgaggaagacgacgagtctgataggtggggctaggtgggccccacctgtcagcgagcgagggcgcgcgcgcgcgggcggcgctcggctgcgggccgacctgggccgggagagagagaggtttgggccgactttcggcccaaagccaaaagaagactttttaaaacttttccaatttaaattattcatgaaatgcaattccatttattaaaaatacttccttggctcaaataaatcctagaaaaatctaggaactatagaatcaagcaaagtatttaataaaattttatctggcccaattttatattggaatttattatttaaaattagatcttctcttctaggcttttaaaatcaattctaataattctaattaaacaacaatttatatatatgggaattttagggtgtgacaattactaagagtggctgacatcaaaaccacctttttggagaagacctcaaaaaaaaaactgaacacgtacatagtacaacacagcaaaaattactaattacttgtgggatcaagcatgatcatacctggagcagtgaagcaactgtgccaaaagaattccacaacagcagagccaggttttgaaacatctctcttttcagaaaaatagtttcaagaagcttcattattcataggtttttccttccatgatgttgtaatgtcaattgtagaatatgcgatttacaattacttattcaattaagaacaattacaaaaataatcaaccaggcaattagaaattaactaatatcttagggtaaggagatctatcaaccctttgagacctcaaggtgtgctttctcacatagattaggattggaaaggttgaggacaagtttctctgctaatgtcatgttttgatccttcgctcactactcgatgacacccaatgtcggagcaagaaagatttttgagcccaggcaaacatcactataactatcatttgctacagaaatttcatcatcaatttattcaataatattaaaatttaatggacttttcaccggtgagcccgagcggctgcctgggctagttgggcgggggctccgcccctgatgacaccaactttagtgcctacctcctcacacggggatgaatgtgagaccatgagagaggagtgtgctatggaggaaaataaagtgttctttttgtttcatatagatgtatgcttgtataaatttctaggtcttagtttcattggtaacatgtatcattatttcctaatagtcttgctctttaagggaaggcatgaagcttagcacgcttggtgggagatgtgtgtgcacacaccctcaacattcaatctctatgttatgttggaatcaacctatttgcttatttcttctctactagtttgatattgagatcctccttagtttggttcattctcttttggctcttccacgggaaagttcccctttccttatgcttttttttgtttagtttgtaccttttagaagtatgtatgcaatgcacatgcctttttatcgtagatagctttgtcttcatgtaagaacaagggacgttgcaatgtgaataaagtctgttccaataagattttggatgtattttggtttactttacataattgtctatattgcagttaagcctattccacgtagatcttctgagttgtgcacactttttctcaacctagcatcttttaaacgtgcaaatgccaaaacccaagaaaaacaacttttggtcggttttccaaaagccattccacctctacctgtatgtagaagcaactagagtaattccctacacctacccctctccctatttaatttcaagcgaccagtggaaacatgaatcatgtgaactttaaacactcacccttcttctccctcccctctcccccctctcctacacacccctcctgttcccttagacaatttatcgcctcaaccacaattcttgtagttagaatgcctgatactgtgtagtagtctaataatctttatgaaaaatatccaaacctaccaaaggggccttactattgtattgggtaggttaataggcatttgcggtaatattgtcacatcaatgcatgccatgccacatattgtccaaatatttacttaaatattgcatattatcgacaaatttaatttaattttatacatatttatttaaaaattgaggggaaaactaatagtatatatgtttagaatatatctcatatagcatcattagataattcctttcgtgcacaaatctgcaataagaaataatgaaatgcaaaaaggtgcatcatctgttttcaactgtcatttattcatgtatgtgtgttacacatatcacttttatttggtggaaaacaacacattagtatattagtaaatcaagttaattttacgcaacttacagcccagtccacttcttcaaataaaaggaatgatgtaatagacaattcccacaaaagatataaattactttgcgcagctcggaaagagcatgtccagatgtcctggatctagcagatcaagaataagacgctcaacaagttcagggtccctagggctaggaacctcactagtcaacatagcaaatatgtgaagactagctatatccaatgaaagaagtgatataaaactctaagtcaaactatctccaatgcttctacatgaataaaatagaaatctgtgatacataggggcactacagcctttaagtagtgtagatacagatgatgtgcatttacttggttcataagaaattagtagaagttgttccagataaatgcacattatcttgttggtttctttgtaaccttgggtgcatgtttcttttgctctaaaaagaatccaaagttaaaaactgcagctccacatctgcgatgagtcatgtaaaagataagtttagcggttcatacctttttatgtcattcctatcgtgtgaagcacatgacaaagtgtaagtttggttcctttatttttgttaatatatgaccagatcactaatctttcttgagggtgagacaaaactcacaggaaaataatgattcacctcataaatttttcccatcagaatgaaatcctcgaggtggtggttttttgtgggggggaagaagaggctaaggcttgtttagattataggataggaaaagtatagaaatttaagaaaggaatctaagtataaaacagagaaattaaaaataaagaaataaaaaagttaataacaagtttcaatcaatccagtgcatcggcccatattcaaagatcatataattgtttaattaatatcttataattatcaatcttatacttataatatctgtttgatccgatctattaagattagttttaatagagttagaagattcaaaattatatcacatccaaatcttggctaatgtattctttgctttatttttcataacttatatcccatcggttatagccgatcgatccaaaattccatccgcatcggctagacacatgattatatatagaccttttggccaatctgccccacgatctaatctttatatattgtcgacgtttgatatcgcgattatgatatttgcatagtatgtggatcgttggtaccagtgtatgtgcgagattgaggtaaaagagatggagacaacgatttttatacaggttcgggccccttatctgacaggtaatagccctactcctgttggccgaagccgttgttgttcttattcatctgaatctcacaagtacaataattatgataatctatctagctgtcatcgacttggcggctagataaccaactcgtagtcgacgacaacatagtcttccttcttgaatatgaactcgtcgggatcagagatgacgctagatccctcttgccagcctccgtagacaccggatagggtatgtctaggcttatctctaacatcgatctctggcggcgtattggcttgtgtgtatgttgtgtcttgtggcttcgtagactgtggtggatgtctctcctctcctctagagggacttgtatttatacccatagatgcccccttgtccaagtaaactagggagaccagtatggatataatctgattagttcttatcgtttccatatagaactttactcgtccttcattatccggaactccttcaatatacgaggattgtttccgtataagacttggtatgtggtgggccccgccgagtttagtcgattactattaggtatgtggtatccataaccctgacatatatatcttgttagttgtaggatcaaactaactaacatgccctgaaccctgattgacagaacatgtactacagctaaccaaatctctcaggcctctatgtgtacgataaattttgtgtcaataaatttgtatatgaatacagactgtttgagaaactgaaaattctgttgaaaaatacaactgctagctagaaacttcccccagcataaacttttattctgttccagttaatgcgcaacgtaatgccgatgctgacagccggacaccgaagcgctcatgtcgatcaccaacgcatatcgcagcacaccgaagcccgccgcctcgccgccggtgcccagccgccgcccagtcatcggcatgcatgaacaagctagctttggtcgtaaaccagctgtgccaaattgatcaatcaagcacgaacgctcaatgatcgatcgattgctcgatcttggacggactgtccctaatttttttttcacgaacgtataaaagaattgcaagttaatatatcaggaactgcccctaatttaatcatgctaatgaaattatttgatcccggtcaattaatctgtagttaatttccagatcgatcatccgtcattttacttctccttccgtgcagtcaaatcctacgggggtatttggtacttgtaactgtcaagctaaccaagtagagatggaattgaatttggtgatcattaaagttgatggagcaactaattgcatgtatgcttgtcggttaaactttccattcctcttgcgacgggagctttcgacgcgtgcatatgactggaaggatggcggcgccggcgccgccgctccccggcggctctcctgctataggctaggttgtaacgagttaattattgaggaactgtactttttccggattatctttttgattatataagaataaattagatactataataaataaagttaataaataatctaacagaagtggctaagcaatacaataggacttaacaagaaagtttattgggaaaatatattttctgaagcatatgaagcaataatctacctatctatctatctatctatctatctatctatctatctatctatctatctattatatattaaaagtccatgaaacatcctaaaaaagcttctacgtcgacacatgacacttctagaaacgttcccaagctatcaagtgatactctaataaattggataagcatgtaactattgattttcacttaattcggtggacccatcaattttgaccattagattaaattctcatctctccaccctaatatatgatggttaaatgctttggtcccaccaaaataattaactacgagtaaacatatgtagagaatcagttgttttctctcccgaaaaaaataccgcagaattaattcttggaaagaaaaccgacgttgtggatttatcatttaatgcaggagcctgggtgtgtgcttccatcatccaaaaataaataaaacaacgaacactttttaagtgaatatcacctttgcgtcaaaaaagtgaatatcactaactgttctaaactatttacagatttaggttccgattcatgaatattgccctcggtagttagtttctgaatttttcctgtatctgtttgattacaaaagtgaatatcactgactgttctaaactatttatacagatttagggtcagattcatgaatattgccctcagggcctgatgaatttctcactagattaaattatcttctctcctccctaatatatgatggttgcatgctttggtcccaccaaaataattaattaggagtaaacaaacgcagagaatcaattatttctctcccgaaaaaatcaacaagtaaattttcagatgcaaagccatagggaaaaaaaagcaatgcgcctctagctcactttttcgaccaatatcgacgacatacatctacatttttttaggaacaagaagcaacaaccaagggagaaataatcctaatcgtatcaaacaggagaatgatgcaagcaacttccacttctcggtttatttaagcatataatttcgctttttatactactccttggtgaagttgttcatcaacaaagtgatatatcaaagctcttgcctcttggacaatatattcactattgtcaggtatttgggtgctgtcggttgatttttgagtacttagtcgaggcgtcctgatagtgcgtgctttgccaccagaaatttgttaattgatattttatataattattttggaagggtaatgcatgccaacttcttttaagaaacatagtataaacacaagcgctcatatacacacgcgtacaattatccatagaaaacatattcgagagactgagctaatgatatatcttcaaattaacgaaatcaccataaacgcctcgctatcgatgggaacgtcgcctacttcaaaaataattagccgtaaatatgagacccatgtgaagtctaggtcttgaacctaggcgtgggcaattaagttccaccatacgtaactaaccagccacactcactaattgcagataatgtggaccccctcttccctcttcttaactcattttttccatatattggttgagataacatgtagtatataaataataaataaactattgtaacttttcaattatatatacaatttttttattcgaccacaattaaatcaatccatatttactatatttttatttagaaaaaaataaatattatttttatccatgatcgatttgaccctttgcgttatgtctaacagaaaaaaaaaacgaaaacaaaggttatagtgtcatagatcacgttataatcataaatactaaaactaactctaagacgtttgaaaataaagtttattagtatattatattatttaccattaacttaatttatgatctatattaaccatactttaatctgtaaagtaaaattatattttaggtcatattttcattctttttctgtagtccaaacggacatgaaaattataaaaaagatgacaatatagactatatatcactatatattctttatcggttataaaaatatgtaccactaaattagatttacaatatcaacaagaaacatgtcatatctttgcgttttacatggcatttgagaaaacaattcaatgatatgggtaaaatcatcacataaatatgcgactatgtagggtgcactatattcggcccatatcagttcacaaatatgcacgactaaattagatttacaatgcaacaagtagcaggtcacatccggggccttgcatggcaattgagaattatgacaaatcatgataaaaattaacaatatagattatatgatcatataaatatgagataatccaagaaatgccattaacaagcgtccaaatcccaaaaatgccatcgacaagtgtgagttataagaaatgccatcatacaaacgactttgtcccaaaaataccatcgccgttagggttccatctattctttgccgttaagttctataggatgaacagtgtatttaatagcacaaaatggacgaaatcctaatggcaatggtatttttgggacaaaatcgtttatacgatggcatttcttggaactcacacttgtcgatggcatttctgggacttgaacgcttgtcaatggcatttcttagattatctctataaatattgttatcatgtggattccaatctatccagactatacggggataatctaaaatgccaattctatttaccaaatcatgtgtaaattctacattttgtagactacaccctaaataagaagtaaaataacagatggagtacacgtcatgttcttccccccttgatttctattaaatacgtatggtgtgtgggtattttgtacatactaagtttggttaattagggaacataaaccatactaaagttatatatgagaattcatgcattaaaaatacaatctcatacaaattattgataaaaacatgttcataataaagtaaaaaatattttaagaaatactcatccatacataaatattcataattaaaatacaagcaacattaaataaggtgctcgcgcatgtgtgcaggttaccttcctaattattatatactaaaagtccattaaattttctataaacgctctcaagccaccacatgtgactcctacaaacactcctaagtcaccacgtggcattctaataaattagaggaattcctaataattctcaaaaaatctaaccattgattttactttaaatacagtggacccactattttccaccattggatttaccttaataagaaaaagctaacaaaacgaaaaggcccacaagttacatgcaccagtgcacgtatgtatgccatacctcctcccctactactcttcatgaaaatatattttgtgataataaattccaaacaattatacgatctaaatcatatagccaatgttttaccacgttcatcattagattatttacaacaaaatttataattcaacacccaaacgctatatttaataagtaaaagaactaaaacacatttatatgaaaaatcatatagatactttaatgatctatttaacaacacatagcttttaatagaacaatatgcaacacataaagtcaatttataatgttataataataagcaatttaattagaaaatagatatttaacaagtatgttactttgggtcattattattttataaatatagaaaactcaaattggtaaaaccattggatctatctcaaaggaaacaaaacttctcccctcctcatgttgtatgtacatatgcatgtcttctggaaacaagatcagaatacatacatctattatatctttattgatccatatgtagatacatataacaaattgcgttaatgtgaaccaattaaaaggagtgctagcttgatggtacattattaagaataatagtttttcgagatttgtaaaaaagaagccccaaaacattcaatttaaaacaaaaaaaacaccttacttttaatttgaacttaatttgttagacattttttttgtaaacaaaataagtctaccttatttttaaattatgaagcagaaagtaataattaattaattatatggatgaattaaatattgcgtagtataaagataacaaataccaaagaaaacttatttaagaaatgccgacaaataaatttatgaaataaaacgtacttctgaagcttggcaagtgctacatgtttaatattcaatccttataagtttctcaaatgcagcttatgatatacatgcccgcgtgaatgcacgggttacattctagttcgttttaacaatcaagtaaataatttgaaaagaactaagcctcaacacgtggagagaaagagtgacatgatataaatgtttggatttggattaaattacttttagtggctttttggtggcacagtgggtaaattttgaagttgtactagattacttaaagaattagctatagaactcccggtaaaaaaattataacaatttgtttgaacaatcaagtactaatttgaaaagagcttagcctcaacatgcgacgagaaaaagcgacacgacagaaatgtttggatttggattaaattattcttagtggcttttggtggcacagtgggcagattttgaagttactatattaggaattagctatagatctttcgataaagaaattataactatatatatactataattctagtgtaactaaattgaaattgcatgtaattattagaaagatgtgcttagattagattgttgaatgtgctacacagctactggctcacaaggtctcgggttaattagatccttcctcctatcctcttgtcaaaatcagtatagttaagtggtggtatcaatctatctatttattatatatagggattattatattatttaaaatatcttaaaaagaagccaccatattttctacggagactagaaattcccacatctatgtctatacctaattaaaaaatacgtaaggctttgcttccgtaacctttttcgtctgtcattgtctctcagccggtccagttctgtttttctctccctccctggccacaatctctctccctcttgatctttttccctttttctctccctcttgaatcttcttccgtattttttacaaggattccgtatatttttatgagtccgatccactgactgcgtgcttcacgcgccttcagccgccactcaggccgaacctagtgccaccgccacgttgatctacctccccgtgcgtttcctcttcaaattaattgcaaataacgattccacactcatccctcatcattttcccatgattttccctttcaattcagcttttatgggccagatttaatcttcatttataatggtcgtcaatgatggttagccagtgagcttccgtgggcccttttttctcgagttctatggattcgcatcaatttttggggaaatagaaagaggagattgaatggatcaaaagccctcaaacaatttttggagatcaaaagagatttagccggatttgatgtgcaggatcggttcaagcatcataggggcatgggactcttattcagaggttaaagacgctactgaaacgcgagggtgtggcttggcagcgagaggaggccaatgtttcaatttattgctcaattcctaatagctattgtatcacttagaaaacgtctgtacccattgcaatgcatgggcattttttatagttaattaaagaagaagaaaatatttaatccattaaaccgtgatgatcaaaattataacagtgtagattgatcgatataattgtacatatagtaacatgagctaggagttgtatatgatattcaaatttattttaaaaatatatatagtagaaaatacaattgtatcttaaaacagaatttaagtatatcgaatctaattctattcttagcaatttgcgtaggacaatcccacctaggtgtttcaatatgaaaaccaagaacttaactcagcacttgaaaatagaaaaaacagttttgttatacatttgtcgacaaactatctcctaaaaagttgacagatgtaaacagtgtaatcgtagtgtaattatattgtaacttgcatgtaactttataaaaatcttgtgataacatgctattttcacgaagcggaggtcatgataccaaaccctcttacttgtgtgtgcgttttgatttttgcttcttcacttgcacagatcttaaagcaaatctaatggtttcaaaatcacatgaaagttacatatcaattacgttgtaattacatgtaataagttataatgtaattacattactattgtactatatttacatttgacaaatttccaagagaaatgtatagatagtccctagtaaaaaaaaattacagtgtactccctccggttccatagttcttgatgttttggacaatgacacagtcttcaactatatgtttgactttgtttttatactataatatatacaataaataaatgtgtatgtctacttttttatatagtactttgaaagataaatctatatatgttattccagatcgtttagttcactaaacatttttaaagttactgatacttaaagttacaaaagtttaatcttaaccttgtccaaaacatcatgaattacggagggagtactaaagtaccagggctctatctagttattgaggccttgtttagatcaaaaaattatggccaaaaacatcacatcaaatgtttggacatatatatgcgtggggcactaaatgtgggaaaaacaaaccaattgcacagtttgtatgtaaattgcgagacgaatcttttgagcctaattacaccatgatttgacaatgtgatgctacagtaaatatttgttaatgacggattaattaggcttaataaatttgtttagcagtttacaggcggaatctgtaatttgttttgttattagtctacgattaattaggcttcaaatatgtgctcatatactttaaaaactttacacgtacccaaagaactaaacacaccctgattgcctttttggatatgcgtaacaagtatgggtaaactacactaattgtcggactgccttacatcttccaattaatattggcattatatctcccttggtgttttagttcctgagaaatatttttcctcaaatgtggaccaacaaatttgaccgctagtaaagaaaccttcagtgttgctgcaaagtccttatgcgatatatgtcgatcgattatgatcactaattcacgaccaggtcagtgttcatgaaatacaaaattctcaaagtgtccagaactcactaataaattaggcttgaaattaaaaccttgcagttattctgccgggatgtgtactagtacgatatagacgggagattgagttgcccatggtttgcccctttatgaatgaagctgatcgacttcgaatcactgtcgctattgcatttcggcatatcatcctggggccaactataggaagaagtagaataaattaagacatgtcatttggagtcaagtagagcttagggtgtgtttagatctataggtgtaaagttttgacgtgtcacattagatattatatagggtatcgcatggggtgttggggcactaataaaaaaactaattatagaatccgatagtaaaccgtgagacgaatttattaagcctaattaaaccgtcattagcgtatgtttactgtacaattagttatttttttagcctatatttaatacttcatacaggtgctcaaacgttcgatgtgacagggtataaaattttagggtagaatctaaacacccccttactatttaatattattgccaatgtctatttcgagcaaagttggagatagggactcataaggaacacacgcgcctactgccttctctataattgacttgattttgctggacaatgacatgcatggctactcatttgaatagcaaattctaacggggccatctatatcattgtagggcttagttgcatcatattttggtatcatctttgctcggcaattagatctataactatatgggctctagagtctagactagtagggcatggctcgtcagtaccgtataattgtaacggtcaaacaaacactaaactagtaaattctcaacggggccatctatgtcactcatatttttaaatgtgtatataatatggaataaactgcactagtattatctggatgtcctactttcaactcaccttgctgntatatttccttgtatcatatccctggggcggaagaatggaacaaggcagcttcagtgggacttttttttccgcatgtatcagtgggttatgcccctctggcgacgtaatttggagtaaagctaaagaaaatgtccctcctacaatatatacaacttgaattctttaacttctgaggaagtggcacactaatacataattatctttgcagacctaccctgtttatttttacaaacagactataagaaaacctgcatgcaaaaacatttcagggttgtctagtaagacccgcatgtgaaaatcaatttttataaacaggtctctaaacatagccgctagtgtaaatacgtttatttttacaagcgactatattaagatgccgcatgcaggtatacgcctcgattttcacccgcgttagaaaatcacatctcaattttctctcaccctcagcttaaaagtcaatgtccatcatcctctcatctactcccatctcttctcctccacacatccactccctctctgtcccctatctcttttcctaccggtcggtgacgaccagcgttagcaagggagcagcgccagtgacaagagtgcatgcgcattcctcggctcctccttctcctctctctcctctctccctccctctcactcctatccgaccaactcgggcttaggctggacagagggttgaggcgtatgtaatactgttgtttgataacaataagtcaagttggagataccttggtctcagaatatggtttctttgtttgattcatgtgtaggtgacttgatgcctcgggagagtattgccggtgatggatcgggagtcgacttggggataaggcgacgtccgtgacggtcagatatcatgcgggatacttaagctagagttcaatgcacgtggttggtgaagattacatatggcatacgatggaggtattgtgtgcatatgggatgcggaatcgaatttggaaggagtccgaatttggaatgattggagtttgtaaagtttgtttcttgtacaggacggtttcctaggtggatnnnnnnnnnnnnnnnnnnnnnnnnnnnnnnnnnnnnnnnnnnnnnnnnnnnnnnnn

SEQ ID NO: 9137 - DNA, 4322 bp, Oryza sativa
tcggtcagaccaactgcttccaggcggtcagaccggtgcaactactttggtcagaccgcgatccgtcgaatttgagggtaacttctaattctgcaaaaagtttgggtttttgagtataccaaccattcaactctctctggttggcttagttcttgtgtttcgatcctacaatcacctcctcgattgaatcacatatatgcatgcaaacaatataattagaaaacttaatggtacaggaattaaaataaatatttaatatatgcatacatacaggccttatattataagacatgagaaaaaaaatggttgtgccttatattttggcatgtagggagtaatgatttttaaaagatgacacatgtatcagtgagagaggtttactgtagagatttatttatcttctcagaataggtgaggagtaggcaggcctgtactgatcttttcatgatctctaatgaaatgtaggcattaacggctatttttttattataacagcaaaggtgatatatttaaccatcacgatacctaatttcatactaattgatgataattattatatgttcatcaatattatcagaaatgtattaaaaaaactagtggcggagaatggattttaacatgatggggcccaacttattaaacaacagtgatcatcgaaaaatggcataaccatatatgattgtcttaagtttttcttggataataaaccaataaaaaagcaaagtgattacataatatgttaattgaggagtgtgcgtgaacaatttaagtccaaacaatttggcgagtagagaaataagttctcagtgggaatttttttccaacttgaaaacatttctagagcataatgttgcactagctaaacataataattcatcacacaccaatataaaatttggttggactaagaaacaaaggcacatgaatttgatgaaattagtgcaatgctaaaactgtgtttttagggatgtttagatcccctgacaagttttttcacccagtcacatcgaatgtttggacacatgcattaggtattaaatataaaaaaactaattacacagattgcgtgtaaattgcgagacgaatcttttaagcctaataacttcatgatttgacaatgtggtgctacagtaaacatttgttaataacggattaattaggcttaataaattcgtctcgcagtttacaggcggaatctacaatttgttttgttattagactacgtttaatacttcaaatgtgtgtccgtatatccgatatgacacggcaaaaatacggatatacggacacacatttaaagtattaaacgtaatctaacaaccaaacaaattatagattccactcgcactatgatatcggctggcaagctgggtttaactgcctttgagtgtttgttgggtataatgctggctgtataagttcagacttcagattggccccgagtcccccataactctctttgtaccaagctcgatgcaacaaagtataattatattcatttatcatgtctgcctcatgacgtaccaggagtatacttcggtgtttgatgtctgcctgatgacgtcccaagcatcaatctggcatttatcacatggctacttgcagattctctccaaaaacaacaattggccattgactcttattatttatgatagccaatactctccatttccaccatcattcttttgtgtttgataaggacatggattgttcagttttttttctcttttaaaaacattgtttagtttatatcccacttggaaggagaggaccgtccatcagagatgcaatcaatgatggtgagtcgaaggagatgaagaaatagaagattttaaatccagttgcaatcgttcgcttcgctcccgttacgactgagggggaatgttagaagtataatatgttagttagagataagagtcaaatacaaattatagagataagatatatcctagagatagaatcctagagataagatagagtcctagagatagaatcctagagataaatctactcttacttgtattgtactccaagtctctatcccctacgtactcctatatataccctacgagagggccgatgtaatagataagaaaacaccagaatacaataattagattttccacaggagagacatcgatttgttttaaatagtcatgagcctggtggtgatgaggatgaggagccccttgatttgtgaatgtcgtctaatgataatagtttatcagcctaaaataaaagtgatttgttgattgacataacaacttgaaaaatagaagtatccacttggaacactactagagaaaccatctttactcggtaggccaaaaaccacaatagtcccaattgctcaaaaaatcgtgactaaaaatcatttttcgtcccggttcaaaagcccaggcgtactttttgatctttagtcccggtaggtattattagtccgggtttaataaatggcaggaggtgtcagacccctctactatctttagtcccactaaaaatttatttttagtcctggttgttaaacaaccgggaaaaaaaggctctatccgcacgcgcatgcaagtcctctcccatcctccatccttatctccttctctcccatccagccatcctccatccttatcttcttctctcctcctcccatcctccccttccttcttctctcaccccatctcctcctccccttcctccggggggcggcgggatggaggccggccgacggcggccgggcgtggggtgacgggatggaggctggccagcggcaggatggaggccggccaccgacggccgggcgtgtggcggcggcctcgccctcccctccaccagattcggccggaggggaggcggcgggatgagaggatttgtttgagtttttcttgaatttttgatgatttgtggatgttgttgatttgtgaatatgtatgagaatgtttatgtgaataaatttgtgatgatgtgttgtgaatgaatttgtgatgatctgtatgaatgaatttgtgatgttgtggatgaatttgtgatatgtgttgtgaatcaatatgaatggagaaaaaaagggaaaaatcaaaggaggaaaaaaaagaaaaaaaaacatagatggttgtatctttagttccggttggtgactaaagatgcatctttactcccgggtatttcaaccgggactaaagatagcaatctttagtcccggattcatagtcccggtttgctacctaggattatagggggttataaaccgggactaaaaagggttagtgcaccagtgccattttatttctcccgctcaccacgaatctcaaaggacattggatggtcctaaataaacgggttattttaatgaaaccgatcatttaaaagataccaatcaacacgcatctcaaagccacatcagatatcttaaacatttttttagcaatatcgaatatttttaaaacacccaaatatattaactatcagattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagagcaatttagggatgggtgaccgatcaggaaattctttccaggtgcgcactttcctaggaaagctaccagatgtagagagggcccggcctcggaaagtgtggggcgtcacattcatgcagcatcgatgatggtggatacgtggatgcggtggagctcgtcacgacatcgacgcggaagtggttgctaaccactggagtggaggaagaggtagatctaggttttcatcttgaattttttgatgtttcagtgcatgtactatgatgtttgattagttatatttgaaatgttgcagtgggtattcgatggtttttcattctatttctcgatctagaaatgaaacagttgggggccgaaca

SEQ ID NO: 9138 - DNA, 7267 bp, Oryza sativa
tttcataataaatttgtcttgggttgaaaatgttactacttttctccacaaacttgagcaaagttaaagcagtttgactttgactaaagtcaaaacgtcttataacctaaaacgaggggagtatttgatcttgaatgctacaagtgctccaaaaccatcaaaaggtaaaatttcttcattccaggccatacagagcacggcacacaagtactgtacatttttcttctcctttcggtaaattgctacatggtagatggtaggtagatggaataacaaatcatccaaaaaaaatatagctccggcctagttgattgcatgaaaaaattggcgttgagatgccatggccttaattacttggatttaaacttgagtatttagaatcgtttgcatagaatgtggtaacctccagtactagaaaaacattttcgccggtcgccgtccgcctgtagcccaacgactgcaaagatcgccgatcttcgcaggcgggttggcggtccgcctgggaagataattttcccaaacggagtgtagctagacccgtctgcaaaaatagataacggccgcctgcaaaaaataacaaattaccgcctgcgaaggtaggttaaaaattttaaaatttgatacaataataatttgcctataaattagttttcaattatttaattgaaattgatgcaggaataatattagtaaataacaagcttttgatacttagaaatctacatatattgcataagtgaaaagtgttgacaaaatattacaatattttttttttacattctcacttgaaatacgctatctaattatattttggcatagcattgctccactccagaagatgcttgtattcgttacttgtagctagggcaccctctgggtcgaagaactctcctttcacatgacaacactcacagtggatgaagtggcaaagatcgcgctagatatttatgatgcatgtatcatcaaagcttgttcgatgttctattcttggcaactgcatgcattgaagaaacacaatatattagtatcatctatatgtgaagttgtctagtccatagtgtagaaacttgcatcctctgcgttaaccatgtacctcccattaaccctgaggaattcgcacgcgtaatacccatagaggacagtgcctttaggttgcttgtgacacttcatgatatatcgtagaagaaaatagttaaattttgcaattagtgaaacaattggaatacattaagtgagtggagtattatcggccaatatgtatgtactagcagcttctcccttgttcgaatctgttctccacccttgaacttgtagtagctgtacgcactatatggatttcgtatcgtttcgcattaaggaggagatttaattataatacattcatagtatacatgcaagtgtcagaatcacttactattgtaagattgttagaaattctctgtatgactggtgacgataatcgagagggtccaagattgtcacggttccgtgcttcgggtagatgattaaacagatgtaatgatcgctacatattaacgacaatgcagttagtcgcggctaaaataaggcatatatgtagaagagaaatgtactggacttacttaaaattataagaggccaggacgactctcttattttgaaagtgcaagaagactcgtccaatgtactgtgcaatagtaatcattttttgcttctgcaagcccaacttgtattcagctatctcttcgggagtcttgtccttcagctactctgaccctagtgataacctcacggtatgttgtgtttgacagatcctaattggatccaggaatccgataagttcttttttctccttagcatccatgtattgcatcctacaaaagaagtttaaagaagtttgttagtaataatcacatggttttgtattgtacatatttttcatgtaattaatgtaaactcatactcacaggcacccagcagcgacatagttgacgtccatcttttcccgacgatatatggcgtggagatcttcaaaatctagccagaagtaaccgttgccgccgaaagcatctatcggtgatcgaactgttatattacttaggcctttcttgctagtgtccatataccatttatgtaaccttctcatctcccatggaccgtcctcaagtgcaaaatccggtcatatttctttcccatgttcgtatttttccgggcaatcatcaattgccaagtttttttttcccggctagtgcagcggccttcttggggtcatcttctctgaggttggcatgttccttaccccttctaaagacggataccatgaacttctccttttgatcatctttggacttggaattgtggctcctaagcactctaggcacttcagacttctcagtggccttgtcattgaccgggggttcttgcacctcagggtctttcgcaggattagggacttcaaagatttctagatctgtaccgtcccattccaaacctggtataacttctatatctgtaccgactattgccagaagttgcacatctagttgtggcactgaaatctccatgggcacatcttgcactgaaatatccatgggcacctccggcactgaaatttccttagacacctccggcactgaaatctccataggtatcttgggttcttccaccttatcagtcacctgcctcttctgaggaggtctcggaggtctcggaggtttttgcacccccggttttggcaccaccagttttcactgggcgccggtgcccaatccaaagaatatgtcattcttgtgccaaagaattataatatcgaccgcatccccaagtacggatacaccatcaggagtagggatgtcgatgtcgtacgactcaaacccttggtggaccacttgcgactgcactttggcatactcatcgggtatgaactctccgttatatgttctgccagggatagcaatggctgtagcggcctcaagagttcttccaaagcatctaattggaacgtgcaacttacagggtgtattctccttcaggtcatcaaaggggtaatctggctcaggttctttggttgcggggtcaggcaaaataagatgcctaatgcagaaatccatcatttgcctttcaaattccttagccccttcatcccttaggctatccttgtaggcgtcacatttcttgtaggggtcatgtttgaacccttccttccaactgagcttggacgatacacctcgaaccctaccctctgtgctcaggagtacccagtgtcatatttagcacatctttctccctctttggcttaaaaaatcatgtcttctatgcactggataaagactctattttattggcaaccccttgcagctcgaggtcttcaaacgaaaattcgccttcttgcgtgatcttaggagttctagcttttacccattttttcgatatttcgctccattcctccattggtacctgaagccccgccttcctcatttcttcctcctcttttgcccactgcgccacctttggtgcataccccccggagcctaagcgatgaggaaatctgttcttcttggccaactcagcaaacttcttgctcttggcaattctttcggggaggtcttcaacttaacatagtcgttccactgtgtcggtgttatattggcatatgtctcaaatggtgtccggcccgtcttcacgaattttgtgttcaatgtgtttttccaaccacgccacgacttgtccattgtttgcagtgcacaattcctcaccgctgcttctgatccatccgggaactggaacattttcttcagctcttttcataggacttccttatctccatcctatacatgatcacagtccttgatcatgattgtgatcctttcccttactattatgacacactgtgaactgaatctcgcacgtgcagtcagaggggcgagaggctctccttttggaccaacatgggtcacaacatagaacccttcgtcgtttttattgacgcttctctcgcccttcttttcttcgcctgtgctaacttatcggttttctttgagccggtggacttagctgggacctcgtcgtcttttgacttatctttcttcttggctaccgttttgatctccgtggccccgtttcctatgagtaggtatcaaagtttcgaattagttcgggctaatagttatcactcaaatagttcagatcttaattgtacttatcccttaatcacggggaatgtagtccttgtcgcctttttcaccctcgtcctttttccgtcatttcgggcttggacaaggatcacttagcgaggagtactcatcatcctcgtcagctacgtcgttgtcggaaccattggacggcggcaccgttggtttcggagcaaccacaatagcaagggatagctccactgtcggatgtgaagactccacctcccctacagataagttatcttcatttcctttagtactatcggccatcgtttcgtacttctaacataaaaaataaactatataattaatatcgagcccacatgtcatattaacaaatttaaattcgcccacattgccatatattaacagagtaattaatatccgccgcaaactattttctctgtcatttcacacacttttttcccggatgtaggttttagtggaggatcactctcttcagtgccatcgaattccgactacatcttgtggtacttgtgatttgtgcgtaggaaccgtcggtgccgcatgtatacaagcttatttgaacccgggagaggggcggagcccaatgggccaggggttcttaggcaccgggcccaatttttatatttagcggttacaaccccccccccggcgcggaaaggcacgtggcgcacgcagagggagccgcagcagcgcacgcttgcgggacggcaccacgtgtcgcacgattttttccccaccaatttttcctattcttttctggttttttctttctgttttttcttttggttttttccttgtagtttttttttccttttttatacgtacgggacgtaaagtttctgtatgcgtatacaaagtttgtgtacgcgtatacaaactttatatatgtggccgatttttgtttccgcctttttttctagttttttctttttgtttttttcggtttttttgcttgcaggtcttttggttttttgttttttatatgtatgggatacaaagtttctatatgcatatacaaagtttgtgtacgtgtatacaaacgttgtatcccgtacgtatagaaaatttgtacatgtgtacaaactttatatatgtgatgtattttctatatttttgattttttaatatatatatatatgtataaagtttgtatacgtcgtatataaactttgtatacatatgcaaaagtttatatacgtgtgtatatttttgtaagtagtagtagtatagtatagtagtactactactatcaccacctagctgcgcgtgtgggccccactagcagcagcagcagctagtaatccaagctgcgtgcacgggcccgctagtagtagcaacgctagtaacagtagtagtaagtagtacactacagcagtagtagtaggaggagcggactggtcgcgcgctcgcgcattaggggtctcccattttcaccacatgagaacccctcagcccaaattcgtgcaccacccctagcccatgagcgagtcgtggaaggctaggcccatcaacacggtgcgtcgtctgggccaccggcgggggagagagcgacgcctcgtcaatccaaccgcgccagcgccagcgccgcacatctccccgactcccttttttttcgttttttttttctttctttttacaaacgcgatacgacgtctgtgtgagtctgttcgtctcctctcgccatcactcgccgggacaccgtggcgtctactcctgccgctcagcgccttgtcgagatcgtcccgtcctggccagcaaactgccgctgctgttggtcgccctagctagccgccggcagcaccgcagcactgcaggtctgcaacggcacggcggcagcgcccagcgggcagccggagtactactactacagcctacaggcaaccagcaacctgcagccgagcaagcaaactgcattgcacaagcagtcaagcacaagcaagagactaaagagtaaaagataggtacttatttttcttttaactagttccagagaatttcaatttatcatctattctagttctagtcttatttttaatcctattatttgatttctaacttgttaatagcaccttttcaattatccagatttaatgatttatataagctagggaagaactgaaagtttctctggaagggacaaggacatctgttgtcctgtagtcatcagtccatcaaggcatcaaccatcacttagtaaaattgtaagcatactgtgacaccatcataattgctaaataatttgtcttttgggggtgtacattattctattgtgcagtgcacttatagtctaacataataaaactatttaattgacaggttatagacaagtaccttgaggaaagcgctcgatagttccaataatgcagctgtacggaattcttgtccagaacaagtcgatgatggtagttgggagaacgagattgaatatgatccaggcttgagaaaagagattgatgattaccatcctagtaagagggatatagtcagaaggaaatacttgcagaaagggccttgccaaccatgtctattcacttttccggttacaaagatctcaggtaaagacagaaagtttattgaggaatggtttgatgaatttggaagttggcttgaatataacaaggcaaaagacagagaatgttgttttagagatcgcaataagaaagaggatgggtataaagcctttgtggttgatggttggaatggttggcatagaaaaagtaggctaaaagagcatgttagtggtgttggtagcttacataatcaagccatgaaaaattgtgatgctttgttgcaaagagcccaacacatcgatatacatatgcaagtgcaaagcgaagctactaaaaatgcatattttgttcgattaaatggatcaattaatgttgctaggaggttgttaagctaggtttgccttttcggggccatgatgaatcaagtgattcatacaacaaaggcaatttcttagagtttcgtgatttcttagcagagcatgatgttgctttaggcaaggtagtggagaaaaaaatgcatcgaagaattgtcttatgatagctcctgagattcaaaaggatattgttgactgctttgccaaagaaatattacattccatt

SEQ ID NO: 9139 - DNA, 1657 bp, Oryza sativa
cttgagtcaagtaagagcccaaggatatgatggggctagtaatatgcgaggtgaatataatgggctacaatcactagtcatgagagagtacttcagcttattatgtccattgcttcgcccaccaacttcagttagtagttgtggctattgtgagtatgatttctaccttgttaaatgtggttggtggttcagctaagagacaggacatggttagagacatcaatgatgagcatgtgagcaaagcattaggttgtgggctacttcaaagtggaaaagggttgaaccaagagcaatgtcttcaaaggccatgagatactcgttggagttctccttacaaaactctcaaaattttggtagatatgttcccaacaattgttgaagtgttagaatttgtagaagaggatgatagggatagagcaaacagagatcaagcggcgggtcttttagtatatttctagtcttttgactttgtcttttatttgcatctcatgttgactgtcctaataatcacaaacaccttgtcattagcactacaatggaaggatcaagatattgtgaatgcggttaaatgtgtgagatctacaagaggtcatttggatgaccttagaagacatggatgggaaaaattagagagtgatgtgtataacttctgtgacaaatatgatcttaccaaactggagatgggagaagtatacattaatccaaagaagccaaggcaaaaaacaggaattacaaacaagcatcattatgaagtggattgttttaataatgttattgattggttacttcaagagctagacaatcgctttaatgagacaacatctgaattgcttgtttgctactagtactactacttttatactactactagcagtattactacactgctactagtagtactactactatactactaccagtactactactataaaaaaatattttatatgtatatattttttatgtataaaaaatatacaaatatacacgtataacaaagtttatatatgacgtatacaaactttatatatgatacaaactttatatcattcgtattaaaaaatcaaaaaaaggagaaaaaacatcacgtatacaaattttatatacgcatgtacaaagtttatataatgtatacagagtttatatacgcatatacaaactttgtatatagagtttgtatacagagttcgtatataaactttgtatacgtacgttcatattaaaaaataaaaaaaaagagacgtcacgtatataaagtttgtatacactatatacatacatatataaagtttgtatacgtatatatataaaaaaccagaaaaaaaaacagaaaaaacaaacaaagaaaaaaccgaagaaaaccgaaaccacaaaaaccggcgaaaaaggaacgtgggcccccactgcgcgtggacgccgcgccccctcccctcatacgcgcgccacgcgtccatccgcacggggggaggggtgcatgatcagtcgctaattagcaatttcacctctttctcatctgttcgctattttctcctacctccgagagcaaaatggaacggcgcgcttgccccgcatccatgcccccaccgatgtcgattttttcccatccatctgccgtccgcggcagcaaaaccaccggtgagctccatcaccagcagcg

SEQ ID NO: 9140 - DNA, 9291 bp, Oryza sativa
  unsure (1)..(9291): unsure at all n locations
nnnnnnnnnnnnnnnnnnnnnnnnnnnnnnnnnnnnnnnnnnnnnnnnnnnnnnnagtttatataatgtatacagagtttatatacgcatatacaaactttgtatatagagtttgtatacagagttcgtatataaactttgtatacgtacgttcatattaaaaaataaaaaaaaagagacgtcacgtatataaagtttgtatacactatatacatacatatataaagtttgtatacgtatatatataaaaaaccagaaaaaaaaacagaaaaaacaaacaaagaaaaaaccgaagaaaaccgaaaccacaaaaaccggcgaaaaaggaacgtgggcccccactgcgcgtggccgccgcgccccctcccctcctacgcgcgccacgcgtccatccgcacggggggaggggtgcatgatcagtcgctaattagcaatttcacctctttctcatctgttcgctattttctcctccctccgagagcagaaatggaacggcgcgcttgccccgcatccatgcccccaccgatgtcgattttttcccatccatctgccgtccgcggcagcaaaaccaccggtgagctccatcaccagcagcgccgccgcattcaggagcgacggtgtcgtggcattccgcgtcccctatgccccctcgacggctcaaggaattactaacttgctctgtgaaaaaaaaatttcagcaaagtagaagatgtatgagaattatgaagtgtttctttgcactggtagaagttgaacctagaatttgatcataattttaatgtttgatctcgatgtgtgggaagttgtattgttggacagaggattatatattgtttgccactatcatgctatgagacttatgaacgtgtgtcctgtacacactttgttgatgccctactgctgtatggtgtagttattttgtaatgaacaattcaatctgccatgtttcttgtaatgaatttgtgagaaaagcacaagcttttgctagggactttaatctttaaatggaagattttaggctaacctgctgtcttatttttgtctgctgtgaacagagcatatatctgaatggagcttgaatattgcaatcttgtcttgcaatccagatcctctgcagtacggtacagtactgctcactgacacttggcttgaacctctattcttttctgaaagctatttaatgggacctgcactgatataacactaagtttgcatattgctaagctttccaagttcgtctgatatatagacccagctgcgtattgtgaaatgtagagaattgtgacagatgggctggttaaggacattggtgtctgcaatttctcagttaccaagctcaacaggctgttgcaatcagctaatattccaccggcagtatgccaggttgcggactgtcagatttaagttccaacatactgatttccagtgagcctcccaaaatagtgtcgaagtgatggttccatatgaataattttctggaaaatttgtctcagtacacctgaacttgcaaccatccatccggtactcatcaacccaaatgaacaatgcacagctagaaaaatgagatgacaatcaacggcctgagaccccatttcttttactacaaatcagatgacaaactacgtctgttgccttaacatagctaatttacatgtagaaaatcaacaacggcaagcatagtacatattatcaaataatttcatgagaaggaacacaactacatctattgttcttatgaaccaatttctaatgtcatcagttttctgtttggacaacttcttctcgaatgaaatttccatatctgaaagacggtgagccatttccagctctagcttcattccctcttctgcctttgtttttttttcaacataacaggtccactcagagcgcctccgacctggattggtacgttctagcaagtgccaaagctgctcgaatgccttttgtacttttggatgccactctggatctacccaaatcaaagtgtcgcattgctcatcctcctaacaaaaaaatagtactattatttagacatgcatgactaaattaacagaaaatctaagtatcaatgaactagtaaaaagtacaacaaaccaaacctcaggaaggcaaccaagaaatctccttccggtgtcagttccttcccatgcagtcctcctttttggtcacatgccatgtctgcacttcgaatttgtgccatgttcctccctgcaatactcatcatcgatgtataaaggaacattcaacaataggccaaacctgtcctgctatatcggaaacaaaaggattaaaccaaatagcgggacttacccacctgagctataacccatactagaaaatacgcgcgccgtttggcgtgcttaatatctaaaccgttggttactttgtgtatgtataaaacatgatttataaatgttggtttttagtatgtgagcatgaagaataagtttaacataggcttatatatatcggaaaatagttatatataaaaaaatatcaaataagatcgaaacattacataaccaaatatgaatacctctcttcttcttttttttaacgactcggacgagacagtgcgaagttcaaattgataaagtagaaaaaattacaaaatcacaaccctagtaggccataaccaggaaaaggaaaaaaaaagataccaccacccacacaccgacagcgccaaccgcaaacccaagagaaggctagcaccggaccagccaccgctaagcgtgaccgaccgccgctagaccaacaaaggagctacaactgggatcgcccagaaaccaacccctacaaccgacacaaagcactactctatccacatctaagggatctagggagagggagtgagagagaagaatggaaccgctcccccctaaggccctccgatgtgtccaacttgtataaactagggcgccgatacaagacgacgtgactctagagcaagcatgcaacaaaagtttaggtggttccggcaagggtgctacctagacagcgtctccagggagagtgtcgaggggtgaccctctctagcgggaggccgtgagaccccccctttgtgagttcggccaggggaccgggtgcaagtctgaagagcgcgttctcgtgcccatgtcggtgggaattgtgcttgaagggtcaactgtgaggaaaagagagagggggattatacaggttcgggccgctatggagcgtaataccctactcctgtgtgtatgatgatctttttgaggttacaaagagttcggatcctgggagcgcaaactagggctttactagcctctacccagaattccgttcatccaaccgtcctccccttgctcgcaagatgaggtcctccttttataggtaaaggggataccacatgcagcgtccctgccctccctgttcgggagaaggacccacatggcctacattaaaaagtgtcccatgccttgggccggaagcgatccgaacggccgcccctgggtggcccccaccgaagtcctttatctgacatgggggacatcccccgtcattccctaataaattcttggcgacttcatgggctcacacgcgtgggaggcggtgacctgcacgtcctttccttgcacacgatgggacggggcataccagcccccacgccgtctgacacggagtgagacgtgggtgcgctgccgcctgtcccatccatccatcgccgggtcacagaccggtcaaaagccggtcgcctggcgcacatccatcagtgggcggcgcacgtcctgccacgttgcattaaatgcgacggggcggttggagcactgcccataaatgcgcctggcaaacggcgctcctccccgctcaagcccccatgtggcggccacgtggcggccgagcgagggcctcggggcggtttagcccctcgggcccgaggggcgcgacaaggtaccccgagcccccgggaggcgaaacgggcggtcgctcttcggccgaccgcacgaccccccgaggggggctgggtccaccgcgcacgttgcggaggaaaggcttctcttcctcctagcctaggtaccccccgggcccatattatcgatagagagaaacaacaaacatcgccgccgctgtccgcgaggtctcaagaaccctgactgcgctttcacccactagagggggtgagacagcatgacaacgccctcaggagggagtgacgctcgactgccatcgttgctggctcggccaaggacgggctgggttttcacccgccatccaccgcctgcctatccactgttgacacaccgatgctccactgccatctgaacctccgccagcgtgtgggcaccactacaccggtgccccgtgccgggcagcctccgcatgccaccactggctgcgccatgtcacctcgttgtgctggtcgctgcaccggaatggcacactcctctcgatagctgcaaccactgttgccgccgactgaacctcctcgcatcgcgactaaccccgtcgccgctacccgcgcctcgccggcctacacagccaccagctgtgccgcacctccgcgcctcctcgcgccgtgggcacctcaccggtcgccgccgttgccgggtgctgctgccgctggctggccacccgctatcgccgtcgtcgccacgagcctcgcgctgccgttgccgccgtgacgagcgctcctaccgcgagctcgccccacccgatctggccgcagggtggccagatccgcctccggtgcgtcgaatctggcccgccgtcgccatccccgccgcgcggcgcagctcgcccctaccatcgccgtctccatccctgccgccaaccgccaccccaccagatccagccggagcggcaaggatctggtggtcaccgccgccgccgccctgggcggctcccctggccccgggagcgagaccctatcggcgaaacgaggagcccgccgccactgtccttgcggccgcgcggctttgccggcagccgctcaggtggcggcgaggcggaggaggaagatgagtgggagggggcagccggagctcgtcgcctcccgagctgcccaggggagggcgacgcgagaatttagatggagtggttttgatcagaatacctctcttcaaatatttaaaaactcgtattcaccatatttcacttagcttctgaaatttgtttttgctcgattgaaatctcgaaatttttttctagcagggtgataattgcaaaactacataagatctgattgaaaaaaaaaacagcacacgcttcagtcacttttcacctctaccatcatcagaactgcacatacgattcagttatttttaccgctcccgtcaaacttgcacgtaatctaaaaaagcccaaaaagttcgcacgttttggcgtctcccacatataccagccaaaaaaaaaaagaaaaagaaaaaagaaaattcccctctgacctgattctatctctcgagcgggctcggctcctcctcgtcggcgttcctccgcctccgccgtcttctccgccatctcctctctcgagctctctccctccccgatccgctccggcatctccggcctccgctccgttcggccggcgcgccagtgtcctgtgtgtcccccacatcttctgccgcaacttgcaaccctagccgcggatggcggcgcagccttcttcgtcggcgtcgacgggtaatgcaattcgtctcttctcgtagattgcccctagatggagaagatcttcctctcgttgattggattattagtgtttcggatggtttatgcttgtggttgctatgtgtgttctaggtatgaaccggattagctagttaaccgaagtgatttagtttgggttgtttgattcgtttcagtagttgtatatagagatctagccacgaaatatgttgtcacttgaggagtggagcacaccatcaatcccaactcaaaatagcttctccttttacctttaaatgaaaggagtgtggagatgctgtaccattcagtactgattcccgggatctttgattgtctctggctctgtgcaggcgataccaagtttgatgcgtcgcagtatgctttctttggcaacaacgcggtggaagaagttgagctaggtggattggaggatgatgatggtatcgatgctggttttgttggtcctggtgatgaagaatacccttctgcttatggaagggatatgtttgaggtaacatagatgacagttcatttaattttgatgtgacaaacttccatccattatttattactttcaatttaaaaaactttcacaagaaatcaatgtttctttatgacacagtgtgcccagtatgtaattttgtaattcccacagcactcatgactttggtagcaaacacccttttgtgttcagaacatgagagagaggtgggaggtgctcctaggggttattttgatcattcttttttacttcttgtttgttttcattgttgttcaatccaacgggaattaatagttagtctatcatggttcagtaagaggtagcagggtccacctgaacactacggatttatgttgaatgaagagtaaatagtaagcatcggtgttatggtagcttcagaggatgcacatagtccatgagactgtggactcatcatgcggaagccttggaccatgctgtgttgaccattgaaaggagagagggacattagttgaggacgggaagatggagagctaagcttagacattgttgtttcttgccattgttattgctggaactttcctttggtgctgtcactaccatgatttctgctcgcccttgcaattccttttctagagtaacttcagggtagatagcacctttgttaggcattgactgctgtagcatccagcagagagaagcagccaatcaacagaagggtaaatttgggatgcactaggaaagtggcaaatgggatgtgtagcgtagggggtgtttcgcaactatcccgatccgcactggttaactcggttgatcagtatttgttatttagtgtttgataaaacatgttttgaaattttgctttttggggtaaaaactggctaggaactgaatatatcaacaataccgaataacatgaacctggccttttggtgtcttgtgtactgcgacatgtttctgtctttgcatgcccggcttgataatcttcttggctcagttgcccagttggccaactttccaacaattagcggccacttgttttgactggccaatactggctacacaaccaacataagcacctaatattgcttgctcatgttcatcagtaagctgcttgagtgattgtcactgttttattatcctgcgtgtggttgtgtgcatgcatggattaattcttcttgtctcatctgttaactgtcagctatcattcttagtttgtaattatgttaaaaaagagttgctgtaaactttggtaaaatatggtatttaccaaagtagaactgaaaaaacttgtatctaccaatagcacaacaatgatctgtatttttgtaagtataatgtatttactaaacaaatactccctccttcccaaattgatcatcatataatggaattcaaaatttctcaaattgatcatcatataaccgtatggatacggatttcatcagaatacaattaatgcagcaggggagaatgtgtgtatgctaaggtgtaattggcatggtgttttaatcgatgcatgcattgtgggagattgatgtgatttaaattatccttggtcttagtgtataaacttatatgatgatcaatttgggaaggagggagtaataccatatttaccacacagaatttaacgaaaatattgtggtaaaaggtaggtgtcgatgttctgtttcatcggtttagtcgggtcaattcttcggttttcataaaattcggtttctcgataatagccgctgagaattttttttttacaaatataaaccaagccgaaaaaaccaaataaaatcggttcggtagttacggggaatggtttttaccgaagaatctcacattaaggcgacaggtgttcgtgttactcatgttgcccgttgcccgcacgcctgcaccacccatcttctcctgctcgcagctcgcaccactcttgtctactaaagaatcgacagatgggagagatttgccgtgagatttgtggctgtggcatgtgactgccttatcagcttatatcctccaatgtgatatggctgggccatgggatgcatggatgagtcttgcattgactaagctcacattatacttcaaatgagctcactttgagccaagctggattccgagctagagaactggctcatgctggactcgactcaacgtcgagtgaatttcgagcctaattcagataaggaaacaactacaaaaagtctcatgaagaagggtatcatgatgcccagctattctaagtatcaccttacaacgacttaatgcatccattgtcaaataaaaaggcagtattttattcgaacaggcgaatccaccataaacaatttaagaattcattacttccatctattggaattaacatcagatatactataactcaagacatatagacaagtgcctcggttcaatctcaacttgtacacctgagctgcagaagagcgctcgcaagccttgagcttttcttgcatcccatgacttgatcatcccggaacttatgtcaccaaataggaaaccaacagcatcctttctctgcactagtaatatgcccgtgcgcagcaatggacattgattcatgggcttatgggcccatataattggggatgggctcggagtgtagggagggtgctacgctcacgggagggaggcgtacagggcgtgctccgcgcggtggggtgcggaggagagcggacggatgactccattttttagtagagaaaaaatcaaggttaaaaattttgtgatgggtacgcagcagttcacccacctagtagctatccaagaatcactgcttcagcaccaactgctgttccgtacatgatatgcatgtcatacaacatatcggaactgcatcaaatcgatttagaattacaagaaaacagatgcaatacggcagcggcatgggactggaacaatacacacagatacagcaggcccaaatacccagagaccagaggtactgctgctgttctcaacacctatcgccaccactgcacctttcccctgccatcagctcatggtaaggacgatcacctgggggagaagaaattgaagcagatttgctatctctgatagcgaggtcgaaaatttggggaattggaggaggggaaacagcagcaaacttggcatgtaatggtgggggagaggactgggtgaagtaggaagggaacataata

SEQ ID NO: 9141 - DNA, 1949 bp, Oryza sativa
  unsure (1)..(1949): unsure at all n locations
nnnnnnnnnnnnnnnnnnnnnnnnnnnnnnnnnnnnnnnnnnnnnnnnnnnnnnnnnnnnnnnnnntgtgttactggtcaagctttctttggcccatgcccataataattgcctagtagacctgttatagaaaactgctggattttatgcacactgctactcttgaaaactttgtagagttcaattaattttattttagcggaaataatatttcaccaaaaaagttgccttgcaatctgaggcagcttgtaatttctctgctgcagagttgttcaagtccacttctcattatattagaggttgttttatctcactatctgtacttctgagcaaatttagctcaggaaatagtgcagtaattatctggatcatatccaggttatcttattgttatagttttcttcgcttagtgttgcggcctaaataacagattaagctgtgatgtgcttctgattaccttaaaagattgcagtatcacactatcacttatttatgttgcaaattaaggaatcagcttcagctgctcacaccaatcaagcttttgcttttgcaggatgaaggtggaggttcatttactggcgttgatgatcttgctggagcattctcaaaggtttgttttttttttaaagcatagctttttaaccacataatatacacaaatgtgatctaacagaaacatggtgtattttatttttttttttggtagaaattgcagaatgtagattatagataaataaagttgcatattactgttgtatacctatttgtatgcttgcattgtgttgttcttttttaactgtgaacttatttgttgatttctccactttcagttgaccagaagcatcaatgaaccaacacaatcgggaataattagtcgtgggggttcaatttctagacaaagtgagtgggtatttgatttattccatttttcaaggatatatgtaagattcgttacatctggccaatgggatgaacatatccattaattttccattgttagaatgtgaatttcaatacatttttacagtctttgttctcttgtaggtttagggcccctttgatttgtaggaaaaatgtaggaattttggaggatttcaatcctatggaaaaaaaatcctatgaagggctttgaaacaaaggattgaatcatatccaatcctttaaaattcctatggaatgggtaatcctatgtatattttggaggaaagttagcaagaggtctaacctcttggaaaatttcctctgagtctatctctctcatctgattcctgcgtttttcctctggtccaatcaaatggtcattcctgtgtttttcctgtgtttcacaatcctctgttttacaattgtattcctgccagaatcctctgttttttcattcctacgattcaaaggggcccttatatatggtttctgatttattaacattgtattctaatgttaatgaattcaatttgtgtaggttctactctggactgggcacaagattcatattggcctacacagcctatatttggagctgaaccagggctgaataatgaaagccggtggtctcaaccacctcatttagcccgctttgctgattctagactgcacagaacatcctcatcgccgcagcaagatgctcaatacaatcctaatgaacatattcttggagcaatgccatctctgttgcatagaacttcatcatacccacaacaagagcctcaatacagtcacacagaaccaattccggtacctaaatcatcattcattccgtaccctccatctggtgcagtatcccattcttcgccaggtcaaccacataacatgaacatgccatctcctcccacttcattccaaatgcctgtatctgcacaaaatgagttacaccatccccagtttcctcgtggtggtatgcctccaaggccacttggtcggagcatgggtcatttggaatcagcaggtttatc

SEQ ID NO: 9142 - DNA, 14109 bp, Oryza sativa
  unsure (1)..(14109): unsure at all n locations
tattgtgtgttcttcgttgcaaccccttctgcgaccctttggacatgctgcaggtgatggggcttctttcatcataaagtctgtactggacagagcaacagagcttctcactgatcagcatgtggcctctacctnnnnnnnnnnnnnnnnnnnnnnnnnnnnnncatcatttgatcccctctttgggctgcttacagagtattgcatgagtaaattcgatagtgtgattcatgcattgcaaacacaacctgctgtggcagcagttataagcagggaaatgccagttgaattgttgcgtgccagccttcctcacacaaatgagtatcagcgaaaacagttgctcagtttttctcagcgcacggtgcctgttaacaaccatagttctcatgggtccaataatggacctatgacatcagaatctatcccaagttcagaaagccggaaaatataagttaaatcatagtgtttttgcttctttgggtaatcagtatacttgatacaatggctctttaagatggagactctttccccaatttcctagtaaagaaaagtctatatgaatccaggaaacaagatcgagagggttggagcatcgataaacagcggtaatataaggcaccgagtttactatcgtcgcgacatgtctggtttattatgtactgtagggatgcagtctgttttgcatgcattatgcagatggatgtgtttttgttactgggaagtttcttcctgagttttgttgctcatgaaacctgcctggtatctatctctggctgtagaaggtgcttcttgaagatgctgtttgattgttcttcaagacaagtgtcctggaatcatcaaggtggaatttcaatcaggccgcctttttttcccattttgttttgttcaagggttgaaatgtaactgtcgatcatgccctcatattgaaaaaaatcctagctgtactgaatgttgagcattggtttatggtactatgttttgttattattatttattaatttgtctcttttctgacttctttttttctattctagcggaaggtataattcgggattttagctgagtagagaatgacaatgtagtagtagaaacttgggtggctgtaatgatgtttgcaagtttaaatgcaacaagttagaagtgaccacctgaccatcagatggctcatgtcttggggtggtatttttggttgaaggttgtgttaagcgtggcattttctggcgccaattgttaatatggtgtagaagtattttgctgatgagttcaaaaagggaaaaggaaaaaatggtctactacatttcaattcatagaatgccttataaattcaactcgtcggatatatagctgccacttgatgtcgacaattcttgcctcttactgcatcttatatgcggtgctatacccgtatatgacatatcctagtaatacgatatctggataggcgtcaattcagcttttgtccagcttcgtagcgctaggatgtactaggatgtgtcacatcacgtagtaggtttgtttttatgagatggagggagtacttgctttccctcttctcaactctgcttatctacctatgggtacatggctctgatatgcttccatcattcatctccttccaccgtctatttcctagtgagtgcacttgtatgattatagatcttattattgtgtgttttggtttaaggtgcacgactggtaggacaagcaagtttaaatagcgagtgcctatgggtctctaggatcagtagctaggattaggccattcccaacccaaaacactagatataattttcatacactccacatcatcaataaattagtactagacactactctttcaatgcaaacactattattccatacttaaatttaatgctacttatctcacatgatgtcttggatgttgtgcagaaaccatgtctcatgcaagacatggttttcttctttttcctcatttattcacttgtcatatcatttttcatcataggtgacagtttatttaatgttatagacaccatcctagtcattgagttgggaatggccttaggggatcattcttttgcttggacatagatcatactcccttcgtcctaatgtatagcaaagactggacgagacatatcatagtacgaatttggagtcctctgtccagatttattgtactaggatatattctcacaaatcctagatttgttatattttgatacggagtgagtaagagcatcaccaatttaggaattcctaaacagaatttagggtcttaaaatatcttctccgacagattagaaaaacatgttaccatataatataagaagtgggaccaccaacaaaactaccgatgtttcctctccttgaataatgacccgaccaataggacccacatgttgttccctctttctttcctcttctcttcctcctctcgttcttctacctctcacgcagggccagaactagtgcacagcgagacaagttggcatcggtggcaggctccagcaagggtggctggaggagggtgcgagaggatcctggtggccggcagcacgaatcgagtctcagcggaggtactaatcaaggttgtgaatgactagttgtggagagctctaggtgtgacttggggcttgacggaggggagaatcaagcatgcgtgtactagctcgggggccagccgtgacgtgaatcgagtcgacgtcgggtgagcttgcgacaacagagacatttcagctgtgtgcgcgaattgcttgtgattggtagattggtaggcggtgatattccctacatgtggagaacgagaatagcggagaaggtatttctaattttttgggatgttgattggagatctgttggatctattttttgaaataaaaaactacgaaattttgagattgggaataggattgggcatgctctaactattaattattagtacacaggggatggagacaccacgcggatatcaaatcagggtatattgcacgggttatcagcagtatttctcatagtagaatctttcgctgacaactaatctagataatgttggtgcaggtttatctagtgacatggtgaagaatcatgtcaagaatgtggtgactaacccaacgtcgtcagtcgataacattccagcgccactgtgcgacctcccgtagacagagcgagaggaaattgtcaatgtaaatacccgattacttatcctctcttgatcttaactcattttgtaggagtagtgattctaatactttcaagaatcgcccttaacggatgtgattgggggcattgatcgaccactaggaatctgcctcgctccatgaggacgttgaggcacatccccactcagccattgccctcgcagcagtgaccgcaatatcctcaggcgttggctctagtggtgcaataggagtcaaaaggacactttggaccaaattcccagagccaaaggagcagggatgctcaggagggttagtgtctccgtggtaagtaaaacatcaacactactaggttctcttatggaatttgtcttagcgattgatgatttattaattggcagacttcttctgccaagaaagcctcctcgggcgaccgcggctagacctttgcttctgtcaaagcaaaaaagattctagtaagttgacctcttactttggttatcttcttgtttgattccttagaatctagttcgtcgagtttgattgatgtgtcttatagtaaagttgactctgccgttgtcggcgcaaagctcttagcctacctacacccaagctcttctccccaaacaaacaattgatggatcttgtgcacaatagttgcacctgaagctagagatggaggaattttggaggcaggtgggactaagggaggggttctcactttgaaggtgcggcaaaactagttgaggcattggggtcaaggattttcgtgggaaaaggggcgcagtatgcggcacaactaacatagctgaagtctatgtcagtatatggcatgggtatcacatgggtctcaatgggcaagaatagaagttggtagcaccgagtgaactgggctttatacttttggagtgggggagggggttgtttgctgtaatgtccaatagggcttgtgctctaaggatacatttagactaaatctaatggttgacataataattatgactaaatctaatggttgacttaacctagaggggatattgaataaggtaattagaaggggattatgagcgtcttgttcttgatctgctagatctagatccagaactcaaaggacatgcaagggtgaattcatcgttggggcttcagccccagctcccctcgatgaaccccaggtgcccctagctcctcagaggtagtagaggaaagggtgtgtagtagcagtagcaaccagaggaggaagactattatctgttggttgggttgtgacaatcctgcgtaataggtgtgttgacagaaaacacatggcctgggagatctgcttaactccagtgcaggtcgaaagctcgccttcggatgtattagcgtgccagttgatttgatcctgtaatcaacaagaaatagaagcaaagaaaccgtggttaaatctataaatgatagccgatcggctagatgccgatgacatatcacttatctttgggccgatgtcatctgtgtatcgatcggcagtcatgaataagtaaagaagaactaaatctactcgaccggctgtagatataaatgatatatactcctcatatcgatatatacttaaatcaagtgattgggatagatcggttatcatgccgagacagtataaatcacttagatcgaaacatatatcaataacaggactatatatgtttatagcatagccgatcagatagatctagcatgtatcggctaatactctgatactactccatatcaggatattaaagcaagaataatatatcaaacaaaggcctaacatgtttagatacggcaatatcttgatataaagggcagatttaacatatcagtatagcatatagaacaaatatagttaaatcagatacgatcggctgaaactccgatgctattctaatcggcaactagaaggcaggctagatatcgatattctaagcacgacttaatagatcaaactcaactgatatagtattaagtatgaaaagaagagtgatatctagacaatcaagctgctagaagtttcatagaatggtagatatcttatataatctagaccaacatcaagatctaacctaatcggctgccttctgcattcagatattggccgatagtagattagatgacgatgttgctagagattatgtaagatatatgataactcgacgaattatataaacaagattagagtgtcataaagatggaaacactaatcctaagaacgcaattcgtcataacgaattttacctcttgttgaagatcgaaatcgatgcagctcaacccgaaaacatgaactcgtcaaaacaaaactaaagcaaaaagggtggcgatgtgccaagattgtattgaacgtgtgtgttcaaaaattacataaagctcggggtctatttatacccgagaattacaagatatgcccataccggacacgaccattatctctaacaaactctaagatactataagtctttgcggcagacttttgcccacatttatctataaggaatttacataagatatcctaattaatagatacaattgccttcccaggactctatccgtgcgtggcaatcatcttgaaatacactaacttgaacccgatgtcgcatacaagttgtattgtcggaatcggctatatcggcttatttagcccgactcagacccagccgatcctaaccgtagccgatctggattccagccgattcctgctctgcttccgaactcgatctccgcctccaacttcgctttgatcaagtcctctttcccgacacagatgttaccaaatttggttgttaacacatgccccccaagtccgggatattcgataatgttccggatttgccgtatgccgactccgagcgagttttgcactccgccgcttttgaccgttattccagcgctttaaatactaaccgttacccccgagaaatctcacaccgtgacttccgttttcaccgctcaagcgaaaccttttctctctcttctccggcgattcctccggtgcaaaggtgattcctaggcgacctcctcttcgacgagatctccgcccgcggccatgtcgtcctccgccagcccatctggtgcaccaacagccgagtacgctgaggtaagttctcattggctaaatccccttctttagcagcagatcgatcttctcttatctcatattgcttttcctcttttggttgcttcaaatttgtagcatctttctcaccaagtcgcaattcccagtctgacgcatgaaaattactactttcttggcccaatcggcaatcctgaccccaccgagttcattgttggtgaaaccaatagaatcccctttagactaaccaacccagatctaggtcactggaagaatactttcaaatcttggccatctctagagaaagttctaccagaaaagagctggaccacatggttcaaacgtgtgttagccagcaagagggttcactgggatgaaattggaatcggccaagcacttgaccttactatagcaaactcagccaaggatgaacccctaatggcagctgcttcttacttctggtcaaacactactaatgccttcctgttcaatcaagggcctatgactccaaccctcatagatatcagtatgatcacaggtctggatgtcacctcatcagccaaccctatgagtttgaacacaaagaaccaatatgacttcaaaaccaaaagcgtaggaggttggtcaggctatgtggcagcatacatgggccagggttcggtcactcctcgagaacatgtggcctttctattaatgtggctagaaaaatttcttttctgtggatcaagttgcggccccacaaccaactggcaatttctggctgaagctctagaaacaaagagacaattccccttgggcaaaattctcctcggctatctataccatatgttgagcaatgcatcggctaagatagcagttggctcagtagttggagcaggtggaccctggtggctgctacaaacctggttaaacctgatagtcatgaaggttgtcaatcggccatccgtactagaagccgagttcccaagactagagccgattgtaggggatgatggagaagagcgtactcatcggagatgcacatcatacggagaatacgcttctacaccaactgatgccggggcaaaactatcggctgaactgctcaaggattggttttgtagcttctatgaaggctttcaaaaagatgctagaatctggttcctttatgaagactctgcacaacttgagcacccagtggatttcagattcgaagacatcaaccatgaagtataccaatcatccagggaaatcttctcggctgcaatcagtccatgcatccttcctgttggcattcatcaaggaagaaacatccaagcttcctatgaattctatcatccaatgagctcagctagacaactcggaatgggccaactcccaatcggcttattctttgctgacaagatccaatgccgaggagggatttcatcaaccctaatgatcgattggctacttagccttcaaggaccccctctgggcagtattgacaacatagaactggcaacattcagaagcaaaagctttgacaggtggtggggtaaatggaaactgcatttattccatcaaccagcttcaatgtatatgacatacctctttccagatgttgtccctcaagtaagtcttcaactttgctcaactctagttaaataactgttcagccaattaatctcaactaatcgtccttttgatttgcagacaacagagtcttcccctcctcatcaaagcaacagtggcaaagacatccgatatgccccaggtttaattcctaacggaggtaggctatctcctccagttattggctatgacgcccccaggacatcagctcttcttcaagggctcgtcaaagaaccagccgatgccggcaaaaagaggaaaaccagatcgtcggctgtaagcatcgtagccctaattaagaagaagaagaagacaaagaaaaccaagccagctaatgatctgcctaccctagatccatccgtcaaacaagctttggatgaagaggtaattgaagatgaggttgatcaggccgcagccgaggtaagtgatactgaaagaacaccatcggcttcgcctaagcaaacctctccgactccttctgctccggttcacttctcaagggtaagtgtttcttgttaatccctttcgttattattttgtcttatagccgatcattcccaagtcttataattgcagaaaaagaagactgcggtgaagaagaaatcggctgcaacaacatctaaaccaggtccactagtaagatagttttaacttttcattagttaattttttacccgattctatctggcacttgtttcctttctgccttcacctcctcctcctcctcctgttcaacaatcatcaagtgatcagaccccttcagcggcgggaagtcatcacgtcgaggaagaagaacaaccagctgctcctgctatcccagtaagtttcttttatcataacaagcattcaaatcggctataatcgtttaacctctaatctgcttctaaattgtcactgcaggtgttagctgatcttttctcttttgacatcagagactatcttgatgaaggagaagaagataccacaagcaaagccttggctcctttatctgatgatgtgaagaaaactctaggaagcattttagatcggctagaagcatcatcgctagacagcttggtggttgattgtggctcaattagggctcggctacacgagattcaggctttaatcccagatgagttagccgatatccttactccagccgtttaccttgagcaacaccaattcaaactggagaaagccaagttaagactagccgaacggcgagaacgtaaggacattgaggccactatccaagctagccgacaacttgtacatgaagagaagtccaagcttgatcaattatctgaaggcccaatcaagtctaacattgatcggcttgaggctcgcaagattgaactcttagcacaacttgaagaatgtaacgctgagctagatatggaacacaagaaactagccgatctccccaaattcattgaagaacagaaagtaagactcaaatcggctatcaagcatgttgttgagctgactaagtccctaaaagttatccctggaaccgatgctcaagatgcccaagccatagaagaagtagagtagattaggcaaaaggctatatcggctatccagcgatacttatctcaataatctttgtgtaataggacttagaattgaaatttgctaaaaaattttgcactgtatttaccgcattttgatatatatatgccccccctagttttacaatgtgaagagtattgataaaattataaaacaactaagggcgatataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaatcacaaccgattacaccatgaaaaacaactaagggcgatataacaatattggccattgtatatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaggacgatacaacagtatcggccatcttaaggtgatgtaaacacatcggctgtcatgcatcggcaatagtagccgatcatgcgttaacccaaacacttgggtaatatttcttcaaatatttgccattgagcgctcgctcataaacttcaccgtcatgtccttgcaacatatatgctcccttagacacaaccttatgaatttggaacggtccttcccaattcggcgaccacttgccgaatttactatcacgagtaccaatcggcaaaatcagcttccatacaagttctccttccgaaaaatctttaggtaccactttcttattataatgccgagcaacacgttccttatccctagtaaccttcgcaagggctcgcaatcgtgactgaaccaaatcctccctttcgtcagccataagattgtaatactcattggctgttaaatcgttttgcaactccgtttgtcgagagccgattctaacttcccatggcaaaacagcctcatgaccataaacaagtttgtaagggggaacttgaatctatccatgataagccatcctataagaccataatgcttcggccaatcgagtatgccattgccgaggataatcagaaattttccgctcgatcaacttaataaaactcttattagacgcctcggcttgcccattagcttgtgcataataaggtgaagaattcaacaacttgatacccactctatcagcaaactgaacaaactcatcggacacgaagattgaaccttgatctgtagtaatagtttgaggaagaccaaatcggtagattatgtgtttctgaacaaattgaatagcatccccagaatcaactttcttcaaaggaatcgcctctacccacttggtgaaataatcagttgccaccaatataaatttatgccctttactcgatgttgggtttatcattccgatcatatcaattccccaacctctgaacggccacggtttaataatatggttcatagctgacgccggtgctcgctgaattgctccgaacttctgacaatcttgacatcccttgcaatatctgaaacaatcctctagcattgtcggccaaaagtaccctgcacgccgaagcaaccacttcatcttgtgagccgattgatgagtaccatagatcccttcgtgaacttcgccgattgcaaccttagcctgatcggcactcaagcacttaagtaataccccatcaatcgtccgataataaagctcatcattcaatagtgtatactttaatgccttatatcttaatttcctagaagccgattgagatggattacttaaatactgatgcacatcatacctccaatcatcggctgacactgctgcaatttcaactttaacatctttgatcatcggcttataccccgatgccccttgggccaaatcattagcttcaagatattgttctcgagatacatgcttcaaagtaaccagtcgaaaccctttcattagttccaggcacttctcattataaaccatcaatgtatcgttcttgcattcatattcccctgccaattggctgattactagcaaggaatcccccatgatttcaatggtatcggctacaacttccttgagtaattgcaaccccttgagcactgcttcatactcagcctgattattggtcgcatatggtttaatagtataagcaaactcgaaacatgcccccctaggggaaattataactaagccgatgccacaaccatgagtgcataccgatccatcaaagaataaagtccatggtactatctcaaccgagccgattgaatcatcacgatgttctacaataaaatcggctatagcttgtcccttaatcgcttttggcgattcataccgaagatcaaactcagtcaaggaaaatatccactttccaactcgtccctttaatattggagccgacagcatgtacctgactacatcggctttgcatataacggtgcactcgttagataatagataatgccttaacctcgtacacgaaaaatacagacacaagcataacttctccacaggagaatatggagtctcagcatccaagagccgtcgagtgagataaaacacaactcgcaccttcccttccaattcttgaatcaaaactgagccgattgacttctcaccagccgataaatataacctaaacggtattcctttctgtggaggaatcaatacaggaagagagctgagatactccttgatattatccaaagccttttgctgctctgccccccaagtgaattgctgatcggcttttaatctcaataaggttgtaaaaggttccaaccttccggacaaattagaaataaaccttctcacaaaatttatcttgtcgatcatctcctatagttccgtcttattttccgagggctgaattttcttgatcgcattaacgctcctttgggtcacctcgatcccactttcatgaacaataaatcccaaaaactggccagccgacacaccaaaagcacattttgtcggattcatcttcaagccatattttctggttctctcaaaaaccttccttaaatcggctatgtggtcctctacttctttagatttaacaaccacatcgtcaatatagacttcaaccaaccagctgattaaatcatgatatatataattcatggccctttgatatgttgctccagcactcttcaagccgaaagtcatgacgacccattcaaacaagccgattgcaccgggacatctaaaagctgtcttatggatatcttcctcagccataaagatctgattatatcctgcgttcccatccataaaactcaaaattttgttccctgatgcgacatcaaccagctgatcggctactggcattggatattcgtcctttggtgtagctttatttagatctcgaaaatcaatgcataccctgaccttgccattctttttaataactggaactatgctagagacccattcggcatatcggcagggacgaatgaaaccagcatcatacaatcgtttaatctcggctttaacaggctcgagcatatcggctttacatctcctcggaggttgctggcgtggtctaacccctggcttgataggtagccgatgttcaacaatcgatcggctgagttcgggcatctcatagtattcccaagcgaagcaatctctaaactcttttaagagctctatcagcttggttctaaactctggagacaaatttttgctaataaatgtcggccttggccgatcgcctggacctatgtctatttcttccaaatcatcggccgacataaaaccctgaccttgcttgtcatcgagatcatctactgtatccttagcatagacattcgaaccctccacgacgctctcaaagtaatagcttgggttctccatcttcgattggctgtatatcagaatcggacacttttagaacatctccatcccagacttttccagataaacaatcaaggccatccatctcccaaagggctaaatcggcactagcaacattaactgacctgtcggctggcacaatctctatcttgtcgccttgccattgaatcaagcattgatgcatagtcgaagggatgcaacagttggcgtgaatccaatcccttccaagcaacaagctgtacgaacccttcccatcgatgacaaaaaacgtggtaggaatagtcttgctgctgactgtcagctccacatttagaacactcttggtctctgatggattaccaccaaagtctttgagcaccatatttgttttgatgagatcctcggcattcctacccagctttctgaatgtggcataaggcatcaaattcaccgcggccccaccatcgaccatcatcttagacatcggcttcccattgacgtagccatttatatacaatggcttaagatgccgattctctgtcccctcgggtttctcgaaaactgcatgttttggtgacaggaccca

SEQ ID NO: 9143 - DNA, 561 bp, Oryza sativa
tcggccattgtacatcggcaaatcacaaccgattacaccatgaaaaacaactaagggcgatataacaatattggccattgtatatcggcaaaccacagccgattacaccatgaaaaacaactaagggcgacataacaatatcggccattgtacatcggcaaaccacaaccgattacaccatgaaaaacaactaagggcgatataacaatattggccattgtacatcggcaaaccacaaccgattacaccatgaaaaacaactaagggcgacataacaatgtcggccattgtacatcggcaaaccacaaccgattacaccatgaaaaacaactaaggacgatacaacagtatcggccatcttaaggtgatgtaaacacatcggctgtcatgcatcggcaatagtagccgatcatgcgttaacccaaacacttgggtaatatttcttcaaatatttgccattgagcgctcgctcataaacttcaccgtcatgtccttgcaacatatatgctcccttagacacaaccttatgaatttggaacggtccttcccaattcggcgacc

SEQ ID NO: 9144 - DNA, 610 bp, Oryza sativa
  unsure (1)..(610): unsure at all n locations
gtagatgataactttattactcctatttatatttacaaagtgcaacaacaacacttcttacgaaaatcttgactaaactcgaaaccctaattaactattaactcaatgctctcaaaagcgataccgggaagcctcacgctccctctctatttatacataaggtaggcagcctaaagccacaaaccaaactcatactagaagtcctaatccacctaggaaaccttcctgtacaagaaacaaactttacaaactccaatcattccaaattcggactccttccaaattcgattccgcatcccatatgcacacaatacctccatcgtatgccatatgtaatcttcaccaaccacgtgcattgaactctagcttaagtatcccgcatgatatctgaccgtcacggacgtcgccttatccccaagtcgactcccgatccatcaccggcaatactctcccgaggcatcaagtcacctacacatgaatcaaacaaagaaaccatattctgagaccaaggtatctccaacttgacttattgttatcaaacaacagtattacannnnnnnnnnnnnnnnnnnnnnnnnnnnnnnnnnnnnnnnnnnnnnnnnnnnnnnnn

SEQ ID NO: 9145 - DNA, 477 bp, Oryza sativa
gaatgatcggcagcgacggctggagcttcatccccggggccttgagcgcgtcaaaggcggctggggagatgatgctcaggctggctccctcgtcaaccaggacgcgcttcatcctgacgttgtgaatggtcgggaagaccacgagggccaacttctcacctcgagcgagcattgtcagatggtcgctctggtcaaaggtgagcttcacctccgaccagcgcgcctttcgagccgctttgtgggttggaacggcggccagaagctctcgcctcatggccttgaagcctcagcgagaggtgtgagcgcaagccctctcgtcgagcgtggcgacagttccctgaggtatctggaactccagatcctcactgtcatcgccatcatcggcgggggccttcttcttggcctcccctcgctggtcatcggctgaggtcgtgggggctttgccctctcgtcggccctgccgcttctcctcatcgg

SEQ ID NO: 9146 - DNA, 431 bp, Oryza sativa
  unsure (1)..(431): unsure at all n locations
nnnnnnnnnnnnnnnnnnnnnnnnnnnnnnnnnnnnnnnnnnnnnnnnnnnnnnnnnnngagccgctcctgtaggtgctcgccgccgccaattccaccgtccaggaggggctcaacgcccaagttcaagccctggcggaagagcgagcggtcctggaagcagagtgggcacagctcactgcggaccgcgcgcgggttgacgaggggtgccgcgccgtggacgacatggtgaaggtgggacacaaaatgcgccaagcccaactagctgaaatccacgcgcgcgaggagacgctggactctgtcatgcgggagacggaggaagagcggcaggcagcactgattgcctcaagcgtgctgggcgaagtgctgggcgacatccgcttacagtacgaggcccatgccgaggacctggcaaagagggtcaaggatgcc

SEQ ID NO: 9147 - DNA, 5339 bp, Oryza sativa
gtgaaccgccgtgaggtggcctcacgctggctgggcgagcaactcgcgaaacgcgaggaggccattgccggcgtgaggctcggcatctggagagtgcccgcgctgagtgccggcgatggcagtgagggcttctgagctggaggcctgggagaaggacctggaggcgggcgtgcagcccggcggcgcagatttggtgagccagcttaccacggctcagagcactatcgccgacctagagcgcttggtgcaagaccaggctggggagattgcggccctccgccttacgaacgagatcggacccgggcagttctccgatgccgtcgatcggctggagcgcgcgaggcgccgagtcggcatctccgtgcgccgggatagtaagctcccgcccacacagccggcactcgcgctccggctggacaggctggcggcggatctggagaggctggaggaggaggtcggcgagatcgtgaaatcgtcgtcggcttccttggcgcgggtcgcggtggaactggtcctcgcgagccaccaagcctgcgaccctgacttcgtcccatggcgcgcactcgaggatttccccccggggaccgaggcaatggctcgggagcaagtccgggaggtggccgacgcgatcgtctctaacttcgaggggtcggccccccggttcaccttcgggcttgcctcggacgaggagagcgggagcggagacgatggtgacgacgtcggtggcgaggactgggacgacgtcgttagcggcgccggcctcgggggcctgggcactccgtgattatccgcacttttaatttccttttgttgtgtgcctgcagcggacacttgtctttaggctatcgtgcggtcttgtctgtaaataaagcttccttttcgcactttctacccctttgctttctccattgaatgcatacggcacggaaagaaaaaacaagagcaaaagtatataattgacctccctgtgatcgaaatgccgttcttaccccatccttcccccccctcgggctcgttctcgcgaaaaggtaaatccgcgctcggtccgtggtacctaagtggtgaggggccagaccgtcgccccgagggagcgcatcctctctatcgcgcgtattttcccgggattagcttctatgcctcgtgaggagaccagaaaactgagtttgcccgccggcacaccgaacacacacttgtcggggtttagtttcacgcgtgtggacctaagactgtcgaaagtctcggccaaatcctgcaacaacatgtcctggtggcgcgtctttaccaccaggtcatcgacatacgcctctatattgcgccctatctgactacttaaagtgatacgagtcatacgctgaaaagtagggcctgcattctttaatccaaaaggcatagttgtataacaaaaggtgcccacaggagtaatgaaggcagttttttcctcatcttccctagccatgcggatctggtgatacccagagtaggcatctagaaaacacaaaaggtcgcaccccgtagtggagtcgactatctgatctgtgtggtaaagggaagggatctttagggcatgccttgttgaggtctgtgtagttgatgcacatccagagcttgccgttggccttcgggacaaccaccgagttcgccagccactccggatggatatactcgcggatgaagtcggcctctaggagccgcgccacttcctctcggatgaaggcctgttgctccggggcttgacgccgcactttttgccggatgggtcgcgcatccggcctcacggcgaggcggtgctcgatcacctccctggggacctcgggcatgtccgacggcttccatgcgaagacgtcggaatttgcccacaggaaggagacgagcgcgctttcctatttggcgtccagggtcccgccaattttggcggtcttggatggatcatcgccaagggggatctccttgacaggcacctcatcagccgaggcgaggcgcttcttggaggcgcgggacgcggaggcctctcgggcctgtggttccgtggccaccgctaggttgtcggcgctttgctccgtgcaggcgagggcgattttgacatcgccaaagacggtgatgggaccactagggcccggcatcttcatctggaggtagacgtagtgggtggcggccatgaacttcaccaacgcaggtctgcccaggaccgcgttgtaggcaaattgaggtccgccacatcgaagtcgatccgctcggtacggaagttggtggagtcgccgaaggttaccgggagctcgacgtggccgaggggccacgtgtgtcccggagtcacgccgatgatcggcagcgacggctggagcttcatccccggggccttgagcgcgtcgaaggcggctggggagatgatgctcaggctggctccctcgtcaaccaggacgcgcttcatcctgacgttgtgaatggtcggggagaccacgagggccaacttctcacctcgagcgagcattgtcagatggtcgctctggtcaaaggggagcttaacctccgaccaccgcgcctttcgacccgttttgtgggttgaaacgggggcaaaaagctctcgcctcatggccttgaagcctcagcgagaggtgtgagcgcaagccctctcgtcgagcgtggcgacagttccctgaggtatctggaactccagatcctcactgtcatcgccatcatcggcgggggccttcttcttggcctcccctcgctggtcatcggctgaggtcgtgggggctttgccctctcgtcggccctgccgcttctcctcatcggctttccggaaccgctcggccaaattcttgaccgagcggcagtcagcgagactgtgccgataagtgttgtgcaccgagtaccacttgtctgccgaccggccctcgccggatggagcagtggagctcggcttgtcgccggtggtctttcccttgcgcggggcccgtgcgggcccatcagtcgcaaggacatggccctcgtcatcggagcgggccggtttccttttgcctctcctatctcacgcttagagcggggaacagactcgggggtagccgcagccgccgtgccggtgccgggggagttccaggcccacgcctcctccttccgagccaccttgtccgccagctcgaaaagctcggcggtggtcttgggctcctaggaagcgatcttctccaacatgcggttatgccgcacgccattccgaaacgcataaacgaccgcgtgggccggaatgcatggaatggtgttgcggacctggcagaagcgctgtatgtacgagcgaagggactcgtcgtccttccgccacacaacgtgcaggtccgactcttctcctgggcggggatatgtgccctggaagttcgtgatgaactgctggcacaggtcctcccaggagtagatggagtcggggggctgggtcatcaaccagccacgcgcctgacccttgagggccatggggaaataattcgccatgacccggtcatcgccccttgccgctacgatgatcgtggtgtagatctggaggaactcggagggattgatgctgccatcatacttctccgtaaggttggggcgaaacttcgggggccaccggacgttccgcagactcgccacgaaggccctacaacccgtccctccaggggtgagcgtggggggagggccgcctcgtgaggaggaacgtggcactccagatgaggaggcgccttcccccatgcgggcagctcagcgctcgtcccggcgtcgctcgatatggattcgagcatcctgctccctgtagagaccgtcgtgatgcctccggcttcccgaggcccccgacgatgttggagccgtggaccgcctcgagaccatggccgaccaacaggccctcctccttgctgacgaggagagggtaatgggggtatgcaacgtaccggtgacggcgggtcggccgcccgcggccaactgccgctgggcagtggtgaccaagttggccacgtcgtccaaccagcgctggacaggggtctctggctccgagttcacggggggatgccgcagaagggcacccgccgcctaaagcgcgcctcggggcgagccgccgtcaccgtaagtgaggcggcgccgtgccccgatgcgtcgtggcctcccttcacctgggggcggggagagggccaaaccacccgaacgggtggggtcctccctccgcgagggttcacggcgggggggagttggagagttgcggcggcggtgacgagggccccagctctcgctagcatcctcactcccagacggagtgggggtgaataccacctcctccttctccaggacctcgaccatgatcgtcgagggcccagggaaacttgggacggaaggaaacgacttctctttaaagcgcgtgccctccccctacctggcgcgccagctgtcgagggatgatcctctctagcgggaggtcgtgagacccccctttcgtgagttcggccgggggaagaagctcgcttctagaaaccacgtatccgtccctaaggcccctagctagctcgcacacaatcaaattatacaaattcgggccgctgagaagcgtaataccctactcctgtgtttgggatttagattgagagttacaaaggttcctaaactcgggagaacactcttctcctagagcccaagttagttgagaatcgtccctttgctcggtgggcaaggtcctccttttatatctcaaggggataccacatgcaccgcctctacctactcttctttcgggtggggtcccaccctatcttgaccggaactcgacccgtgccttcgcctggaacctgaaccacagcttgtccttgaatggggcccagtgccgtccctcgcctgacacgggagacagccctgtcattccctcattaatgggtgaagacttgtggtggccgccgtccgaatgaccctccgatgggacgggtcatacctacctccactccgccggaagcaaatgcgacgtgggagcacggtcggtgtcaggccggtcacagaccggtcattcttgactatggcacgtcagtttagcacgccgcacgtctgtctcactgcattaaatgcgacagggggtagttgaggcattgcgcgtattaaaggaggctcaacctagaccctcacctcgctcgctccccccgccaaatggtggctgggcgtgggcctcggggcaaagcggtgcaagggcccgaggggcatgacgtggcaccccgaggccccgacccccccggctgctccagcggttcgcagactgcgggggcaggacccaggctgtaaggacacatggcaggatgggaaggtagattccccacacttcgcataaccctgggcccata

SEQ ID NO: 9148 - DNA, 4913 bp, Oryza sativa
  unsure (1)..(4913): unsure at all n locations
aaggccccgacccccccggttgttccagcggttcgcagactgcgggggcaggaccaggctgtagggacacatggcaggatgggaaggtagattccccacacttcgcataaccctgggcccatatctccaacagagatggagcagaaaaaggtagccttctctccagatgatcatttttctttttataaaagaaaccagatagccatcttcattactgtcaaatattaaaaaggaataggggatcaaactttcaattgagttggtccacaagacatatatttactagtgaaaaataaatctagtgatgatcctaggatgaaccacgtcatctatctatcttctattatatactaaaagtctattaaacttcctataaacattctcaagccaccacgtggcgctctacaaacgctcctaagtcgccacgtggagctctaataaattagaaaaaaatcctagaaattttaagaaaaaaagaaaaacatctcaccattggttttcacttaaatgagtggatccattatttttaatcattagatcaattttaaaggaatatatactcaatccaacctatgggcctattagatcgatctcacggaatatgtagccttcccttcccctgctgtacatgccaccgtacgtaagtacgtatatatgtgatacgtattccatatgccctccccttttctcctattttctaaaaactcattacaaaatagtttaaattttaaatagctaaataatcatgattctcaatttatatacaacattaaattcatttgtactatttttatttgtaattaaataaatacattaagatcgatattgcatatattttgcgaggtaaagaaaaaactgaaatacgtttggacatagaccctagcgtggcagtcattaaacaaataaaaaaattgacaacaactataccatcttaaatcattctatatataaatatgtacattaaattaaatatcatgtaggacgcaaaccatcaaccgtcacatcctaaaaattaagaaatatcgttgaaattctatgagaaaaacaaaagcaaaacatcctactatcattttacacttaaatcggcaaatttattattttcagccattagatatatcattctactctcataagccactacgtatcacatcttaaaaattaataaaaatcacataaaatctaaaacaatgaagcatctgacctcgataaaatcattatttcagccattagatctatatttaaagaaaaactataaaaaaataaagtaccatcccattccccctccccctcacctggattaacaaagctccatctttatattatgaaattataaatatatagtaaatgaataaagatatcgttggagtatataagtataaaaaaaaacagggagtagctaaagaaaagccctaagtgcggaaatgctaatgggcgggtgatcgctccctcacccgcccagcgatcagacgcccgccccctcccctatactactagatacactcctccctcctctcctgctacagtacaccacacaaaaatttaaaaaaaaaacaaaaagttagaaaaatttatgtatagaaatactatatataaaaaatttaaattcaaattcaaatttgaatcgggtatgtaaactttttgacttataaactttgggtctataaactttaggtgtataaactttagatgtatagaaatactatatatagaaaatatttgaattcaaatttaaatttgaatcggatataattcaaattcaaatttgaatcgggtatgtaaacttttgacttataaattttgggtctataaactttgggtctataaactttagttgtataaactttagatgcatagaaatactatatatagaaaatatttgaattcaaattcaaatttgaatcagatataattcaaattcaaatttgaatcgaatatataaacttttgacttataaacttttggtctataaactaactttaggtgtataaactttagatgtatagaaatactatatataaaaaaaatatttgaattcaaattcaaatttgaatcggatatataaacttttgacttataaactttgggtctctatactttagatgtgtaaacttgaggtgtataaatttactaaaataagaaagtaatgcggtggtaaaaaaggaaaccaggtggagggggggcgtggggcgatcgctacccccatctccaggcgatcgatcgcccattaggatcgcccccctaagtgcttcaatcctactgcatcattagtcaactgctcagtagttttgctccctccgtttaaattatactattgactttccacattcgttttaaaatgttatatataaatgttatttattttgttgtgacatattttattattattaaagaaactataagtatgacttataatttagaatatttacactaatattttaaatagaacgaataatcaaacattattttaaaaattaatggtattatctattaaagaaaatagcagaggtagtattactaggggtggaaacgagccgagccaagcctagctcggttcggcttgcaatggctcgtaacaagctaggcttggcttggctcggttcggttagggatacgagctaaaacatgagctcggctcggctcgtttcctggctcgagccagctcgcgctagcttgcgaaccttccgttgaagctatataatttataatcattaagaaaagcaataacaaattatcaacatgtaaaattaaaataactttatatattcaattcattaaaatctagacgataaattatatattgacaaataataactcaactgcaaaataaaatcatccatacaaatatatgatggcctaggctcacgagccaaatcaagtggctcgtgagccagctcgggcttagctcgtttcagaaacgagctaaaaaggaggcttgggcttggcttgtttggcattcaagccgaaccgagctaagtgagctcgagccaagcccgagctaagctcacgagcccaagctttttttccacccctaagtattactaattagattgatttagggtagaccgcgagaggtggcggcggtcattggggtcacgtacaatactcctatctgatttgatctccaagacttcaaaacttggaaaagaaatttggtgcagaactgcagaactgcagacctgctccagatgattgccatgtggacgacgtggtgatcagacggctatctcccctcggctcctatgcagcgcgatatatatggtgaggatcgatcgatcacccttctccatatggtttcctattttaacaccgcattacttttctattttagtacatttatatacctaaagtttgtacatcataaatttacacatctaaagtttatacactgtcgacgacctcaaatttacacatctaaagtttatatactgttgacgagtgatactcgcagacaggataagttgagtattggggtatgtttgaatgagggtctatgtagtacaacatcaagcaaacagaagacgaggattatactggttcaggccccttatcaggtaatagccctagtctagtttatatgagattgatgatgatgagaacagattacaaagagagtagatgaaacaaacgacaccgacgagatcatagtcaatagattcgacgggaccgacgagatcatagtcgatagattcgacgagatctcccggtgacttggctccgaatacttcggcttcgtaagctgtggtgggtgtgttggcgatgatatttgatgcccttcacctccctctaggggtccgttttataccgtggattatcttacccgaagtaagagttggagatatgtaaactagtacgatatagcagatattctatcccctccaagtaggactctgatagtttcttaactcgtagagatatttttcataattcgggacagattcctaacggtgtatacggaaacgacccgtgcacgtgaaggtataccttatcggtatatttcataagtcgtaggttagagggtatgccttatccataatcctaacatacacctcaagtttagagacccaaagtttacaagtcaaaagtttatatatccgattcaaatttgaatttgaattcaaatattttttatatatagtatttctatatatctaaagtttatacacctaaagtttatagacccaaagtttataaatcaaaagtttacatacccgattcaaatttgaatttgaattcaaatattagtttatagacccaaagtttacatacccgtttcaaatttaaatttaaattcaaatattttttatatatagtatttctatacataatttttttcaactttgttttttatttttttttaatttatggtgtagtaggaagaaaagaaggggaggaggaaggggggagagagcgtatagggaggatggggatcgataagcgatcgatcgcccattagccacacccgaggatggaggagccttgctcggctggattttttcacattttagtactttttaaaaacttatcctacaaatagacctataaaaaaacttattctagaaatgatccttgtcgcggcgccaatgtcgttggcgccatgtttcaacatgacggcgccaatgatattggcgccatcctctccgccctcgggtgaaagtttagtcacaaatgtgaagtgggacggcgccaacgacattggcaccgaggaccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9149 - DNA, 6569 bp, Oryza sativa
gggtgaaagtttagtcacaaatgtgaagtgggacggcgccaacgacattggcaccgaggaccaatttgtaaaaaaattgaaaaggacctatttgtaaataaaaaatatttacaaataggtccacaaataggtccttggtatcagcgtcattggaactaaggacctatttttaaataatttttatttgcatataggtcctttttcagaaaaaaataatttggtcctcggcgccaatgacattggcgtcgtcccgttcacatttgtaacttacctttttcacctggggctaggaggatggcgccgacgtcattgacaccgtcatgttggaccacggtgccaacgacattggtgccgtggaaaggatcatttattaaataagtttttttagagatttatttatagaataagttttctaaaaagatcaaaatgcgaaaaatccagcctcgctcggctcacctcaaatcgcataggtatcgactcattggcctcagatccgcttttctcatcttgccggcgccatctccgccgtaaccccaaatccgtcgcctcccgacgtgttcccctccaactccctccgcagtcccatccacctcccgcctgatcccttcccgcgccgccttgtctctcgttcgctgccgggacgcgtttgtgcgcgcatcggggacggggaggactaccatggtctgggacctcggtctcgcatgaaacacagcacctcgaccgacgaccatcgatcaaatggtgagcaaccagcccgaccttgtcctcctccgcgatgcccgctacaacaacctgtatctgtatctgactaacggtgaattgctcataacattattcagagtttgttcataatgcattattaagagttgagagctagatgattgttctgcatatcgcataacattattctgcctgatggattatttgttgatatgattcttattcctgattctggtgttcccgataacagcagaacttatgcatttctcatttcgatttatctttatgatggtggttctctatcttctctgcagaatatatacagaagagggaaaatcgctatacctgaaaggactgtaaatttggaaaaagaggatggtgttgaaaaaattgtagtccttcactcctttgtaatatgaaataatccctaaattgttgcaaggattgtagtccagtcgtccagattgtaacctgaacagccttttttttttgttcaaattgcaagaatactgagttatccctttgtaatctgtagactgtatttttctatctggaatacatatgagcgtttttggttgttctgaaatattcaatctgatggatgtgttacaaaaactgtgattgtttatctaattacgtgagtgaataaaatacggaatattgtataatctgaatttttgaagaaatttaataagaacaagtagcaactcacaaggtgagttcaggcaaggaaaagatgaggataattaagagcaactcaagaactggtcgccacaaagtcaagtttttacatgttaataagtcacaatctccgtattaacgtaactaataaatccatggtcgcaactaatatcatcaatgaaaattcagtaaatccattgctccttgtcgtcatgcgcagcgcaggtgaaaccagccggcacctgatgagacgaaggcagaagcccggcaggtcgatctgttcttctccaggcctcctcgtcctaccatcactatcgtcgacggcgtcggcgagaggtgattccggtccgattgaggtgagagggcgagggagcgatcgccgcagcgcgtccgcaaatcgtgctcgccgttcgatctcttttttatccacgcgtccaccatcggcgcccggggctgcagaggcttcgctttgcaccggtgtatgcaccaattttttttcaaatcaactcggactcggttagtcgctttgtactgccgcgcgcgcgcgtttcccatctccgactcggattacacgtaggcgcgccgcgcgcgcctatttatagccgctgtccgtctccttactccatgcattagcctgattgctagttgctgctagcgcgtggcacaagagcagcgagaccagcagtaagctaggcatggcggcgcgcgccggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggtgctgaggtcgccgcccgccgccgtgtgcggcgggctcccgagatcgcgtcggcggcaccggcggtagatgactggcacgagcccgatccgatcgaggaggaacaagacgaagatgatgatgatgatgcccgggaggagcgcagagcgaggataagggagagggcgctgctcctgaggcggcatgaggaggagcagcttcttcttcttcacccgcagcatcaggaggaggaagatgaggaggcgtctgagtctgaagagacggcggaatcggactccgacgtcggcgagcagatggccgtcgtctacatggccgtgccactgtttataccaaagccgcggcgtgacaccatccggctcaaggaggaagaacggcagcgacttgaggacgagctgcaccggaagaggctcgaggacaggaaggctcagacgaggcagatcctgctccaagagatcatcaacgaagagctcctcgccgccaacacagcttcagatgaagccgccatcaacggcgtggacaccgacgacgaggtggaccaagccgaggagtacgagtcgtggcggcgccgggagatggcgaggatcaagaggatcagggaggagagcggcatcgacgacgacaagtcgatcatggaagacgagaacccggttgctgatcgtcccaagaagaagatgaagatcaagaagcagatgaggttcatgcaaagatactaccacaagggctgcttcttccaacaagacgccgacgatgcggcgcagacggcaggatcatgcgaaatctaccggcgagatttctccgggccgaccgggttggacaagatggacgtaagcgtcttgcccaaggtgttgcaggtgaagcactttgggcggcgtgggggaaggaagtggacgcatctagttaacgaggacaccacgtacaggacaccacgtacggtgagtgattttgtatctatccccacaattttgtaaaatttcaaaaaatgtgagcagcggcaagttatttttcacccccttgtgacgtactcatctgtattttaatgtatgacgccgtttactttttgaccaacgtttgatcatttgtcttattcaaaattattatgcaaatatataatcatgtgacaaaaaatttaattgtaataaataaagcggtataatcttatcttagatgaatagttttggagaaaaagtattcttacatggttgcataatgcatgctagtagatatcttcaaaactatagcccaatgcacaatatttggcaccatagatctttacttgaaatgatatctggaatggagacattagacattttcatagattgttcgggtgggactcagtcaaatccatatgtgacaaaacatttggaagatagtgttaacttacctctacctgctcaagccttagatgaatttcagcagctacaagttgaattgaatgagttacaacttcaaatacaaagggagatccttagtctgtcatatggaacagccgtgtttgttcctcagaattttcacgggctgaattttgtgaatcattctccccctagtcaccatttggctctggaaaactaaatgtgtcgtcaagaacaaagtatttatgtggctgatgttgtatgatcgattgaataccggagacacgttggacaaaatcacaaaaaactattgtgctctagaatgcagatctaccttgtgttctttgcttactggttctagggagacaacaatgcatcccttcttcgatcatgtgtcgagaccgtattagagtaagatggaatgctaatcttgagtttttccaaatggtggtcttggcacgaccgaggtttaggcaaaagagtttcttggatataatgttcatagcttgctggcatatattgaagcaatgaaatgaaataatctttcaaaaattgttaccagaagaagacaatttgttccattcttttaacaatgaaattctcttgcatatgtgcaagatgaataagccccttaatttagtcatttttgactgattacaacatttacaataattattttgatgtgatactcttgcgtttaaatattttactgttttaaatatataactattaggcaaagcttgttagaatttttcataaaaaaggatcaaataaaaaaatatatcatgttagatcaaatactcaaacgcaaaacaatatctctcatggtagatcaaatattcaaaaacaaaacaacctttaaatagtaccattactatttagactagagtcgaagcaaaatagaatatcaattgaatggatcaaatcgtaagtatatacataggtataagaatttgattcatacctatacctagcaacaaacaacttaaactcaactttatttcacaattcattattacatacctaactaattatatgtttgaatgttatatacctagaaccaaaatctaaccaaaaaaatgtccaaactcagttcaatcttatttgaacttgttagtaaagaagttaatgttcatatctaaacatttttttaaaaaatcatactcattaaaattgggtatatactcaattttaatcttcgagcccgagcaccatggagccccagttaattttaatacacatatgtatatatacatacacacacatgacggtgacactggctctatatcgagaaatagttatatgttaaaaaaaactaggaaggtagccagcgcatacgcgtgggtatgttgtttaatcttatttgaacttttattacgaatttttatgtgtggatgatatttttgaaatattttttgacactattttaaacgtatgtttgttaataactggtttgggcatattacttgaaattgtatatctattaggaaaaacgtgtcataataatagagttagttcatatctattttaattatgtgtgattcctttctaaaaatttttggactttccaaactttatataacatttttattttgtatgctatacatgaatttaagtaacattttaaaaataataaatttaatctaatggtgtaaaatgaaacaactaaattgtattgtttttattttttttataaatgtagatttaaattagtgttgtatatttgtcaagtgatatttgaaaccctaaaacaagatgtgaaataaaaaattatcatagcaataattattatatatatcatcctcgtatgctaagataggatgaataaagattattcatgggatatttcatatttataatataaatttagtttaactacgtatatttacataaatttgtagggtaatatatttatatttaaatagtagataatactattttaaaagaccatcgatctttttcgaatgatacacatttttttgttttattgtttttatagtaagggattttgaaaatactatttcaaaagaccattgtgcatagatttttcttttccaatggatagtaggtaagctccaatttttttccaagtcatatgtatgtacggacaacttatgtttttttttgtttttctatcctaatagttatatagttctccagtatacgtacacagagtaatatggtattagtttataaaataaaatactctaatggtctaaatattgggttcatcaatttaagtgaaaatcgagggtgatatttacttaaatttatagagtaatagattttatctttaaatagtagaaaactctattttaaagataattgatttttttaatggtactacgtatggttttttttcctttcgataaacagtagataagatacattgtattttagtcgtatgtacgtacctattgaatacttgtgttttttttccggtgaacagcaaggtattagtttctattttctttttcggtgaacaataggtattagtttctttttaaataaaatacatctaatctaatttaatggtctaaattatcgggtccaccgattaagtgaaaatcgacggtgagattaggcattgtcacgtggcggtccagaagcgtttgtaaaagtgccacgtggtggcttgagagtgtttatagtaagtttaatggacttttagtacttcctccgtttttaattataaggctttctagcattgcccatatttatatatatgttaatgactctaagcgcgcgcgcatatatatatgtatatatatatatatatatgtatatatatgtatatatgtatatatgtatatatatatatatatgtatatatgtatatatatatgtatatatgtatatatgtatatatatgtatatatgtatatatgtatatatgtatatatatatatatatatatatatatatatatatatatatatatatatatatatatgtatatatatag

SEQ ID NO: 9150 - DNA, 28683 bp, Oryza sativa
  unsure (1)..(28683): unsure at all n locations
nnnnnnnnnnnnnnnnnnnnnnnnnnnnnnnnnnnnnnnnnnnnnnnnnnnnnnnnnnnnnaatgcttcatctatatcttttgaggatattgagaaaagtatttccaattggaagattcctaaggttaatattaaggaaatatatcatgtaggtactttttcgttacttagtgactactatattaaaacaattgaaaaaactattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccttctatgtagaaaatgctgctgaaaaagaacgaggagttcctcggctagttattaattacaaacccctcaataaagttctacaatggataaggtatccaataccttataagcatgacttaatacaaaggattcagggttcaaagatatattctaaatttgatatgaagtctgggttttggcaagtccaaataaaagaagaggatagatataaaactgcttttactactccttttggtcattatgagtggaacgtaatgccgtttggtttaaaaaatgctccttctgagttccaaaaaatcatgaatgagattttccttccctttacatcctttattatagtttatatagatgatgttttaatattttcccaagatgttgaccaacattggaaacaccctaatatattttataaaatcatagttcaaaacggtttagtagtctctgctaagaaaatgaaacttttccaaactaatgttcagtttctcggttataaaattcaatatgatcgagtccaaccagtagcaagagtaatagaatttgcagaaaaatttccagatgagataaaagataaaacacagttgcaaagatttctagggtgtttaaactatgtctccgatttttataaagatcttgcaaaagacagaaagattttaaccgagaggttgaagaaaaagcctccagcttggacagctaaacatactcaagctgttaagaagatcaaaggtaaggtcaaaaccttgcactgtctttatatcctagatcaagatgccttcaaaattatcgaatcagatgcctcagatcatggttatggaggaattcttaaacaaaaaaaggattccagagagcagctggtcaggttcacctcatatagatactgcattcctatcctcatatctggtgactagacccctagtcactgccctgggttagagctggtatcagagccaagtgctcgtaacctccccaagccatcttctccgaaaggggggggggaagaggggtcggatagcgtgctgaagtcgcggtgatcccgaacggtgtggtggtgttctgaagtcgcgaagttcccgaacctttgatcggttgcctgaagtcgcgttgccttgttgagccgcagaaggcgtttgtcggcgtaattcgttgactgggcacttatcaaaggcaaaggttgaacttaattgtgggaaatattccctgccgttgactggaacacatcatatccaaatagcttgatcataattgtgggagatttccccgccgttgtctggtaactacctacctatcttcctatctttcgtataagatgtcttggttggttagatcacgaagagccactgatcgatctgtagcctcgtgcagtagcgagaagtctattggcactatgtcgataaagaaagcttcatctatatcttttgagggatattgagaaaagtatttccactggaaagattcctaaggttaattttaaggaaatatttcatgtaggtcctttttcattacttagtgactactatattaaaacaattgaaaaaactattccaattagttctttgcatgaaatgctctaacccagggcagtgactaggggtctagtcaccagatatgaggataggaatgcagtatctatatgcaatcttggatgtgagattagtacgtgacaattggatggcaatccaggttgttaatttttttttttatttttttttttatattattatgcaaacatgaatgcagtacaggaaataaagataagctgtaaatacgaattatgtacaagatataaaattagatatttagaacataataggtttatatagaacggtccaggtgttcattcatataccttgataggttgaaggtagatccttctgaagattacaccaaggacttggtacaacacgttcgtaattatacaggtacaggactctcacaaggactcttacatagactctcacacttagactctcatgagtcttttatttaggttctactatagtactaacacttagttggagtggagtggagtgtgatggctggtggagaggtgagaggaatggttgagtgagatgtgttgtgtgtgaaatgcgatgcctgtgaaatgtgatggtgagccccttatatagcgctcggtagagaatattcatgatatctcttcttgaccttaaagagtttatgatacccctttagacttcatggagagaatctttggtgataacgctttagacctttaataaagatgtcataatatcgctttttgactatggacttatcttatctggaatagtgtagattccttatcttgaatagtgatctttgtcggggatgacaagatctttattcattatcttcgttgattatcgtgggtgctgattgcaccgtgtcaatctctgacggctctgatttctgaaatcactgagccaggcttctgtagtaacttttcttggagcattcatttccaaaatccggtttaattatgcgccctgctcccttgaagtattcataactttggttgtaatatttgctgataaaaatccttgtgatcttgttttggaaaaccagctgatattcataatctgtggtgatagcttcttcaatttctgcagcttcagaaaataatctccaattttcatgattagcaattgttgtatatatttcttcctcttcatccgatagtttgctaggaccgtcttcttgaaaattaaattgtccattcatgatatatatataatgaattgctggacgaacaggtggtgtgaattttggtggtatggaggagaagataatcctgtatcttccatttccaagtctcctgcagacatctttcacatcgcttccaaaatcagattgaaggatctgatcgagggttgcatagatggaattcacaagaccatgatctataatggtttggagagatatttcttcatggttgtatgtgggtaggttccggaatctttggagatttatctcagctttgagaaccaggaatctataggatgggtcagagattgcctgatcatctagccttaagagagggagcatatatatgattactcgtatggctgggtttctttctcttccttctaagagatcaaagaaataatcttggagtccaaggaatattttcatttgtctctctttaaacttttgccaaacaagatcgaggatgtcttgcccaaagcaagataaagtttgctccgtcttgaagcttaatctaggttggagattttcgtatgtggtactcatgggattttggcttttaagtttcttttggcaagaatctttgtaggcacaagatctacatggtgcttttggctgggtccggagtatatattgtggaaggaatgaattgggatgattatgcagtatgtatggtgtttggggaatggtatcatgcctttttgtggatgatgatggtttattatgtggaaaagattgcaataggttattgatatttatgtggaaagcaaccatgctcgaagcaggatctgttgagatcaaaatcttatctgagaataccttggtattcttatctgttgccatagattgttcaacttccatgggaagtttatcttggccatcacgggatttctcctcgcgataatctagtaatctctcctcatgatgagggatatcttgtagtttagcccttttttctgttatcttttgatctgagggcacgaaatttttgaaataatatgccaggccatttaaggcatgagctttttcttttttgttttttgcctgccacaagtggtttaataacccttgttgtagctctgttactctgaaattgtgattaaatcgttctccatggcctctaggcagttggggcagtctccatgaactcatattcgtgaaccattcagacttctgtgaagccatttccctgcatatatattcaaaatttttagtagcttttaataaatatctatcttcccatgatgtcttacatggcaagtccatagattttggaagatatgatgggaaagaattgtcatgcaaatatattgtattcacaacttgttctcttttggtctaaacaagctggtcaagaatctcatctgtgttagacgaaaatcttaggctcacctgtttgcccattatctcaaattgaatatcttcggttgtgacaaggaagggacgaatgagtgataaaaacggtgttcctaaaataacatcttgcttaagatttttaacgagtagaaaagatgttttaatgcaaacttcagatatgcaaatatagatttcagggatttgatattctactgttaaaagtcctccatctgcctcacgaattctgtgggcggctttacagaaatatttatgagggataataccttctcgaatgcaattgacatcagcaccagaatcaattaaagtgatatgctgaaagtaggatccgtctataaaacgatacataacttctgtgtaccatttttgcttcatatatttttgaatggttccaacaacctgatcatcttcttgaattggttcgtccttttcttccatatggaatccttcttttaattctaacatgtatagacgctttcttatttcttctaaatcttgtttcataattttttggtcttcgaataggctcatcaaatctggtttctcattcttctttttctgttcatctaatcttttgaacacttcatcaatagagaggaatttgctcttttgaatatccttttttagtttatccttatcagtcttgactcttgaaaggaatttttcgagaactcttcttttttcttctggatcttgaatggtttcaaaagtatcgagaacaaattcttctaaactggttaaaacgagtatattttcatcagactcttcttctgaattatctggctcataacaagagcaaccactgtcttggcaacaattaatctctgcatttttttcttcatctgaacatgagtcattgtctatattatttagtattgtttcaagtttttctttaacatcttctgattctgaatctaacaaggcttggatctcttttttaactttggatttgaaacatctgttagctatgtgtcctttcaagccacatttgtaacaaatggtttctttgctttcagtgtcttgtgttcttatattcttattgtaaattctttttggttttcttttggtagcttgaaagctcatcttgcttttatcatttggttttgtcctaggtttggaatgggtttttctttttctattgacataaggatcttgaaaaccaaactgatagcaaaaatctctcatttctcttttaccaagaatcctttgttttttaagttgatctttgatttttaggtcattgcaaagctcagcccctactaattgtatcttttgtgtgatttttccaatatctagatagtgataatttatactccctcccccttcttttctttgggaatttctaaccttttcagcaaataaaggaggtaaaccaaaaatatatttttctttccaaaagtcttgattaggttctggtagggtatatagttttgacaagaaaatatctttataccatctaaaatctgacattgttttacattttaaatttatcaattgctctctatttttttcatagatatcatgatagttttcggcaaagtaataaattatgttatagattaaagtggctaaggcatcagaaatgttaccggttggattcccattaccatctctatcgggcaatggccttccttgatcatcccttttaactgcgcaaagaatctcctgtctttgagtttcatttaaataattattccaccatccttttaattgaccagaaaacccaatgacaatcatattggcagcttttctttctttgtttccattagctatgcaggcattagcatacataatcatttgatgacataaagtaaagatttgatattcagtaaagccatctaagttccattctacaatttctttgccattgtagtaagtcatattttgaatctgaggaatttcctcaaactgtaggtctgcataagttggttgagggtaataattcctagttgtggaagtaagagtagaaggtttaaaaatcttgttgaccatatcatatttttcattatcagaaatctcattgatatttttatttacttttaaattatttagttttaaggctagctcactgactagttcttcagaaattgtgggtccaaaagccttttattttccaagtttgatgttaggatcaattgttgggacaaacataggactaacagactgagaactagaagactgagaattagagcgaatatttatctttacctcaggtcttcctgttttgtagccttccataaggattgtctctattcgatctgtttgttgaccaagagaacgtagagatatatttgcataattttgttgttctaccaaatatcctatgtgttcaacctttgttgtttctccatatgtatttttagaaatactttttagtggacaagcttttcctccattatgagataattgaatggattcaaatggaggatgaacagagtctaccttgtttccactggttgtctcccattctgtagaaaccttcttgataacagttaaatcttttgcttcggatttttgctcttttttcatcatgttttttcctttgaagaattcttcgaagtgtctgacttggctactttcataccaatcaaagaaaaagatgttcttcctttgttctctcatttctttgtgccaaagttctcttatttttagtctaaatggttcatcgaccctttcaaagtatcttttcatcttgggtcggttcttttgaagcctgagttcttttttaagcaaatctttatcaatttcaaactcatcttcttctatggcaataacaaagccaacatcaagctcgataacattgatatcgaagtctgagattgaaggttcgtcggagttgtcttcataggtagcatagacaacattttgaggttttgtcctaggcctagaatctagactgacagaaggtctagactggagaaaggctttttgttttgaagtaaatgttatctcaacatctccgtctggtgtttcaatcaaggattcgacttctgattgatccatagacttaggttcaacagcttgagataaaacccatttctcaggcagggtgatctcatcccatttcagggttttgggggtagtacatctgttattaggattggtttgaaggagagtggttaggccttttggtgtataatgtttggcacaaggtgctaaagttgtcatggctttgtagtaaactctgtaggtaacggagatgttttcactccctggttctagttcataaccagatgtttgtaagttgagagtgagaactttatggatatttgtgtctgagagggatacagaaaaatcaggaaagatgttaaaataaacaggaccattactgaggctagcttccaccatgccaagtaaggaatctttgaaccttttatttctgcaatctcttagacaaggcagaacagagacgttcaaaccctttctagttaaggatctgatagcaacttgtataagaccaaaatgaaggtagtgatattgatgtttagctcttatagaattgatttctctttctgaaagaagatgcagggtttcatgcaaagaactaattggaatagttttttcaattgttttaatatagtagtcactaagtaacgaaaaagtacctacatgatatatttccttaatattaaccttaggaatcttccagttggaaatacttttctcaatatcctcaaaagatatagatgaagcattctttaccgacatagtgccaacagacttctcgctactgcacgaggctacagatcgatcagtggctcttcgtgatctaaccaaccgagacatcttatacgaaagataggaagataggtaggtagttaccagacaacggcggggaaatctcccacaattatgatcaacctatttggatatgatgtgttccagtcaacggcagggaatatttcccataattaagttcaacctttgcctttgataagtgctcagtcaacgaattacgccgataaacaccttctgcggctcaacaaggcaacgcgacttcaggcaaccgatcaaaggttcgggaactacgcgacttcagaacaccaccacaccgttcgggatcaccgtgacttcagcacgctacccgacccctcttccccccctcctttcggagaagatggcttggggaggttacgagcaattggctctaataccagctctaacccagggcagtgactaggggtctagacaccagatatgaggataggaatgcagtatctatatacaatcttggaatatatatatatgggacagccatatgggacttcatggtgtataggctccaaacctagctgccgttggatctgatccatatctatttgatcgctctaggtgttgggtttaacgggtacacccgtttgtacattaaatatggaatgagttatatatggattaaaaactaccgcatgcaattgccctattattgtgggtagtaacgatatgcatgcatgtttagataaatagctatacttgccatctatgattagtaatttccttacggatgtacgtgtcatgtccaatttttaggcaacaaatatgataggaattaaccatataaaataaagagtgttgtgcagtattttttatatggaatgtgattgacacatggtatatagctggaaattcttggagagtatatggcaagaaattcttggagatttatttttgggtatgtggtaaaatgtatgtattacccatcactttttaattttgaggaacaaatttaaggaaaaaataattatatacccagatttggatttatacacgtattaagtatatacgcatttaaacaccgattaggtatatacacatttaaacatcgattaggtatatatacatttaaatatatacgcatttaaacatcgatttggtatatacccattcaaggcatatacccaacaaaatatgtatatttggtatatacacattaaaaaaattaggtatatttggtatatacacatttttaaataattaggtatatacccaacaaatcacgtgtattatttattcagtgtatgtgataaaaaaaattagggcacatgcaaaaaatcggtgcattatgtatatatttagtgtatgtatctagaaattcatgtgtattatgtatttagtgtagcgtatgtacacaaaaatcacgtgtattatttattcagggcatgtgccaaatattcaaggcatatacataaaaatcatgtgtcttattttatttagtgtatgtgcccaacagtcatgtcatatacccaaaaatcgtattataactagtgtctgtgccaaaaattcaaggtatgtaaagaaatagagagagactagacaacgggaaccgttactacagggtactttaagtgactcctaactgctatccggtacccaggtaccagctggtaccttataccctagtatcgagttggtagctagatatcagaacttggtacctgagtaccaggcgtgataccccaagagagagcaaacaagacgccaccgccgaccatcgtgtacctggatatatcccggcttcgcttgagacggagagacgccgccactggccgctgcggctgctgctcgcacggggcaagaccacggcggcgcgcacagcacgtggcagcgtggcacctgggccacaccttggagaagctcacgtctccgccgcaggaaattttgaggtgtacattaatcatataatacttatgtaaatacccatatacactaaattatcacgcctaaaaatattttttgacatataaatactcccgattccgatacgttcacacgtgcaaattagcaaaaccgattggatatacttatgtaaagaattcaatccggattatgttcatcctgtgcgtcgttgggtgtgtgtcccctttggacttaatcagtgatggttgagtatatgctgtcactaataacttaatcagtaatcacagtagagatttagagaaaacgatcgaatgacacacattgacaaatcaacattttaactgatttaatttctgggtatcctgttgataatgcagccatacaaacatattattcggattggatactgaaataacaaaaatgaggtgctaactaaagtataatacacactgtttcaagatagattacactgtaagtgtaacacgtaaatatcaaacaagtgatgcttagtactccgatggcttacatttcttccatatataccttccaagatgtggcttccggctttactgagttgctccggcctgtatacgcgcttcatatggttgctatgcagtagatatgttctcagcatgtgcagcaaccttcaatggcggcggtgaacttcgcagacgaccggcagcggcgatgacgaacctcacagacgaccgcagcggcgacgatgaacctcacagacgaccgcacgatcctcatggatgatcgatagtggccacgaaagattacagttgaccggcgacggcggccacgactaacctcgcggacgttcagcgacgtaacggcatggcgacgaagctcgcagcgacgacaagcggacaaggacgtatgtaccttgatcgagtgtatgtatctaatcttttcgaacgcatgtatatgtgtctaatctaaattctacaatttgcaataccgtcggaatcggatggtatatatatacacagaaaaaatgaacgtccaaatctgtatacatggaaagaaatcaattcaacggataacgtaattgacgggcataattttgtcataatcacgttcagaatccatatatactttatttggaactctggtggagagatggtttgtagtcccggttggtaacccctttgtagtcccggttttccaaccgggactacgaatccgggactaaaaatcactatctttagttccggtttaaataaccgggactaaaaatccatctttagtcccaccaaccgggactaaagatagcagcgcagtcctggttggtcaccatttttttctttttttttatttttattgtttctttccaaagagttgctccttcccaaatctccccaaatatcccaaaatcaaagtatcatcccaaatcaatgaatcattcacatcacaaattctcaaaaaaatacaactcaaattcttaaagaaatacatcacagatccacacatcaaatacatcacacatcatatacatcacagatccaaacatcacagatccaatgaatcacaagttcttatatccaaatgtatcacaaatttgggaaaaaaaagaaaattgtgcttcgctgccgcctcccccctccggtagaggagagggtgccgccggtcaccagctcccgccaccgccacgctccctgccgggccgcctgcggccacgctccctgccgcccgcggccagccgcccgccgccgcccacggcccgccgcccgccactgccccctcgaccggcgccagccgcccctatctcgccaccccgcgcccgacgcagctggccgccgccctcccgacctgcgtcggccgccgcctcccgcccgacacagccggtcgccgccgcctccatctcgtcgcctcgcgccaggccgccggcggcggcctccatcccgtcgccccgtccggggccgccatggccggcctccatcacgccgccccgccggaggggaagggaggggaggaggagatggggtgagagaagaaggaagagaaggatgggaggagaggaggagagaagaagataagatggagagaatggctggatgggagaggaggagataatgatggaattaataagagacttgcatgcgcgcgcgtggatagaggctttgttttaccggttgtttaacaaccgggactaaaaatcctaactttagtcccggttggtgttaccaaccgggagtaaagaaagttaggatttttagtcccggatggtgttaccaaccgggactagagatcacgggagggcctgacagcccctgacaacatacaaaccaggactaaagatgatctttaccaaccgggactaaagattaaatatgcccactgtagccactaactggaactaaagatgatttttagtcccggtttttagtggaaccgggactattgtggattttggtcgaccgaccaaatatggtttctccaccagtggaaatacatgcatgcaaataaaaaaaatggaatgtacgtatagatctttcttatcgggtaaaacccgctaatttttgtaacactgagtttttggtttgcacaaatcctaaagcagctggatggtggatgattttggagcccatactccatggagcatcaaataatttacctatatatatatataatagatagataatagataatagatatcaaataaaatccaaacgttgcataacaaaatatcttcaaatatttaaaaactcgtcaaaacatatttctacatattcaccaccttccacttagcttctgaaatttgcacctcaggcacttttcacctctaccatcatcagaacggcacatacgcttcagttatttttaccgctacaatcaaacttgcacgtaataataattccaaaaaaaccgaaaaagttcgcacgttttgcccgcaggccgcagctctctgacgaattggctgtctcggcgtgtccccacatataccagccaaaaaaaaaaaaaagaaagaaagaaaaaaaaagaaaattcccctctgccctgaatcctgattctatctctcgagcgggctctcctcctcgtcggcgttcctccgcctccgccgtcttctccgccatctcctctttcgagctcgctccctccccgatccgttccgctccggcgccccctgccgccgctccgttccgccggcgcgcccgtggtcctgtgtgtccccccacatcttctggcgcaaccggcaaccctagccgcggatggcggcgcagccttcttcgtcggcgtcgacgggtaatgcaactcgtctcttctcgtagattgcccctagatggagaagatctttcctctcgttgattggattattagtgtttgggacggtttatgcttgtggccggattagctagctaaccgaggtgacttagtttgggttgtttgattcgttttgttacttgtatatagagatctagccacgaaatatgttgtcacttgaggggtggagcacaccaacaaacaatcccaactcaaaatagcttctccttttacctttaaatgaaaggagtgtggagatgctgtaccattcagtactgattcccgggctctttgattgtctctggctctgtgcaggcgctaccaagtttgatgcatcgcagtatgctttctttgggaacaacgcggtggaagaggttgagctaggtggattggaggatgatgatggtgtcgatgctggttttgttggccctggtgatgaagaatacccttctgcttatggaagggatatgtttgaggtaatatatatgacagttcatttatgtttgatgcgacaaacttccatccattatttattactttccgtttaaaagaactttttcacaggaaatcagtgttttttttatgacacagtgtgtccagtatgtaattttgtgattcccacagcattcatgactttggtagtaaacgcccttttgtgttcagaacatgagagagagagaggtgggaggtgctcctaggggttattttgatcattccgttttacttcttgtttgttttcgttgttgttcaatccaacgggaattaatactttgtatatcatggttcagtaagaggtagcagggtccacccgaacactagagatttatgttgaatgaagagtaaatagtaagcatcggtgttatggtagcttcagaggatgcacatagtccctgagactgtggactcatgatgcggaagccttggaccatgctgtgtcaaccattgaaaggagagagggacatcagttgaggaagggaagagggagagctaagcttagacattgttgtttcttgccattgttattgctggaacttttctttggttctgtcactaccatgatttctgctcgcccttgcaattcattttctagagtcacttcaggttagatagcacctttgttaggcattgactgctgtagcatccagcagagagaagcagccaatcaacagaagggtaaatttgggatggactaggaaagtagcaaatggggtgtgttgagttggggtgtttcgtaactatcccaatctgcactggttaactgtgtttgatcagtatttgttacagtgtttgagaacacgttttgacattttgctttattgggtaaaaactggctagaaactgaatataccaacaatactgaataacatgaacctggccttttggtgtcttgtgtgctgcgacatgtttctgtctccgcaagcccagattgatagtcttcttggctcagttgcccagttgaccaactttccaacaattagcggccacttgttttgaccggccaatactggcagcaaaaccaacataagcacctactattgcttgttcatgttcatcagtaagctgcttgagtgattgtcactgttttattatcctgcatgtggttgtgtgcatgcatggatttatttctcgtctcatttgttaactgtcagctgtcattcttagtttgtaattatgttaaaaaagagttgaggatcagctttacagatcatgtaaagccgtaaacttttgtaaatatggtatttaccagtgtggaaccgaaacaatttgtatctaccaatagcacaataacgatctgtatttttgtaaatataatgtatttaccaaaaaaataataccatatttaccacacagaatttaacgaaaatactgtgttgaaaggtaggggtcgatgttctgtttcatcggtttagtcaggtcgatttcttctgttttcataaaatttggtttctcgataatagccaccgaggaatttctttttacgaatataaaccgagccgaaaaaaccaaataaaatcggttcggtagttacagcgaatggtttttaccgaagaatctcataataaggcgacaggcgcttgcgttgctgtcgagcctctgcgttgacatgctgaggtgcagctgtgggggttccagctctggagagctcctgccctgcgcacagcccccactctgatgggctacggagccagcgcccagtccatgatgctgcccgtgccgctagcctcactctccgcctgctcacgctggctgctcatgttgcctgctgcctgcacgcctgcgccaatgcaccacccgtcttctcctgctcgcagcttgcaccacgcttgtctactaaagaattgagagatgtgagagatttgccgtgagatttgtggctgtggcatgtgactgccttatcagcttatctccaccaatgtgatatggctgggttgtgggatgcatggatgagccttgcatcgactaagctcacattaaacttcaagtgagctcagtttgagccaagctggatcctgagctagagaactggcttcattttttagtagagaataaaatcaaggttcaaaattttatgataggtacgcagcagttcaccccccctagtagctatccaaggatcactgattcagcagaaactgctgttccctacacgatttgcatgtcatacaacatatcggaacctttcccctgccatcacctcatggtaagtacgatcacctgggggagaagaaatagaagcagatttgctatctctgatagcaaggtcgagaatttggggaattggaggaggggtaacagctggaaacttggcatgtaatggtgggggagaggactgggtgaagtaggaagggaacataatagtagaatgcgccttggaacatttggcaactgcagtcacgtggtacggagcacggcttcatgtctccaagtgtcaagttaatataggttactttattgagtgtactctcctttcatttttctttatttcaatataggtttgctgactggccaacagcatgcaggaagcagtgggccttatgtgcgtgtatttaggccttttatgtatacaattttgggaccctcagtagtttacctgttattttattgagtagctgagaatgatcacaaaatcgttttactggtatcctgcgttggtgttacataggtaatgattatatttcataacaggcaattatgcagcaataggcagggagtgttcattcctcgtatatgcctgagtgtggaccaaagggatctaggagttggctctggaaggcatatgttactggtcaagctttctttggcccgtgcccgtaaaaaatgtctagtagacctgttatagaaaactactggattttctgcacactgctactcttgaaaactttgtagagttcaattaattttattttagtggaaataatatttcaccaaaaaagttgccttgcaatctgaggtagcttgtaatttctcttctgcagagttgtttattaacacaagtccacctctcattatactagaggttgttttatctcattatctgtagttctgagcaaatttagctcaggaaatagtgcagttattatctggatcatttccaggttatgttattgtcatagttttcttcacttagtgttggggcctaaataacagattaagctgtgatttagaattatgtgcttctgtttaccttagaagattgcagtatcacgctattacttatttatgttgcaaattaagttatcagcttcagctgctcacactgatcaagctttgcttttgcaggatgaaggtggaggttcatttactggtgttgatgatcttgctggagcattctcaaaggtttgcttttttgaaaagcatagctttgtagccacatagtattaatacacaaatgtccaattattgggatttgatccaacagaaacatggtgtatttttttggtagaaattgcagaatgtagattatagttaaataaagttgcaaactcttgtatacctatttgtatgcttgcattgtggtattcttttttaactgtgaaaactgatttgttgatttctccactcagttgaccagaagcatcaatgaaccaacacaatcgggcataattagtcatgggggttcaatttctagacaaagtgagtaatgccctgttttgctcgattgcaattggaatcctttgctacttctttatgtgtttcttcaattcacgtgcatgggtatttgatttatttcatttttcaaggatatatgtaagattcgattcgttacatctggccaatgggatggacatatccattaatttttcattgttagaatgtgaatttcaatacatttttgcacagtctttgttctcttgttgggtactgcaggattatatatggtttctgttttattaacattgtattctaatgattcaatttgtctaggttctactccggattgggcacaagattcatattggcctacgcagcctatatttggagctgaacaagggctggataatgaaagccggtggtctcaaccaccccatttagcccgctttgctgattctagactgcacagaacatcctcatcgccgcagcaagatgctcaatacaatcctaatgaacatattcttggagcaatgccatatctgttgcatagaacttcatcatacccacaacaagagcctcaatacaatcacacagaaccaattccggtacctaaatcatcattcatttcgtaccctccatctggtgcagtatcccattcttcaccaggtcaaccacatcacatgaacatgccatctcctcccacttcattccaaatgcctgtatctgcacaaaatgagttacaccatccccagtttcctcgtggtggtatgcctccagggccacttggtcggagcatggctcatttggattcagcaggtttatcaactaataatttgcaacagaatgctctaaacagtgggccagttcgtccaaatggtgccatgcttacaccaggtttggtgcagcacaatctgcagcgtccaaatggattggtcccacctcaaatgctgtcacgccatccacaacatggaatggccccaattcaacactctccgccacaattctcacagttccatgctcagatgcttggtcctcggcatcctccaccaaaaggtcgtcagatgtacaatcctcagcattcatcacaaatgatgagtggatttgatgcaaatttggcaatgcctgacttgagtgatccgagagcaagagcaatgctgcaccatggagtgcatggccagcattatctcccccaaggttttgagcttgccggtatgaggatggataatgggtggccgcggttcagatccaagtacatgtccacgcctgaaattgagaacattgcaaggatgcagcaagctgctactcagatcaatgatccgtacattgatgattactatcatcaagcctgtttagctaaaaagtcagcaggaggtcaactcaagcaccacttctgtccgaccttgattagagatccatcatcctgtgcacggagtaaagatgagccacatgcatatctccaggttgatgctcttggaaggttaccattttcttccatccgcaggcctcgtccgctcctcgatgttgaacaaacctctgaatcaagtgatgacgttactgaaaaatctgcttcaaaaacacttgaccaagaaccaatgctggctgctagaatcacaattgaagatggcctctgcctactgcttgatgtagatgatattgatcgcttgctgcaatttagccagcagcaagatggtggcttgcaactgagaaacaggagacaggccctccttgagcagctggcagaatccctgcaactagttgatccacttacacctagtaacaatgcacctctctcaccaaatgatgatctggtgtttctccgaatagtctctcttccgaagggccgcaagctactttctcgttaccttgaacttgtgagttctggcagtgagcttgctagaattgcttgcatggcagtcttccggcatctaagatttatatttggaaatttgccatctgatagtagtgctgttgagacaacgacaaaacttgctactgctgtatcaacctgtgttgttcggttggagttgagtggactaagtgcttgccttgcagctattgtgtgttcttcgctgcaaccccctctgcgaccccttggacatgctgcaggtgatggggcttctttcatcataaagtctgtactggacacagcaacagagcttctcactgatcagcatgtggcctctacctacagcatgcaaaacagagctctatggcaagcatcatttgatgccttctttgggctgcttacagagtactgcatgagtaaattcgatagtgtgattcatgcattgcaaacacaacctgctgtggcagcagttataggcagggaaatgccagttgaattgttgcgtgctagccttccccacacaaatgagtatcagcggaagcagttgctcggttttgctcagcgcacggtgcctgttaacaaccatagttctcatgggtccagtaatggacccatgacatcagaatctatcccaagttcagaaagctggaaaatatgagtgaaagcatagtgtttttgcttctttgggtaatcagtatactagatacaatggctctttaaaatggagactcttccctcattttcccagtaaagaaaagtcaatagtaatatgaatccaggaaacaaagatcgagagggttggagcatcgataaacagtggtaatataaggcaccaagtttactattgttgcgacatgtctggtttattatgttttgtagggatgcaatctgttttgcatgtattatgcagatggatgtgtttttgttactgggaagtttcttcctgagttttgttgctcatgaaacctgcctggtatctatctctggctgtagaaggtgcttgttgaagacgctgtttgattgtgtacttgaagatgctgtttgattgttcttcaagacaagtgtcctggaaccatcaaggtggtatttcaatcaagactcaaagtgtcctggtgccatcaaggtggaatttcaatcaagccgccttctttttctcattttgttgtgttgaagggttgaaatgttactagttgatcatgccctcgtactgaaaaaatcctagctagcattggtatatggtactatgttttgttattattatttattaatttctctttcccgactttttctattctagcggaaggtataatttgggattttagctgagtagagatcgagaatgtagtagtagaaacttgggtggctgtaatgatgtttgcaagtttaaatgcaacaagtcagaagtgatggtagtgttaggcgtggcattttctggcgccaattgttaaacatttcaatttatatagaatgctttatagattcaacttgtttggtgccactcggtttcgtccagttttccctctcaatccatcttatatccgctactatttatgaatgaactactctttgtctcataaaaaataaatctagtacgaaatgtgacatttcctgttactacgaatctgaagaagaggtagctcttatctagattcatagtgttacgatgtactaggatgtgatacatcccgtaataggtacttttttttacgggacggatggagtacctgctttctctcttctcaactatgcttatctatctttgggtacatggctctgatatgcttccatcaatcatttgtttccaccgtcgatttcctagtgagtgcatttaatgatcatacatcttattgtgtgttttggtttaggacaagcaagtttaaagagtgggtgtctatgggtctctaggacaagtagctaggctcacgggatgactcttttgcttggtcatagatcatactccctccgtcccactgtatagcaacgtagaactggatttgacatatcctagtataacgaatttgggcatatccctgttcagattcgttgtactaaaatatatcccctcaaattctagatttgctatattttgagatgggggagtaagagcatcatcaagagatacccaaataaatctgctccctagatgagttttcaagaattcctaaccagaatttatggtcctaaaatatcttccctccaacagattagataaacatattatttataataaaaaaagtaggaccacttgcaaaactaccaatggttactctccctcttgaacaatgacctgaccgatatgaccacatgttggtccctctttctttcctcttctcttcttcctctcattcttctacctctcgcgcagggccgagactagagtacagcgagacaagttagcaccagcggtaggtgacagcaagggtggctagagaagggtgcgaaaggatcccgatggccggcagcacaaatcgaggctcagtggagacacgaattatggtcgtgaatggctagctgtggacgagctctagggtcggccgtggtgcaacttggggcttgatagaggagcgaatcgagcatggcgcggatgagctcgggggccggctgtggtgtgaattgaatcaacagcggatgagcttgtgacggctagtggtggcgcaaattgaagcagtgacgaacaagcttgcgacggcagagatatttcacccatgtgcgcaaattgcttgtgattggcagattgggaagcggtgctcttcactacacgtggagaacgagaatagcggaaaagggattttcaattctttgggatgttgattggagatctattggatctattttttttatacataactacaaaattttgagattgggaatagaattggacatctcttgggcatgctctaactattactcattagtctctcggtgcttagctaacgatggtgtaatgattgtttcatgcatgctatttatgcggagatagaaagtatgtgtttcaatgacagtaggtgacggagtgctcggttgtgcgactcagccaaacaaaaggattggcccagggcattgtttgttggtcgaaccaaacacacggctgattattgaatgaaatggattcatcatcacacttcattagtcaaaagcacatctagaaagagaccgaggaatgtagttatcatccataggccaacacatccggcaacaagttgtatttctttaaagtacaaattttattttggatagtcttttattaccgatgtttcgctttaaaccattttttaaccaatgtttttattctaaattgagtatttgtatctctatggttctttggatcttaactcttttatccatttacatccaacttgttatatcctaaagaaacaatctttcatatagttgtgaaacaatctttcatatagttgtgagagttctttgatgggtaggagccgacgtactcaagatctttcatatgcttgagagagtcaggtggttcaaaataaaacaaagccaagattaaccggtccaaagaaaaaatattagttaaagagtgattcaaaataaaacattggtaataaaatatgatcaaaagtgaaatttactccttttttttcatctcattggttttttaccagccaccgaaactatttatttaacacagttatgatccatattgatcacatttaattgtgtggatccactgaacttatgacattaacatattcttacatgaaaatttgttactccctccatttcatattataagtctattttacttctttttcctaagtcaaacttatttaggtttgattgagtttgtaaacaaattaacatctataatatcaaattagcttcattaaatataacattgtatatattttgataatatttaggagtattatgtttttctatacatttggtcaaacttaaaggaagtttgattaggaaaaaatgacaaagcaagttataatgttaaaaagtttgactaggaaaaaatgacaaagcaaagttataatgttaaaccgaggaagcatgtgattttgaacaaattaattactcccgtcattgtttcctaatttcatgtcaaatagaataattgcatatgaatttagaggagagaaaaaagtaatgagttcttaccttattattcttcattatatttagataattccgcgtatttactagtatttaaaaatcaaaatcatttgctccatggagttttttagggcttgtttgggagcatatatatccccatcaagaatccccgcctaccccacgtgccctttttttttatcattgttggtgggatataagacctctcaactgacctacttccttaataagacagcaaagccaaaaaggccaaagatatgaaggtgggtcaggcatatccacaaacataataatacagggcacaatgtagagtataattaagtaaatgtatgcgttcatttataagtttgattgaatctacaatgctacaattcaatatatgatcaaactcagcaagaaaagaataatccaatgtaggatctgatacccaaaaaaaatcacgcagcataggtttgttagtgtaatttacagaatacagacaaatttccagacaaccttatgctgtttatactattccaagtgtgggcataaaatgtcctaaaatatttcaaatgaaacatgctttagttctttaaatttggggtagtggcaatgacgatcatagatgttgcattacattaaagatgaccttttctccctaggttacccagttacaatctgttctgtgcttgatcaatcagcacttaaatcacaacacttgttaccataagcactaagaatgaagggaacagaaagacctttaaggtgcaatatagtatcgaaatatcttttcagcatgaattaagaaataaatgtgacaaacagtaagatggaatacatgagagatcgtgcatgaaacccagcaggtttccccacactatgtgctgcagagctttgttttactatggcgtcctccctgatggataggaaactaaaggaaagggaaggaaaaggggatttacaaatgccagtcatccatccattggttagcaagccatgttcatttgctgctgttcccgttgcactggtgtaccacaccattgctgggtgtattaccatttgcatagatcccattgctgctgccaacatccttgcgcttcagattggccttctttaaaccccatatacgaattgtgtgatcatcacttgcagatgcaagcatgtgcggattcgcaggattccagctcacacagttgaccgtgccggtgtgaccaggcagagtttcaataagatctccagtagctctatgccatatatagatctgaagtaggaaaattattccagattttgaggttacggaagttgcagaagacaggacaagatatatagatgcagatgataggaaaagatgcgtgacaatctagtggttagaccacgctagacagcacatagctccacactttgtttgccataacaattttgagacttaactagctccatccaaagtaatttgtagcatttcatctttcttcttttccatattaattttgtatatcagataatgggtgccattactggaatactaaatggttctatctggtagactactaattatcagtataaagacagtaaattctgacgaaatatcccaacataataatgcatatttatttggattaaactttaaactcatctgtcacctctattctaaaaataaaatcagcagcagccgttccaagtcattagacttgataaaacagcaatcaatatttatgcattcataacattttggagaaaatgaggtggtcgatgcctagataacaagaaaacacagtgtaaatctgaagaacaggcctaaacattaatacatttgcggtactgtgcaaggttccaaaagtgaactagatgtagtgatgtttttgtatacagtgtaataatccaatgtattgaggatgtttacgtatgctatgactatattttccttacatactgaggaaatctagaatgcagaatgccaatcattagcacaagtaatagaagaacactgtaacaacgaaatttaacaacatccatatcattattttatagtgataggtggccatcaagcaaaatcaccatacctgtgaatcttcactaccactagcaataaaggcctgctcggatccaccaaaacaagaccttatcacaaaccggctgcgcttatgaccagcataccggttaactcgaatggggcaattccttatgttccacaaatgaatcgcctcacttataaggtttacaagcaagaaatcaccatcttctgaaagagaaaatgatgtgattgtattgtcctcctcaatcaatctctcctgttttgtctcccgatcaaataaacgaatggtggactctctattcatgcttattataagcttgccatcgtttgatacggcaaaatcagatgttttagatgatctctggcctttccaacaatctacttctttaccatctaaatcccacaagcaaaagttatgatcagttagaccagacaatatatgctttccatctggaaaccaaccacatgagatcagaccaatgccagacttttcataaacatgaagacatttgccagattcaacatcccaacaccgaatgacttcttccattccacatgtgagaagctggcaatcatcagggctccatgcaaccatcatgactggcttgtcatgaccagtcaatgtgtgctttagcaatagctctccatcttcatcaacctagggaatgatagcatatgctttgcatcaagagaatatcaagaaaagaccctttacatcatgatcaataacaaaaacaaaacatataatgaagttctctgcaacagattatatacaacatactaatttccataagacaaagggaaaatcttgtagaggagattcagtcactaaaataaagcattgttgcaggggagaaactgtgagaccaagaaattaaaattttattttatgccaacctgctgcaaagagatctaatgaggattcgaattgtgaagaagacttgacgaaaaaaattgaagaataagtttcaaaaatttaatgtccttgggcatagatataccagatgactataagctcagctaattaaactgaaaatgacatgcataagaaccaacttagattaggtggaatgtaagacagactactgtgaccagatgagaaaatatgcactttcatggcaatagttacaagctaggaaaaaaggtgttatactacaagttcatagggcaaaattggcaaatatctatattagattccttgctgataaagctagctggagataactctcaagtagactgatgaaatgatcagataaatggcaatattttatcttaattttcagagatcgttttttttttcagaattcacttcagacagaagtaacagcagagacacaaaacctgagggtgtacagaagggattgttctaagaatgtctcggatttaattcaatgaaaggatccaaatcctcccacccaatcaggcctgaatgaacttgtgcaaaatcatgatttgacgaaaggtgcaaaatgggaagttcagggacaacaggctattggactgctaaacaaacagctccatgcaaataagccactatgttcatggatagattcgtaatttttaccttccatatgattgcggatttatcatttgatgctgaggctaaatactttccattgtttgaaaattgaagaaaccatacttcatcacggtgtgcacgcagaacctgcaacaagaattttaatgtgcgattagtaccagtgaattttgagatatggagctgccagcaaagagaagtcttggcgaataacttaacgggaaaaaaaaaagcagttgatcacccaacggtaaaaaaaatgagtatatgacaaagcatggttatagaaaaccacaaagcaaatccaccttgcacattagggcctgtttggtagagctctaactcctaaatttagctccagaagtttggtctggagtggagttgtggagcagcctaaacccagctaaacctctctagttcattttgtgtgagtgctccacccagctccgctcccattttaggtggagctgaaactgtttagctaggctccagctccagaagatgtggagctggagctggagctggagctgtgccaaaaaggccctatgtttacatttctccatgcaaatttcccacaaaaacacaccaaagcccagccacctagccacaacacggattcaacttacacctcatgtttagcgtttagacaggcaaatttcccatagcaaaaagctaggtttccatctaattttatagtaaaggcaatgttttccagaatgagagaagatgagtagcacatatttcttatttgctctatctgatataaaaattttaagccaaatcttttcttgatccaaatctgaattttgcatcaaactatgttactttatctaaatagtaaatatatatatttcaggaatatgcaagaaaaacttggtccatgcctactacaactgcaggctgaactttttaaagttgaagttttcctgcttccatgtaaactgttctgtaacttctgttttactatccaaaaacacagagcacttgagcactcacaatagtgcagtttacttgtttagtaggaggggagggaagggagagaactttgacacttgcatcagtaacaagttagcgctagggcccaagatagcattaaccagttggactacagagaagctcattactatataaagcgtattgcagagccattagaagtgatacacaacatattcatgctataataaatctattgtaggacctttcgtaacaagattcagtaataagctattggactgcttttaacaaaaatctcctctctagtctggtaacaacattatagtaacaacctactgagaattacttcatggtggccaaaggcagtatttgaggaatgttttaaataaaattgcccagtggtggatcaagaaaataatttaagtggttaaacagaacaacagagcagtaggccaagaaatcattcttatgtgggtgtataagcagtcaagacaagtatacaaccttcattcataacactataaactgaaataagcacttatataagttattacctgcaccgtgcaagatggtagctgatccttcccacagtgatgatcagtgtagagtgac

SEQ ID NO: 9151 - DNA, 675 bp, Oryza sativa
ataagatgtcttggttggttagatcacgaatagccactgatcgatctatagcctcgtgcagtagcgagaagtctgttggcactatgtcggtaaagaatgcttcatctatatcttttgaggatattgagaaaagtatttccaattggaagattcctaaggttaatattaaggaaatatatcatgtaggtactttttcgttacttagtgactactatattaaaacaattgaaaaaactattccaattagttctttgcatgaaaccctgcatcttctttctgaaagagaaatcaattctataagagctaaacatcaatatcactaccttcactttggtcttatacaagttgctatcagatccttgactagaaagggtttgaacgtctctgttctggcttgtctaagagattgcagaaataaaaggttcaaagattccttatatctctaattttaatgaagataagattcccactaaagcaaggcccattcagatgaatagtcgactttaagaaatttgcaagcaagaaataaaaaacctgctagataaaagcttaataaggaaacgttcctctcctttgagttgtgcagccctctatgtagaaaatgctgctgaaaaagaacgaggagttcctcggctagttattaattacaaacccctcaataaagttctacaatgg

SEQ ID NO: 9152 - DNA, 742 bp, Oryza sativa
  unsure (1)..(742): unsure at all n locations
gctcggtaccctggtgcttactcgcagcaacgggaatggccccaaccccaacaacaacaacaacaatgcagagaatcccacgcttgctcaagtcctggctcaacaggcacagcttatgaatctgatgatgcagcaactccagaaccagcagaaccagggaaacaaccatgcacctcccccgaataagctggcagaatttcttcgcgtgaggccgcctactttctctagcaccaccaatcctgttgaagctggtgattgcctgcacgccatagagaagaagttggacctgcttcagtgcacagatcaagagaaggtttcttttgcttcacaccagctgcatggccctgcctctgagtggtgggatcacttccgtctcaacaggactactgctgaacctatctcttggcttgagttcaccgctgctttccggaagacgcacataccatcgggagtggtgtctctcaagaagaaggagttcagggcgctcattcagggatctcgctctgtcaccgaatacttgcatgaattcaatcgtctggcccgttgtgctccagaagatgtgcgcactgatgaagagcgtcaggagaagttcttcgaaggtctgaatgatgagctttcttacccattaatgactggggattatcatgatttccagaagttagtggataaggctattcgnnnnnnnnnnnnnnnnnnnnnnnnnnnnnnnnnnnnnnnnnnnnnnnnnnnnnnnnnnnnnnnn

SEQ ID NO: 9153 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnaataaattcgtctcacggtttactatcggattctataattagtttttttattagtgccccaacaccccatgcgataccctatataatatctaatgtgacacgtcaaaactttacacctatagatctaaacacaccctaagctctacttgactccaaatgacatgtcttaatttattctacttcttcctatagttggccccaggatgatatgccgaaatgcaatagcgacagtgattcgaagtcgatcagcttcattcataaaggggcaaaccatgggcaactcaatctcccgtctatatcgtactagtacacatcccggcagaataactgcaaggttttaatttcaagcctaatttattagtgagttctggacactttgagaattttgtatttcatgaacactgacctggtcgtgaattagtgatcataatcgatcgacatatatcgcataaggactttgcagcaacactgaaggtttctttactagcggtcaaatttgttggtccacatttgaggaaaaatatttctcaggaactaaaacaccaagggagatataatgccaatattaattggaagatgtaaggcagtccgacaattagtgtagtttacccatacttgttacgcatatccaaaaaggcaatcagggtgtgtttagttctttgggtacgtgtaagtttttaaagtatatgagcacatatttgaagcctaattaatcgtagactaat

SEQ ID NO: 9154 - DNA, 588 bp, Oryza sativa
  unsure (1)..(588): unsure at all n locations
tatagggcgaattcgagctcggtacccgattttattttggatggggataaaattattgtgtttgttttagcaaaaccaatcaatgaaaaaagtacgaaaatgctcattatcaagcgaccaacacaaggcgaaccgaccactcatttcctcatcctctctctctcttcttcttctctcttcgctctctctctctctcgcgcgcgcgcatccgtatttggcactcgcatctggtggcgccaccgcccttcttcctatccttcctctgcgtcattgccaaatcaccgcatctggcgccgccacccgtcgtagccacttctggcactgccacccgtcgtcctctcctctctccgtgctgctgccccatcgcctggaacttgggagctcgggagctgtggaacacgacgaccgagcttcattgtgatatcccagcccagggcttaataggattaatagaatactcatatcaacaagttgcaacttcttttctggaagccgatctctaaagaactctgaggttaagcatgcttggcctagagnnnnnnnnnnnnnnnnnnnnnnnnnnnnnnnnnnnnnnnnnnnnnnnnnnnn

SEQ ID NO: 9155 - DNA, 16035 bp, Oryza sativa
  unsure (1)..(16035): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnatgcagatatgctgaagatggaatgaatatattggaagagaaataggcaagggccttatcagatggcttttggctttaagattctctatgaggagggtcaaggagattttgttcttttatttaacattgatcgacctttggttgatatatatcctaatttcatgtactccataggcacaacaaaaaaggacatccatatatgcgggattatttctttacttttagtttttactattttttactatgattactggtcactggtcaaacaagggtaaaggcatatatttgcatagtataaacctattagatatactcaacttagtgtatgcaagggtaaaggaatggaacagatctgattatgaataggatatccatttttcttgtctaggaatttgagtgtttaccttttaattaccaagggttaaatgctcccagctggtagctgcagagccactggtgaattgatagtattttggtgattttctcctcacttgcctcacagtgtaactgtctaaattaaaatcttcgaattttggtatgggttgatccaaggacaaatatattctccaaagagatgaactttttttagatacagaaggtattttattctgaagcacaagatgtgctagatccccaacctctgcccaggggcacacgaccaaaatgcattccatgatgttctagaatttcagcacatgttttttttatgttggaattgatctgggattatcctagccattcttacaagctgctaataggcgttccttttccttctttgcaccgaccacaggtttggaggatggaattaggcaatgtgacacacatgactacagtggaacaagttaatcgtgattgcaggtttggatatggcattggtaaggtgatgcacatgacgtaagtggagcaagttaatcacaattgcaggtttggaggacgccattacttaagcatatttttctgtcataataatatttggcatccatatgtttgtacacctataacatcccaaaattatctacctgaatgttctggtttgccacatgcacaccacagtactattgactatttatgaattatctgaaattcacattttacttgtgtatgctgatggttccctctgcccaatctcaattcaaagggttataagtcattttccttataatctactgctaagttcctacagaatatttgcctttatatgtataaaaaaagtctaaattgttgctgtacagatttcacacacatgatttattcaatagtttgaacatggataatgtgctttgttcaatttcctttttaaaaatctaagatttgcccattggattgtatctcagatttttgcatggtcttagagacttcaactacagtctggaataatgtaatggtaaattggtaatgtctacatatttacagattgcgtgaactctctgttctatttttccactgacaagtacataaccatatttagatttgcaatatatgctacatgtaataaaaagtgacaatgaccatatctgaaccatatgaaccttgcattctaaataagtacattgatcgttccctctgctagatcatacttatcagaaatacatgtcttttttaaaaaaataattattggtataatttactactgcatacccaactatgctgttgctccacaaaagaccatgtctgccactgaaccaattactgtatcaagttcatcttgctgtatctgaagatctacctaccatgtttgctgtgctctaaccaaaatgaggctctacggttgttgtgtggcatacaacttttgtatttgatttgaatttagttttacatggcttgaacttgggctcgcatgcgtaagaacttggttgacaacttactgaaaatagaatttggtcttgcattatgtgcaaacctgtgtaatgtaatgtactgtttctattcagaacataaacatgcatattttccttgtgagttattggtaggtaccgagttaataattcctgacagcctttagaattgtattttttttattttggttttgttgctggttgactgccaatgtttataaatttctgtacaaatttcctgggagcaaaaaatagccaaacatatctcatgttgtgtggtccaaaaatcaaaagaaattatgttatgcttttctgccgtgctgatgacaagtactattttttttatacaaaggagatctcaaacctggtatacatgttatgtatggtgtcttaacttgtccttgcaatatgtgtgaaccatagatgtctgaacatttgccagattagtgtttgaacatttcctatattattgtctgagcatttggcacattagtttctggcttgcccttgtggtgtaggagtatctgaattcagaatctgaacttggacaagcatctaaatgatgttcaatgttttaataatgctgtgagctgattaatgttatggattcttgtagctcaagtattataacttcacaaattcaccaaaggatgcagaggttttcctgagtttagtgtctgaccatggtcattgcaatttgtgtaaacaatatactcctattaccattcatggttaggattggatatctgcaagttcatactgaattcatattatataagttcatacttaaccggcttggattgccaggtaagatccatattattgtctgaacgtggatatggaatgcatctgaatttagtgttggacatacccttgccatgtttctgaactcagtgtatgtatgaacatgcccttgcaagaatgtgccttgcacgtgcactattactagtaaactaaaaatatgcagtaggttactcacctgggtaacaaatgacttgagcaatggagcagcacctccaaggctaacattatcatcaaattctgatgccgtagatctttctccatttgaatatgatttccaagggcttctagatgtggaatcatcggatgttgactgtaatgatgatttgtgtgctcttgatgatagagctggggcactacaagtgaaacatatgaacatgagacctattagatctacaaactagtgtaatttttcatcagaaccagccaacgctacttacaaaggtttctttgaaaatcaactttcacaccaggctaaaaaacatcacatatggctgtccaataatatcatctcatcaagtattttaagcatgaatttaaacactatagctgtctaaaactaatgaccttaatggattaattacagaaatatgcattatacgacgataaaatgtatgtgtactcagtctgaagaattatttacctgatcggtaggtatttgaatcttgggacttgggagcacctcataatgtttgaatctgtatttgatttagtcggtaacttttgcacagttccagtatacatgtgattcagttgaaccaagaagccgaaaagaacaacatagcgcttgtaagattgcttctcattctcccacagataaggttcgtacctgtttcaaaataagcaaatgcttcatcatggacaaatatggagcatgggtttttgtctataaagactattgatcatgcattcagctattgaattatgtggtgatatgtataacaaagtaaaacagaggatagtgcttacgtagcccagtctatcggatccaatctctgtgagaacttattgatcagcttgtttataggctctatggtagctgaatctgcctgcaattgtgactgttttctcctgaaggaagtcttagcaatggcgcttggcgaagagtcatgtgttctctgtgtttcagtagttttggtggaagaacttttgcctcctgacagaacatcgccaatgaagcgcaaatcgagcagtatttgcagaacccccttttctgaaaccagagatttaccagactcgattgataccaaaaagctttcatagatatcaataacctgcacgaatttaagtagctgttaggttcagtgattatattggcttttaaatcatacactgaacattttctcctaatcttcatcaatgcaggtagacaaaacagataattgttaataaagcaacacatacaacagctagttcctcggaggttctcaaaattgaaatattgatgacagttggaagggcgaggcattcaggttaataaggtccatgacattatattattagggcacggtattaatttttgtaggcgtgtgcaggtaaactgaagactatagtgcccagcttaatcaatgcttgattataagaaaaacaacaaaagctgaaaagcttgattaacttataactctataattactatcaatcatagtagtaatgaattgtagaacagtcattacattttgccaatagcaactattgcacatataacataaacaaatggttccctcgtagtatctattgttgatcatcattacggtatggtcaaatttatacaaaggcaaaaacacatgaaagtgaactatagctagttgtgtttcatgcagatagcatgataaaacattctttggttcttccattctttgctagaagttccaggccaatgttttagcctataacatgcaccacaattacttctcgtcaccccctcaaagaagaaaaggttgtcatgaaagaacattaccttctgtaacaagtcccatgcaaagttttgcaatatagatttgtccaggatgtgccctccaattttatgaatctccaaacatgcttgataaagaaaggatataatgtacagtgaaggcattgatggaagtgctatttgcatctccaaggggccctcagtggattcctcttgtttgatgactgtgacttcccatccctgacaaggcacatatatcatgtctatgacaatcagcatgccatgtttattttggcattaaaatagcatgataggactagaaatcaacgttgaaacacatagtcagaatttaatatttgaatatagacaaaaatcgaagcacaaaaactagaatcaaaacttggggttagctgcttggtcaaccctagaaaaggtgagccagtaagtatagctctatcgaatatcctataatagataacttcaaaattggcattccaataggcaaaaacaaactctacaggcccacgattttattcaacaagttctttgtaaatcataagggcacttaataaaagagaaatgtcttctagctgctcagtcatgtccaacatgatccaaaattattacagatttcatcattatgttactaatattgctgtatatagcagatgtctttgttacctagcaaacaaaagcatccccgattgatagtatgaataacatggacagaatcagaaacagcagtaagaaatatacttagaatgccttttacccgtaaaggggttggaaagataacaattggaaaagataagagggacatggagcgtacccgtaaaggggttgataaggacaatgaatcatctttgttgaggtcatatgagagaagctgtgataattcagtggacaaccatgctatccacaatccatgggctgcaatgcagagtgcctgtaaggtcttgtttagttcatcaagtctgggattggagctatcatcagcaccaaatagggaagcagcagcagcaatagtttgtcttctggggttgtcagaaaattgccttccaggactccttgggcttgactgtgtgtgcctcctgggggtaaaaggcatcgctgtatcaaacgatgctcttgaatgtcttggtgagggcgacgataatctcataaatgctgcaccaccagcctcctttacccactgccttggggatcctaggatcaagggtacatgactcgagtggtatctcaatgcaaacatgaggcggccaatgaagagagatctctccacgataacagatgctgcaagcatattgctctccccttttttggttctcaaggaagcagacaattttccaagctcagcttccaatccattcagtatcccagagatggtcttatagcatttctcttggaggtatggcaccagctccttcaatctgggagcagaattgtgcgagtccacaaaacttaacagatcctcaaggatagtcttgcatttgctgtcaattgcattcctgatgcgactaacttctggcccaaaatatgaggtaaggcagctgtggaaatcattttcatcagcaatcggtttcaaatgtgccaaaattccacctttcttgatcttagactcagagaaccagacaccacctccagttgaaactttccgcaaatacaccatgaaatcaccggcatcctttggatcagcattggcaccaataccatcaattgatttcttaatatttacactatcatccaagctgccgaattccaagtgcacaatgtctttcatccgttgcacaaaggcttcttccatccaatcctcaaaaatgtccttcccttccttcaagatgaggccacggatctgatcccatggtgattcaatctctgatccaaacacactcttcagccattgctccagagtcccttccagtccttccctcccatctaatgcctcccgcacaagtctttgcactgatccaagcccttccccactctcaatggcatcaactagtctttgccctccagcaatcacaccaaaaatctcatcacagcatcccttcagccaatctgtacaagtccttgcaacagcatctggctcaagtagcaccatggtggcctcaagttgatcccagtgttctttccacaaccgtgtctcttccacagggtctggaatgccaccgaacagctgtgaagggggcggcaaatcgagcaccgtcttgaaaaacagtggcaaatcattgagcgcaagcacaaacaactgcccgacatggcccagcgtgacacgcacgatcttggcgacatcgcacagcacggaggagtaggaggtcagatcggaggcaagggtggttagggcttgggagatccaggcgcggcgggaggagaggaagagttggagtgcctgggtcggggtgagcgacggtgcgtcgattgaggcagcggccgcgagcgcgtcggcgtgggcggcgacggaaaggcggcggtcggcgaggcgctcgcgagcgcgctgcgcgatctggggccggaacgcctccaccagctgcgcctggtgcgcgagcagcgggaaccgcgcggccgccgcggcgtcgcgggagagcacgccgtgcaccacctgcgcccgcacgtaccgccccgcggcctccaggagcaggccctcgtcgagccgccccccagatgtgctcgggggtgtcgacgaggtacttggcgcgcgccgccgacgcgtagagccggacccgcccgccggacggggagggcgatgcggcggggggagcctcggggggcggcgcgagcgacgcgagggagtcggagatgcgggagaggttgccggagacggcgtcggaggactgcttgatgaggagtatcgagtccgcggagtcgaggaggtcgcggtagctgcggccgacgagctggcggagctcctcctccttggcggagatctcgcggcgcgtggcgccctccgccgcgcggatctccgggatgcgtctcgtgcggaacagctcctcggcgtcggccgcgccgccgccggagactgccgcggcaggcatcgccgcctagaccttggagctcgcggcgagatccaggaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaataaaatataaatgtttcgtgttaatgaagtggacaatccatctgaataatctgcgcaaaaaattgtttcaaacatggcccaccaaacaactaaacaagacccgtatatggcaatgttaactaaacaagtccaatagtttgcatggcaatgtttgccgcatagtatgattgcaagtctgtaaccttgcattgaacgaatattactcctggtcagacaaaataaagatcaattgccgttatatcgtctattgtctatacagtagttctttttttttttagaaaagtttatatgctgtgtttgatacaggagttcccaactcctccctttcgttttccgcacgcacgcttttcaaattagtaaacggtgtgttttttttcaaaaatattatatacgaaagttgcttaaaaaaatcatatatatacaattttttttaaaaaagctaatatttaaataattaggcactaatagatcgctccgttttccgtgtgtgtgatgggttcccaacacccaccaccgaacacacccatatagcagttggtatgcataggataggaaatgcttggtaggtcaaatatcattggtcctttaggctgagttctttccttgaggttcctaactcacctcattctttttcacgcatacatatcccaaagcagtatagaatctgtctactcccttcgtctcgaaaaaaacgaatctagtactggatatgacatattctagtacaacgaatctggacagaggtatgtctagattcattgtattaggatatgtcacatccagtattaggttggtttttcatggacaaagggagtacatgatttttaattaaataagacaatagtacgatgaatcatgaaatcaagcaaatcaaatcatagtataataaaatgctaaaaagggaatgtctgagcttgtaaaatagagataaacaagtgactatggggtaggcatgaaaacggatcggaaacggacggaaactagctttatcatattcgttttcatattttttttcggaatcagaatcggaatcgaaaactcggatacggaaatgaaatcgaatattatcgaatatagatacggagcgaatatgagacggaacgaatacggtaacgaatatttaccggtatataaaaaacccctcaaattgagtttcttgatcaaggaagagatatctcttattattttagttcaacatctccaacatttatatcgtcaattttgtagacggtctcacacccgtatgtgaaaatcgattttcatggctattcctctaagagatccatatgcaaatatgattatcattttctattccccaagaccttttactagatatataacttatttaccctttataaattggagatgttatttattttacttcacatcttcgaaacttgtaatatttgttttatactttaaatgctttcaaatacaaatgttataaactacaaagtagtagatcccgttgagctctataactttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaatgttgatataaagtttgtcttcatctgatttcgtatgaaaaagttatttatatatatatatatacacttattttttctaaaatttgctcaatgtgtgcggatatccgaaaaaaaatacggatagtttccgaccgttttccgattccgacggatagtacccttaccgtattcgttttcgtttccgagaaaaaaaatccgaattcgtttccgaatccgagaatttccggatagttccgaccgaaactgtccgaatccgaaaaaaggtccgggcggacggaaactatccgaaccagtttcaaccctactatggggtgcttagatccagggtataaagttttggcatgtcacattagatatacggatacacatttgaagtatcaaacgttgtctaataacaaaacaaattatagaatccgcatgtaaactatgagacgaatttattaagcctaattaatccgtcattagcgaatgtttgctgtagcaccatatttgtcaaatcatggagcaattaagcttagaagatttgtctcgcaaattagtcgtaatatgtgcaattagttattttttagcctatatttaatacttcatgcaggtgttcaaacgttccatatgacagggtgaaaaaatttggggtgggatttaaaccagtgttgtggaagacggtatacggatatcggacggagagggtaccgccaaacgattaatcggaatttggcggaaatataacgttttgaaaatatatgtacatagttgataatagttttccctttttgataaacaaatgcatataactaaatatattccttctatatatccttaaatagaataaccatgtatgacatttaaataagttcataatggatagctgttactgtatatctcaattctcacgtagtaatgggttttgttcataatgcttgaaatgataatcaagagaatgttacatagcatagatgaccgtaatcaaggtcccaaataacatatgtatcggttacctcgaagagcttcatcaaatacaaactccaataacgtgattatcatcaaaatcaaggaacccatgttcaaactttagaggaagtcagttccttgtcattttacatcttgttgccttgtgaaaatttcggaagagcttgtagtcagtagtagtaaagggcacagctaacaaccatcatcacgccgacgattatacggttgattagacggagatggacgatttaatcggtaatgatcggatttatgcgttcgttaccgactaattatgaccgcatcgacgtgatgtgacggtctgatctccgtattcgtattatcggacgtattaacggccattaacaccgttttccacaacactgatttaaacaaggcctatgggggtgtttagatcccatcctaaaattttacacctcatcacattgaacgtttgaacacctgtatgaagtattaaatataggataaaaaataactaattgcacggtttgtgactaatttgcgagacaaattttttaagcctaattgtttcatgatttgacaatgtggtgctacaataaacatttgctaatgacggattaattaggcttaataaattcgtcttctggtttactgatggattatgtaattagtttttttattagactacgtttaatatttcaaatgtgtgtccatatatctgatgtgacacggcaaaaaattttaccctagatctaaacacaccctatcttaacttttctgcgggaattgacaactagtactagtaaaacccatatttcccctttcagatcaaatacaagcagcctcaacactttgaccactcaacagctctactagctgagatataggcacacaagttcaatcataaataaagtacgtatgtccgcatgttgcaagctacaccctccagataattgttttacacaatggccgtgtttagttagggtgtgtttggtttgggaccaagtgggatgggctagacccatcccagttttttgggatgggatggttccaattgtgtgtttggtttgtggtatgggatggttatagttttttgtttggtagaagggattgaggtgggatgggatggacaatttttcacggacgttagggccgtctgctcccagcggttagcttccaggctgctggtgagattggggacgaaggagctcgtcggcgcaagttaaggagctcgttggcgcgaacgaaggaaagtcggtagtcggttcgcgaacgatcggcgacggtcgcgaaggtgcggacgggcgtgtacgagcgacgtcggtcgcgaaaacgaggcgaacgcggacgagcggcgccggttggttccgaagccgcaggtcggacacgcaccagtcgacgagacgaggcgtgggcgagcgaagcccggtctcggaggcgaggcgaggcgcggacgagcggcggccggtcccgtaggcgaggcgaggtgcaaaggagcggcggcgtccggtcgcgaaggcggaggtcggacacgaacgagtcgtcggcggtcgcggatgagcggcggcagtcgcgcggaggaggacggacggcgctggggaagggagcagtcggatgagggacgagcggccgtggcggcgccgcggcagagccgagcgggaggctgcgggagttgacgccgttctgtccgtcgaagtgggatggattggtccggccgatttcggcggaccatctcgtcacggatctaagaggaatattcctctccagggaccatcccatcccactcacctctcaacaaaacacctctaaaagtgggttcatcccatcccatcccatccttgcaaccaaacacttacttacttttaaactttcaaaaattccgtcacatcaaatatttggacacatgcacagagcattaaatgtggacgaaaaaaaaaacaattgcacagtttacatgtaaattgcgagacgaatcttttgagcctaattatgccatgatttgacaatgtggtgctacagtaaacatttgctaatgacggattaattagacttaatagattcgtctcgcattttataggcggatgattatgtaatttgttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaaatccagacggactttttctatcataaacgcaaaaccccaatatcatgtaccataaaatgccgcttatggcaagaacacgctgaacacaatttcttggctgcgtatcttctgccactaaaatgttgagccaagcttgcaattcactcaatcaacgagcatttgttttgaaagtactgttcactaccaacttgacagaattccaccacaataaaagaaaactaagctgtggaattatctaatagtaccataatagttttgctgtcattttaaaggatgggttgcgcacaaacacagattcagctcaacacaattcacaaacttatttctattgaattgccatgatttgtttaattaactgatatataactttgacaacaatgtacaaaacaactgatatcaatagtcttccatgcatcacactgtcatcaaggcgacaaggcatgcctcctgaatttagctctagaccctaccgaaacaagaaaggtacaaaaacaataattccctagatcttaaaaatggcaagcattgcattcatacatatggtcacatgtaaaaacacaaggtgatgaattgccagtgtagagaagttacctgtaatattcctcagatacctgcaaatctcactggtgcataaggtgaccatgcaaacggagttctgcggctggacatcaagcttggttaatccttgcagcgtcctcttcctcacatcaatagcaaacaccaaatgcaacttgtccatgggactgggactggttctagaaagcaagaaaacaacatcatcatccatgcttatggtggggtttaccattggaagttccttgaacatttccacgatctcgctgaagctcaagttagaacgacatgggttgctggcacccaaggtgatgtctttaacaccaacctcacagtcacggtgccagtgctcgcacgaagaaccaatcaccggcattggcatgctccatgttgtggccttccagtcgtcacggattacctgggatttccttgtgttattgagcacgcaatccacataagaaacaggagtgctggtggtattcatcggctcttttggtgaccacatttccatctcaatatacttgatagagtctctgtttcggctgatggtcacatcccggaaatagctggggtcatattgtatcaggaagagatccctgttgctcctcgctgggcacggcagagggatgtcccggagcgcagggaactcatcgagcacgtcgcagaggaagatgccacgccagaggtccacccaggcgacggtgccaccctcgccgccgaccgtgatggtcttccctgtctcgtggtacagcctgtcgacagaggcaggtatagggataaacttgtctctgatgaactcggtcaccgataaccgcttggaggtccaacctttggaactggaggtggatctgtagaggtggaggtagaaatcccagctaacgggcgcaccgcctttgtacaccggggggccaagacccagggcggcgactgcataccaggcgccgtcttggcggctgaggagggcagtcatagagtcgtggaggtacacggggtgcgggttcgggagcagatctagccgatgggcgcgcggcctgtagacaaagtagtccaaacctcgtgcgttggcgatgctgtcggggttgacggggacgcagaggaggacgagatcggcgtcggaggcgatgatcttaggcaccacgcggcggaagtcgaggccggggcagtggacgcagaagcgggagagaagcggcgggcgggcggggtggaaggtcgcctggatgcgcaagccggtgctcgtggtgcccacgccggtgctggcgttgggcaggtcagcgatgaggcaccacctgtcgaggaggaccatgccccctgatgagccgtcttcatggccgtcggactctggaaggggaggagccgtggtcctgtagggaacagtcggggcagccatgtccatggacaagcgaaggataacagatccaatcgcagggaggaaccgaatgtgggacggggtttttg

SEQ ID NO: 9156 - DNA, 24459 bp, Oryza sativa
  unsure (1)..(24459): unsure at all n locations
atttctatgcaaactatgcaattagtttttttatctatatttaatgctccatgcatatgtccaaagatttgatgtgaccttttaggaaaaaattagcaactaaacaaggacataggagaactaaattattgtgcaacccctcctctaccaagttagtctaagagagattgcataattctaccagaattggagacacaaagatgtagaggtaagactcttcttatttattcattaacttgtgcaatacaatagcacctcctcccctcaatatataggcatagccatgagtgcttttcatatttagtgacggacctaattagtgggtaaccgggctggaccttcatgggccggtggtttccttaaacaaatcaatcagatccaatttaacttttggggacaagagtctagggttcacgaaggacatttttctccacgtcactcgtgtgcggttaccatcaacagcacgtacaacaaagacgctactacatgtggtctcgagtcttcacatgggctaaaaccacaacattgttatagctcacacaataggaataagtttactttgagtgcctaactagtagccgaatcttattcatctcgtttaaccacgatataagatatgttgactttccaactattaaaacatgtacaatttttctcccggtggttctgaacgtggcgactacgtggaggtgtttgacatgatcttcatcctacgtgatacttatgagcgcagtttgagatctaatcaaccaagcgatgccggccttgtcaagtgggaataaattatgaaatggccatgtgtcttatttactttttttattaccatggattatttgctttatacttctaaaaatatgttttattaaaaatattttatcttgtttagaccacttattctaaaccatttgtgagtttcatttctaaataaaatataaatttatcatgttaatgaagtggacaatccatctcaataatctgcgcaaaaaaaatgtttcaaacatggcctaccaaacaactaaacaagacccgtatatggcaatgttaactaaacaagtccaatagtttgcatggcaatgtttgccgcatagtatgattgcaagtctgtaaccttccagtgattgaatattactcccggtcagagaaaataaagatcaattgccgttatatcgtctattttctatacaagggttctttttttttttgagaaaagtttatatagtagttggtatgcataggatagaaaatgcttggtaggtcaagttcattggtcctataggctgagttctttgcttgaggttcccaacccacctcattttttttcatacgtatgcatcccacactactaaatgatactttttttaaaaaaaaaatcctacaagaaagttgttttaaaaaaatatatattaatattttttaaaaatagataatatttaattaatcatacgctaatgagtcgttccgttcttgcgtgcgcgagagattagttcctaacttcaacatcaggtatgcctataaaacaaaaggctacgatagttttataatgttcgggggtggaaacaaatttaatatgatcttttgccatgccattgttttttttaccatttgttataattaccggaaacaagctaataagtcaaaagcaacttccattaaaaatgattaattttaaatttataggaaatcaaggttattagaggaaaaaaattaaacccccacatgagcaccgaatttacaccgtgtcccctcaccctattattcatcaatagcactatacaacccgtccacgtgatttttaattaaataagacaatagtacggtgaatcatgaaatcaagcaaattaaatcattgtataataaaatgctaaaaagagaatgtctgagctcgtaaaatagagataaacaagtggctatcttaacttttctacgggaattgacaactgctagtaaaacccatatttccccctttcagatcaaatacaagcagcctcaaccaccctcggctcacctttctggattaagaaacatatgccttatttagttcccataaactttttgtaaaaacatcacatcgaatatttaacacatatataaagcattaaatataaataaaaagaaaaattaattgctcaatttgtatgtaaatcacgagacgaatcttttgagtctaattagtccaggattagccataattgctacaataacccgtatgtgctaatgatggtttaattaggctcgaaagattcatcctgcgtttccagacgaattatgaaattagttttttcattcgtatctgaaacccctaccaacatccggtcaaacgtatgatgtgacatttaaaaatttttatttcatccactaaacagtcccatagccgtcttgacatcccattggttaactcggacacgcaaagccaacttcgaactcttcaactaaaacgtgcgtcgcatcccccggccccacacgttagccaccccaaacagcccatcgccacgccaccgaaccccaccccaccccacccgccgtgccacgccatctctctctctccccccttcccagaaccaaccaaccacgcgcgcacgccccgcgtttcgtcgcgtcggctcggactcgaaccgaaccgacgcggcgagacccaacccgacccaacccaaaccccccgaataaaagatccctcgccccgcggcctcccgtccctcgtctcgcctccccacacgcgagcccaacacgcaaacggagctgcctcctccacacccccttatcctctcctccgggcgagcaatcctcgacgaacgatggcgtcgctcaccaccaccaccgccgccgcgtcctccccggccgcgctgccggcggcctcgaccaccgccccggcgtcgtccgtgtcgccggccgccgcggccgccaagcggcctcacctcgccggggacgacgcgccgtggcgggccgcggcgaccggcgccgcggggatccgccccgtcccgcgcatccaccacgcccccgtcctccgcgtcgcgcaggacgattattccgcctacgccctcgccgtcatgaaggtgcgttcccttttctcggttcggtttggttggtgggggaagggggtaattctaattctgggcttgctctgcagcatccggatccgataggggaggggttggccatggaggctatggtgaaggcggccgggccggagtgcatcgtgcccgggcagcaggcgccgctgcggctgctgggcctcaaggtacgaaccgatctctcgatcgcagtgtatttttgcaatccaatcgttacgcacatgtgatcgatatagcccttagttaaattgaacgttattagatgttacttgtgaggggatgtatgcctgattttgggttaatcatgtatcttggttggatagttttgttatggttggtaattcggtgcttggtgcctgaggctcgctcaattatgctttatggttggtaattcggtgcgcggtgcctgtgattggtttgagcttttcttgatcattaaatattcattgggctatgcttgttaattgccaggtttagtgggttggttttgtcaatttcgtagtcatacaaattacagaaaacaaaattttatccatgggattagggatagtcgattaaacagttacgcaattgcgcagcaatgatttgtattatatttttcgtgttgtccaatagtgtttcagctttatcttttgtcaaaaaataggaaatacaagggatactaggttaaggttgagcctttgaggctactctgatgctgtggtactattcatttcgtgctctcgtggtattcattatgaaagtttgccattgctaggcataatatagctcaaaactttttcctttgtttaagtagaatatcatgaattgcttaaaagcttgagaataaattatgtaccttgcacattatggtgtttgagtacttcaataaatcatgtcttttcaatctctgtatttacttgcagtaattgatttctgtgcatgtatgcgttgcggtctttgcatgctcactatttggacacagcaccactagattgaattactacaatagtaaatgatatcacaaattgtcaactgaagtgaatgaaaaccccagccaattaacatggctagtatgaaatattgtgaactgtgaaacacccaaatttttcagtcttaaatttatcctttttgtcatttctatgtaggtttggccccttgatatagagatgaagttcctggagccatttggacgggaactacattccatgaaaaaggtaatgcaagcttgaggctttccatctgttgttctgttgcagctgcacgattggtttgaagtataaagtacttgaaaccaactcaagccttgtgtgctagtaatacttaatcagtctttagccatccttaagacctgtttggaaattacaatgtcccggagaaagataggcgttgtgtttgctatcctatccgtaggacttcctgtagacactcttaaagtcatccaagcctgttgccttttttcactttcaacattagtgctgctgggtaacatgcacttgcttccaatgacctgtatattgtgaccagaagagtccacccatgtatgccctgggattcctaacatttcaatggcaggttgaaggcaatagacccaaataaagtcatgatagaacgttcttcatgctttctagtgatcatggttaataacaccacatatatgttcacttctttctttctttctttctttcagtagtggtctgttgtcatttcctacaaactaaatggtggtctcctgaaccataattgccagagcagatacataacatttttgtacaactatctgctagtcgaaatgcaaatgtaaaatatggttttgtctcctaagatctgtttaggactacattggcattagtttataattaccttctactgctccattagaatgataacttatcacgcctagtttgtttagaacagacatgatttttatggtgtagttactatatcgtacattccttgtgcagttcatggacaagtcatgcagcgttatggactcatctatgtcaaataagtaggcgcatggctgattagttccctccattactagccaatgctgtatccacggctcttgctgaagttacaggaccagaaaggtacaaaacttgaagagcccatggagagaaaccacattcttgcttatcttgagtcgcatcacttgatggaacaagatatagcgccgagaacacagtaacgattagctagtactactatgtatggatccagggctgcctccaccgagttagtctacgtgttatgcgtttattgtattcatgtaacggttgtgacttgagaatataatgctgagttgcaaggaaaacgaagaaaaaaaatcatacaaaataccattctttttgtttctgtattgggttattctcggctgcaggccacatgcgaatatctgatggtgaattctcatcaaaatttcttgtgcgcgccccaggccctcatttatactactatttgttaacccgtaaagtactgtatttgtataacctgtgtttcggggtactcacgtatggtgaagcgtgctgttcattgcctggtccggattggcgattactgttgtcaccgtgaggattctattgatagagcgcgctcctccgattggagctctatcatccgtatgcgagatttcggatcgcgacatctgcaagatgccaagccgccaagcgtggattctcgattgcttaacgaaacagtggagtctccatcaaggactcatgggcacgccgcacgcctggtcgcccacaccacacaacggtgtcaatgagagaggctcctctcttcctggagcgcacggcaaaaccgctcgcccgtcccggtgcctgaagccgccaccacgcgcgacgagacacttcacgcacggcgattcggccttgcattgcaacacggagagggcgtgtgtacaggagggagggaggagggcttcagtcagtagtccccgctcgtccaaactcaagcaagagcaagagcagtgagctagctcgggcgcgcgcatgcatgtcattcgcatagcgtggtaatggccggcgtgccactggccactattgcagtcctggacgatttgtctatgcggatatatggtccatcccttgcaagaaacggtggcttctgcgcacgccggcgtcaatgcggcatggtcccatactccacaggaccatagccgcaatggccacaaggccgcaatcttgcgtcctcgtcgtggatggaagcgctcgaaacgtccgagtctgttttactgttctaccccgtatgggggggggggggggggtctgccgcatatgcatgtggcggctctagccacttgcagagttgcagcgcaggaaggggcagggcagtcagtgggtggggccaccgatggagcgtggaaactgcgtgcgcgtcgtagcgtaagctactcctacccaagcagagcaccccggctgaatcgcatattcgaatcagctcgtgggagggattcggatcaggtgcagtaacagtagtgactgtaactttggtaatacccaatcatccagccatccagcacacaagggatggcccagatttaactgtgtcatgcatcattttagctatttgaataagcatagaacagcttcagttcagattttgcctgaaatttctctccttttgatctgaattttcttgaacgttaagaaaacccaaatattgttaaagaaaactagacacatacttcatttcattatattgaacttcataatatcttgcacgcataattgacaaaatgagctagagtttaagcccttgtttagttcccaaaatattttttccaaaaacatcacatcgaatctttgtaaacatgtatggagcattaaatatagataaataaaaaaactaattgcacaatttgcatagaaaatgtgagacgaatcttttgagcctaattagtactccctccggtttcattttaatgacacggtatacaaaatatatctttgaccttatttttctattataacatataaaataaataaatgcatatttacttttattatagtgctttgaaagacaaatatatatatacgttgtcctttaaactaaatatttttaaaattattgatggtcaaagttataaaagtttggcctcggccttatctaaaacgtaaaataatatggaaccggatggagtacatgatagctataaagtgctacagtaacccatatgtgctaatcacggattaattaggcttaataaatccgtctcgcggtttccaggtgagttataaaattagttttttcattcgtgtccgaaaactccttccgacatctggtcaaacgtccgatatgacacccaaaaattttcttttcgcgaactaaacacaccctaactattttcgctgaaattgggtatcatgcatccactggcacaaaagctttcaaaatcaactagctatgctactgctagattaaccccgttacaaaagctttcatgatacaaaagtagatcatcatctgcttccaaaatcagcacgatgccttctaagttctattgacctcttcaaatgaacttttaagataagatgatatcttcaacattaatagaaccctagggaaaaaagataatatccaaattaatttcatgtgatgtgcagcagtaggaggtaaagtatgcttcccatggtagaattggcgccaattcttacctccctctcagatttttccctccaaaacacatctgctggaatcagagagtaggtgaaaagctgggggaaattaagcaacgaatctagaccatcccttatgtactcgatggttggatgatggatactgttaaagttgcagtcactactgatttgaatcctcgtgagagatgatgtgattacattacagacgcaaaatccagatttcttaatcgcgaatcatcaaaccgaaaccaactccaaaactctaatttcggccaaagagattccgcagaacagttcgagttgaccaatattatatagtttatttccccccttttttgttattactattccaactcgattatccaaacaaagtccatgttggatggatccagatcgccacaacactcccttgtcagttgtctgatcgactgatcgtctcatccctccctaacccgtctacttggccgataacccgtctcaccgccaaatcgccaatctcccacctcgtcacgcatgcgtgttcaaacgtgaactaatcaactctccgcgactccgcctccggccgtcccgtccccgtctccgggattttaatttcttggcacctcgcctcagcatattccatgtcccctctccatccgccccacgcgcccactttgaccgacccatcgatcgatcacgatatttagtagtagtagtagtattacaaatccagcaagcgatcccaatatcccattcccaaaaccccaatccatcctcggagcacgccaccttcacgaggaagagagaatcgaggaagcagagcgctcggaccagaggaggaggaggaggtgccagccatggtggaccggatcggcgccgcgtggtggtgcgcgtgcgccgtggggatgctggtggtgggggcgtgcctcgccggggagaccagcgagtaccggcgccagctcggctccgccgtcgacatgccgctcgacgccgacgtcttccgcgccccgcccggccgcaatgcgccccagcaggtaacccgctgcactctgcactgcatgttcttttctgcatcgcggaaggaaggcatcgatactcgatagactcctccgagggtatcgggtttcgaagccctcgatttgttttcagcatctgtgcagcttcggaggaatcaaatgttcctcttgttccttttgtgatcgatgcttgagatagtagcgtcctgcatctgttcgtgattcgtcactcgtgagccgcacttcgattactgtagattgtataatatactagtactagtactacggagtattttgctgttcgttttgtactcgcgctggtcctgctgagtgctgagtggtggtcatccatttgcatatgcttgtctcatggtgtctccatgctgatgaaacaagcaaggaattttcggtttcgatggtcccgaagttgactgcttgtctctcttcagaaattgtctcctctttaatcacactgtttgtgtttaattcgatcgtttcaatcggataaactgttgtgtttctggttggtagacctgaatttagcgtggcataaatgtttctagctacttgtgttacagggtttctgtcattagtctatcgatgagcatttggcttattcagagtcgtcacctggggtgctttttgcacttagcttaatcccagtccacaaacttggtgtgttcatgaattaaaatactgcttccgtaccaccgcttgctctgcttcactcatttctaaagttaacaccaacttttagggaagtgttccaacttctatcatacactatctgcttgaccatttactagtactaattggttgcagggcccttttacgaacccttttgttgtcttttggaactttcttattcttagggcacccgcaatggttatctataggctctctacaagagatccatgtcagcatatttttctacttggaagaattaaatgtagagagagagcaaagctatctactaacctgaagatagtctatagagaaaaacgaggcaatggattagagagctatagatacccatgtagacataccattaaagtggtttactattaatctagtctattgctgagatgtacatgttttatagatagcaccttactttaccattgcgggtgctcttatagagtcttactcccttgaattaagtattaggatgccttttactgagattgatgtccattcctttttcaatatgccgttagcataaaaaattatatgcaagatgtgctggggtatggtcattggtgtattctccactctgatgcttattgatattgttctctgaaaggttcatatcacacaaggaaatcatgatggcactgccatgataatctcatgggtgacaacaattgagccaggctcaagcactgtgctctatgggacttcggaggataatcttaatttctctgcagatggaaaacacactcagtatacgttctacaactacacctcaggatacattcatcactgtacaataaaaaagttggaggtattagttctttgcaaaagtcgtctttagtgtttggactgtaaattaaagattgactattggctttgttgcagtttgacacaaaatactactatgctgttgggattggacaaaccgtgaggaagttttggttcagaacccctccaaaaagtggcccagatgttccatatacatttggtctcataggtagtattcaatattcctaaattcatttttgctatgtcaggatacacattcaccaaatctataaacgatctatatcactgaaaacaacatctgtattcaggtgatcttggtcagagctacgactcgaatattacgctggcccattatgagtccaattcaaaggcgcaagcagtacttttcgttggggatctgtgttatgcagataactacccataccatgacaatgtgaggtgggatacatgggcaagatttgtagagaggaatgttgcctaccagccttggatctggacagctggaaatcatgagatagattttgccccagaacttgtaagtgtagtactccatttaactttatttgtgtaatgatcttcagtggatgcatatacagttcagtactagataatcagtggagcttatgttataagcatttacattctgttgaacatttgcagggtgaaacgaagccattcaagccatacagctataggtaccccacaccttataaggcttccggtagcacggcacctttctggtattctgtcaaaagagcatctgcttatattattgtcttggcatcatattcatcatatggtatgtaatatgatctagttgcgttttcttttgcatctgtattcaaagtacttagtaacaagcttcacaagtaaaattaaacacccacatgagcaacattgtgaataagtagtcagtcttacatgctttgggcaaacagaaacacacactgtacataacaatgaacttattaacttatactccatttgttgattgctaatagatggaataagataatttatcagttcttctgtttctttcccaggaaagtatactcctcagtacaagtggcttgaagctgagtttcccaaggttaacaggagtgaaacgccatggttgatagtgctattgcatgctccgtggtacaacagctataactatcactacatggaaggtgaaagcatgagagttatgtatgagccgtggttcgtcaagtacaaagttgacctcgtgtttgcaggacatgttcatgcctatgaacggacagtaagcacttacagttttttttcccctgaaaaatagttaaaactttgcatggggaatcaaatggaaatttcttgcaacttcattaggaactttagcacgcacttctttgtcgtctttatatttattagtatatacttgcatctagtaaaattaagttcaacgtgcttgtcgttttctttaaacaaaggagtgcttggttttactacttttttttaaactggtacggagcatgtatagctttactactgatactctgcttagagtagtactagtaccttaatcttgagctgctgacatagacttattttctctgattgcagcacaggatatcaaatgtcgcgtacaacattgtgaatggccagtgcactccagtccatgatcagtctgctccagtctacataaccatcggagatggaggaaaccaggaaggactggccaccaagtaagaatccttttttcgcttccaccaaccgttttcagttcctgaacgctgacaagatatcatgtgcaattgctgggaaaaaaaaacaaatataatgcagcatgacggcgccgcagcctggctactcggccttcagggagtcgagcttcgggcacgccatcctggacatcaagaacaggacgcacgcgtactacacgtggcaccgcaaccaggacggcaacgctgtggcggctgactccatgtggttcaccaacagatactggcagccgacggatgaatctttggacgactcccagtgatctgagtcgttcgtacatggtttactcacacctgctcctcctccctagtttgtgttgtggttcttctacgtgaataagcactggctcgatttgaacacacaggacggactcacggacgcctccggttcaggcgtcgtgatctaggtggttctttctccgctccagctccctcgtggccgtgtgctgcttgtgtatagaagaagcgcagctcacgtgcagcgagaggaaaagaaagctgagaaattgcgagttgatacttgataggcttgtgtacgttcgtactcgtctagatgttgaataaacacattggtttcgtggcgttgcgacttgcatttgacaatccgagtgggagtaacatgggcttctggcaagctgtggcttgtgccaaatcctaggaatccgttattatcagtcttttcgaatacttcaaatgtcgacaacaaactgataataacatcaattcagacttatcagtaaatcccctgaataatactactctaaatatgactgtatctagttctaaatcccctaaattgtaaatataacgatgcaaacattcagtagtaggtggcgtctatcccagccctatctagattggtttttttttttaaggacggagggagtacggagaagcactgggtcgacagcagctcactaatgttgagagattaaatacaccttaataagattagtaagcaaaggctctggtaactgccgtttgggccagagattagatagcctcaagttaagcaacgcagcagtccacagcaccaaaatgaacatttgtacatacatataaattgtcaagacaagcacaagtcgtcagattcccttgccaagacataaacatagcaattcaaaatggcagaaccaagcatatgacttcttgtacaggttaagtagcaaattttcaacgaaacagaactaagccctaacacatgtacttgaacttctgtccattgtagtatccgtatttgtggcgagtccgggtttcattacggggcagatcgtccggatgacaccaaaatggcttgggcacgggccagctgttataaaaaaaatgtatagggtacaataatgctatcaacaaacaaatcaacaaccaaatgcaaaacattgtaatttaactgcgatatgaggtgcaccagaatacctatttggccgaacactacgatctccagtcatagtccaatcaagcacaccagatgaagtgtcaccattgccaactttattgatagtcctgccaagcacaccaatggatagttttaacacatttgtgcttcggactgaagtaccgaaccagattcatcaagacgagcgcacaaacacatgcacatacgaacacaaattctaggagtacctttcttcatcaaaacgtgacagaacgtggaggataacggtgcatgataggaatggggttcctactatgtcatcaaagaagttgataccaacatatctcccatcaaaatcaataagaggccctccaatcccagcctaaccaggttacatggacaagttaatcatagtaccaacaaatgagactacatgcaactatttacttccaccatgtaaaagtaggcaacaaaaagtctcctcccataccttggtgattttaaaattggcgtaccgaagcattctgcaatcaagtgtgcctgaccagccaaccaaatgaccacttgcagccattaatatgtctgattcgaagcagcgccccacagctaatacatcctcacatacactttcctgctcatgatgaagatttgcagggcaaagagcacggaaatccttcacactgacaatagcaacattgtaatgtaaattacagtgctctagtgtcccttctgtacgttttttgtttggaagcaacacttcaatctgcaaatgacaaagtaagacttaagaagtaccttagaagaacaaggatcacagaataatatgagcacaacgttagctaccctcaaattttcaacaatcttgctacgatcgccagattttctaactaagctcgctgaagtcagaatagatgtacatccgttccattcaataaaaaaacctgtgcatgcaaaatatcttgtttctcctgcatataccgtaattttgattattagtgaaacaaatacaaatatgaaagtgaatagcaaatgtaaacttaccattgaatgaagcaagcgagacaacatttcgagatattcttgaagaaacatttttgctgagctcactccagacaccttcatcatacaagtcgccaaaagtctcttcaaaagtgttgaccaaaaccatgccatctggttatagatacacaaccatcagagggtagctaatgttgtgctcatattatgtaggaaagatctgcagattaatttacaagcaccgattcaccgttggccatacttattgatggcatgggataacccatggagtctagacactcaaattgatcctcatcacaaacatctgcaacaaaggtaaagttagcattggcatatggatgaatgacattcacgtaaaattatgcacataataatcaaatgttagattatataatgagaacttgggcaacaactcatattagaatggctcagtttgcatgcccatgagcataatctaagactaactgattagcactaaaactaggatagtgcaactgcaagacactatagcatatagtatgtattgtgaatatcaaatgagagctaaatttgcacttgtgaggataaaataaaaaatgatgatgaattgcatacaagagaaatatttgggggtggctttgtgctcaccttctagaagggacttaggcatctcaattgagagtcttcctccaaccctgcgaaagagcatcaacatgagtacttctccaaaggaaaaaatggatcaaaaccagtgcatcaatatgcaacatctgcatttacacaaaatgtaggaataaatatgacctgagtacaatggatatgattattttaataaaacaaaagataattgaaaggatgtttatacagaacctcagtgccacgaaacaacacaatcttttttaatgtgcacgtctatctattaacttattaaaggaatagaaaacgaaggctccacgttcgctctaatagcctagaaattctcatattaatcggagaaaaagaaaaaaacggagtccacaaaggaatacaatttaaatagctgaaattcggaattaaaaatancgaatataggaagagaagactagagtccatcctggtatacaatttagaactaattgaatttcggaattaaaaataagaaaattaaaagcagagattctgtccatatagaaatatttataattaaaatttgaaattagaaaataaggaatattgaaagaaaagtgtagaatccatatagatatacaatttagaaacaataaaaattcaaaatttttaaaataaggaatattacaagaatagtctagagtccacatagtaatttagaactaattgaaattcagaataaaaataataaattaaaagttgagtttagagtccatatagaaattcaatttataaataattaaaatccaaaattttaaaaaaagaaatattggaaagaatattatagagtccatatgggaatacaatttagaaataactaaaatttcgattaaaaaaaaggaatattgaaagacgagtttagattccatgtagacatataataataaatatcagaaattcggaatttaaaaataaaaaatattgaaagaagggtttaaagtatatataggtgtaagatttataaataatgaaaaatttagaattaaaaaaaataaaagaatattgaaagaagagtcatgatcatataaaaatacaaaataactaaagtttagaattaaacaaataattaataactattgcgtatatagaatacaatatgaatattacacattggttagtttggtcaagttagtacacaatttaaaataaaattatattataattttaatatattttaataatgaaatgtaaaatatatatgctattatgtgagaaaaaaatataaggatgctagccgcgcaatctgcgcgcgccatcatgctagttctaatatgaacaaaatgccttttaattagaaaaatatattgccttcaacaattgattcaagaaatataagaatgaattcatagtcacaattgcaaatctagtttgctatagagaaaccgtgaaacatgctaataggacaactagtgtaaccctaatatcttggtagaggtagcaaagaatcaagttgttattattcaatacctacatgccttataagtggttgaaaagttcaaaatagattttttttttcggaaaatgtataaagcatacctgattgccttcaattttgttgccaatgcaaaaaatttcctccttcggtaggatgtccgaaaatactccaaccgttcaataattatactgatcggcaggaaaagggatcttcccacaagaaataaaaggttcatgccaataaggttcccatcagaatcaaacagtgccccaccttcccaaccctagcatgtaaacaaaatggcaggcaacaagggttacataggaactaatcaacaaaatagagttatacagaacacgggttgcatacaaatgatgcctacaagtgcatttagtaatagagatagatcgaagaacttctgtttaaagtatacctcagagattttacatgtggacaacataaactcttcagcatcttcagatccatttgaatcgctaattagcatcccatctgtgggtgattaatttgccagagatatcacgtcctacagctactaccttactcccggacagatatttcatcacgtgattgggaagcacctcgtgaacattaaggaaggtcatgactttgacaaaagcaatttcgtgatctaaatcatattcatccaaacaccctacgacaaaattgccttcacagcgcacttcgatctataattatactgcgatgttatcgaatgatcgcaattatatcttatgtaaacagcaaaaaatagtaaaggatggttagcaacaccacctttaagttatcacggtcttttgttttatcattgaaagctttaaccaaacttgctgaagtcaaaaaccttgtgaagttacgcttgtgttctatagttatgcctgagcatgcaaacaacacagagtgtcctacacaagaagagtaacttagatcatttatacctagcaacgttaataaatatatatttggcaaaccaagaagagtataacaacgtaatcaccatcagataaagcaagtgatacgacattactaaaattggatgggacctcttcaatgagttcacctaattaaacaaacatagcacaactgagtactcaaatagagctacaagaaacatgaacacacacgcgtgtgcgcgcacacacacagagagagcaaaccagatatctcctctccattgcaagatcttttactcgtacttgggcttatggtgatatcatcaagaccccttttcaatgtcagcatctttccaacactgacacagaaacaataaaaaaaatgccaaatgtgggtcaataaccagtaaaaaccgttgtaaaaccatcacagtttcatagccctatatgtgcctttaagcagttgcggaggacgaaaaaaaaaaagtgtgcctcatgaaacattatctccatgcaaagagttagcatcaattacacaatcacaaatttgtacatttttaaatttgcaatgctctggaattctaaaccatcgaacaaatatatcacctcttcgtgatgccaagaccttcctctgcctctctctttctaaccattttcttgttttgttgccttgctccttagctccttggcttccccttctgcctaggcctgcggcgcagactgccggcctcccgcgccgtcgagccgtcgagccgtccgtcgccgctcgccagccgccacgagatgacagagttggaagaggctagggaatttttatctagggttcagtgaagaagcccaatgggccttttacgaagtgtcggggggatcatcagaagatgggccttttatgaagacgtcaggagactcaggacgagaaccggacacaagtcgtcacggggaaaagaaaaagggaaaaaaaagagaaagaaacggtgacttttgccaactaattctcccgtacgcccgagatccgaagcggctcgcgcggccgccacatcttccgatcctctcgccggcgggcgcgcgcgcgcggcggcggcggggcaaaaatggaagcaacggccggcggctccaccgcctccgcggcggcgtgcccgcccgccccatcccggccgacggacccggacttcctcagctgcgtgctccagcccccgacaccctcctcctcctcctcccgccccgacgacgactacgccgccctccgccgcctcctcctccgccgcaagcccccctcggcgctccaacaccgtatggtacgcccttcctctcgttcttctcagatccctcattggcgcgcgtagtgttttttttttggccatggggaatgaatgaattgggttggattgggtgggtgggtggtgatgcaggagtggcggtgcaacgggaagggctacgtcgcctaccgcaacttcctcctccgccgcatcgacggtggcgccgcctccagctgcgccagcacgtccagcaacaggtgcgtcttgattttgtttcgttttttttttcttccgcacctcgtcgccctgcccttacctaacgaaacgagaacaaaaaaaatgtagccaggctcgctacctttgtgtgtctctgagcttttcttatgctcatccactagttttctcttaagattaatcatttgaatatgtagtatgattttggaggtgaattctaacactgtggatattgcaatttaccagtggaaggtgggctccttctcctgcctatgctgcattctccgaggcggatagctggagttctagcaaggttggtatcttttattgtttgctgcattagccacattgtaaattatcgttgatacaccattacatttgtgcggatacctttgtggagtgatcacaacttgttgtgaattgtcatgtacttgtttgctgcaggacttgagaaggaacagcggaccattgctccgcaatcttagtatcagctcaaagcagagtgatcctgagcgtcatgtcagatttgccgagcctgcatactcatttgttggaatgcattgcatctttgacgactgcaaagcatcaggtttgttgccttatagtcatggtgcacaatttcaaaatttcatctctgacggtaataaattattgttgttttagtgatctggataatatattaacgaaagtttgattttactcccggcagttacaatattgaaatttggtcgtgcaagttcagatctacttacatatggtgcttctgatggcagtttaacagtctgccaggtttctgacccaccaactgttcttcaaaaattaatagggcattctaaagatattacaggttagagtacaatcattacttgtttatatggttttatttatgtacctacgtggctcaggaaaagtgcttagcttctagtacaagggtgttactagggatgatcaaattgcatatgaagctaagtgcaaaaatcagcattgcaatgtaccctcaatgttactgggatcttattcgatgcttatcttaataatatagaatgatagttcagttaattgtgacttcccaatattttaaatgcctatcatgctgtttgtaacatcaatagtatctcctagtgctgagcatttacaattgctgcacatgtagtttttgtttgttatagccacaaaaaagttgcatgaataatttatggatttggatggatgctaattaaaacagaataattgagttgtacttatctattatttcaatgtttagtatttagtgagcttcgaattctaactgcattacagattttgatttttcatctaataaccagtacatagcttcgtgctccatggataaaactatgagagtatgggagatctcaaaaggcacttgtatcagggttgtatatggggtttcttcccagctatgtatctgctttcatcctgtaagtcccgcctttgcagaatgcatacttatcccattcgcttgttggcaccaatcttatttgcacttcgcattcataaaaattatttgtgtagtaaccaggatggatggtctactttatcatatgtttactgggttttctttcttctttttttttttgcaggtgaataataatttactgttagttggcaatgcaaacagggaaatcaatgtacgattcctgaccttttgctcccagcaattcatatactccaatattttgcctgctgattaatctgcgccttcccttgaatgttctgttttgtgatagtaatggaaaaatgaatgtgttattcttattctggttatttattcactaaagatgattttcttctgattaaattagaaaatatatcacctaatgactaccatttcccctttacattcttttgcttgtaccttttaatgtcgatggttgtgatccatatctctatctattataggccattaattttagcactgggagaatagtcagcaagcttacctttgatgatgcggttacagctttggatgttgatcacactggacaacttatttttgctggggacgctcaggtatccattgatttggtttgtttttactgctaaaatgaatatacgatgttcataattttcaattggtaattgaaatgtgtagggttgcatatatactgttagtgtgaattcacacacgggttcattatctagaactcataagaacaagagcaataaaagcaaatctcctgttacaaccatccaataccgcaccttctctctggtggcacgttgcccagtcctcctttcttgtgttcaaaatggaaacttgtttttcttcaggtgcgtgatcattactgtatgttatgctgttaactctacttttttgtaactatttgtgttgttggtcatttcagcattgcaacagattccaagggatacttgaccctaatatgctccctaaaattggcgtcaccggtgcagagcatccgtgcttctttctgtccactcctttccctcgaaaaaggagaattcattggtgagtaaaaataaaacctttttttttccttttcagttgttgcttgttggttacctcaatcttaaagctgttgataatccaaactctcatttctgatactgttcatgtcagccagcactcaattgctactgcaaattttgtgtattgcctgccctcacatgttgtgttagcattatcctttgtaaacttgtcttttagttcaatgaagtagcaagccgacaatgacacttgacacaagttatcattacaaattttgttaattaattattttacaattttaattgaacttagtgagacaatgtatgatgactggctttggcaaataggtggaccattttgtaccctatgttctgttctttgtaatgcatagctgggtttttgtttaaatctgattcctttttcctcctgaatgtaaagtcacgggcagtgaggatgcaaatgtttacttctacgatttgacacggccaaagaactcgtgtgtaaataaacttcaggtatgttcagtgcttcttctatttttggaatcttaaactttggttccatggcaaaggtaccgatgaaactattttcattcgtgaagggacatggttctccagtaattggagtggcctggagtcatggggaaaatttgcttgcctcatctgattcagatggtacagttattgtatggaagcgggcataaactaattagagcggattccacaaaacgaaagttgcttgtataatgaaggcatttttggcgcatgttgtacctcccatcatatattgtttgtaagacacagaagatgaatcagccttcaattgtatttctacaaaagtatagttctccatagagtgtacagcggttcttcaggtacatcttacatatatttttgttcaatactaaaggggtaggaggtacagtataattctctttttgtaaactaaatttcatgagtttaaatggagtagttgcaccctgggtcagattctgtaaggtgaagaaggtttgtgtttgttataatccttcgttttttccgtctacgaatgagccattactgacttttgtattagacttcctgtcttgagaattggcgttttaccggttgaccgaagatctgccaaagaactttttctgcctttctcagctgtatgtgttttacagcggcaatgcgggaaaccatgtattgcaaacctaaaaaccactgtagtataaaaagaatgagcgtctgagatttatcgacactgtaagtaaaattcggggatgacatggacaaatctcatatgtttacttttcgttcctacagtaatttctaagtgtttacattacatacgtggtttgcgccatatattttccccagcaatgcaatggaacacatagctctatctagttcccgaggtgacaatatggcatatattcagctagctgagcatagcattgcaaatcacaaagaagcacacaaccggctagaatagtgtcactgaaagcactagaaacatggtactactaagttgctaacatcaggcaaccattctacccccccagacagacattatttctaccactccaagcaccatgactccatcaagctgctatagcgatggttactgcaaattgaacgtgaatgacaggattattcctagtgctactccgaaggcgagggctaacagcttgcaagtcccatcacaggtgtctgacgtccgaggcgctggcgaagaagtcatgtcgaaacgcaggacgcagtcgtcgctcaccacgacgccgacgccctctccctgctcctcccgacgtgcctcccggaagcatctcggtatctctcgcgccgcgccctccaggcactgcacgcagtccgccggcgcgacgcccgcggcgcactgcgccaccacgcgcccggccagccccgtcctcgtcgtggctgctccgacgtcgatcgccagcatccgcgccgccacgccgttgctcatgtcgaggaacgtcgcgtacaggttgtcgctgaacggcaggacgtctccggtgacgacccaccggtggaactcgccccccgctgggctgggcgacatcgtcgtgttggtgtcggcggcgtaggcggcgaggtagctgcggtagcacccgtcgagccaggcgccggcgcgggcgccgcagcccgcgacgacgtccgcgacggcggcggcgaggctctcgcggtacagcgccggcgtagagtcgccgaggcagacgctgagagcgagcgcgcggtcgccgccgccggcctgcgtggaggcgaacctcgtcgcggcggcctgggcggggaggtcgtcggtgggcagcgcgaggaggttcgcgcggaacgccgtgccgttgctgctgttggacgtcggcgccggcgaacagtcgatctgtgggaagtacctggctccggtggccgtcgacgtcacgcagacgagaaggaggcaagaaagcttggtgagcgccatgagcgatggattgcacgacaccaaggtcgccaggccggatacgaactgcatgccgtagctcgaagctacaccgctctttatgaaggcgatcgagtgagctcaatgccaccacactgtgcagctattaggcctttcacagcgctccaccctggaccggtgctatggggcgacacattggatttttgctgccgtggcgctcgaacccgcgtctcaagttggaacctcatctccatgttgagcgacgcaggacttcgtcaaaacgatgccgcgagcagaggagaagactggaggcgcgcgcgctgtgagcgttgtggcttcgcccacgcgtgccctcgtggcgaaatccaagggcgaaatccccgatacgccctccaaatccactcccaccacagcaaaatccagggcggcctcgccatctcgtcggacggcgccgcagttgccaccggggtgtccgacgagcagggaggcgcctagcacacttccagctgcatcaacccaaatcaaaatcaaaaccaaatcagaacaatgaaacaaatcaaagaacacaaatcgagggcaaggaaacaaaaatcaaacataaatcaacaaatctgaacacaccaccaacacacataccacgtcaccggcgagctcccaagaaacaaaaatggcggcggcggcgagatagatggacatacgtgtcgccggaggcagaagcgatcgaagcaagggagtgggggagggagaggggagggg

SEQ ID NO: 9157 - DNA, 10281 bp, Oryza sativa
cggcgcggtcttgtccactcccgctgctcccaccgtcggcgtcgcgccgtccactacagccgcccccaccgctcccgagtccgagcgagaggaggagcgggcggagcgggcggcgcggtcaacggcgaggcgaggcgcacggcggcggtgtccccggcgtctcgtccactcccgccgctcccaccgtcggcggcgcgccgtccactacagccgcccccacagctcctgagtccgagcgggaggaggagcgagcggcgtaggcagcgcgggcggagcgggcggcgcggtcgatggcgaggcgaggcgcacggcggcggtgtccccggcgtccgccgcgagggaggagagggaggagaaggcgaggcgaaggaggagacgtgctgagggggactcagcttgggtgacattgtaaaggcaagtcacagcgtgacattgggaagatctggaccatccgaaacaaatccaacggacatggcgcttggacccgcctgcaggtcgaaatttcgctgcccatccagcccctatccagcgcgggagacggcgcccgcccccgatccttcccgcgcgctcgcatcgtcgtttcgcctcgcccgcccgcgtccggccatcgctgtgagcacgaatcaactgggaggctcgccgccgtcgtgcctgcgcaggcctccgtgctcgccgcgagtgcggactgaaccgggccagccgccgcgcgaggccaactccctgccctgccgcgacctgtggaggccgccgaggcactgccctgccgagcgcgtggaggcggacggccgctgggcctgacggcgcggtggtgtagacggccggccgcccagcctgagcccggcgcgtggaggaggggacatcctggaggaggctgcgctgctaccagtcattggctgctgtcttgctaatcctacagatgacaacttctattgttacttgccaagtttttgccggctaattctaacatttgcatcagtcaggctctggaatggcacagctatcataaatgtgaaattcttttgtatggaggtgatcaatgctgaaactctgaactattcaggatttttaggtcctcaactgagaagagcagaggatagcacacaggacaacacagtaacttgaaaaaggagaaaaaaaaacccaatcaacacacattcacgcgctgagctgggcgcaccactgcaccagggcttgtctcaggtacttcatgaagccattaggctcgtctcctccacgcgccgagctgggcccaccagcgcgacgtctggaccggcagctggccgcgggccgcctccacgctcctccggccgtggcggcacggcagggcctggccccggcctagcgcggagatcgcctagtcccctccccactcacggttagccccgcggtctgggcgcctttccagtcaggcggcgacgagccttccagcttgctcccggcgacggccgaacccgggtgagcccagcgtccgggcgcctcgcgcggtggtcaccccgtcccctccccactcgggggaagcccggcgctccagtacgggcggcggcgcgtgctcccagttggctcgtggcggcggccgaacgagcgcactgctccacgcgttcaatggatggattggggctgggggagccgtctcccgtcgggatggatggattggggaataatttcgacctgcaggcgggcccaagcgccatctccgttggatttattttggatggtccagatcttcccaatgtcacgctgtgacttgccttcgcaatgtcacccaagctgagtcctgctaagggtgaggggtaggtgaggaaaataaatttggggtcgcgtcctgtgtcctcctgtagggtatcgcttcgtttccttcacggcttcacctctctctctctatccaattaagccacacatatatgggtgctttcactgtggggtgagtgtctttgagttgtgactttggactagggatatgggccccatagcttgcactgctattgcccttagctatagccgctgcctctctgcgcggttggaccagggttcataatttcagctcgaaatttcggttctatcagaccacgatacaataatatttcggctgaattttttttcatttttttcataaatttggtaatattttgttcaaatttaaccaaattttattcaaaaattcatatgatttcggatcaaaatttcagaattttgaaaatttcggtatttcgaccaccaccaagtcaaaacactaaaccgaaaaattaaaccctcggctggacacgcacgcgccacaactcgaaatggcacgggaggttagcacgcgtcattgcagtagctgcaagtaagcactgtgaatggccaacgggtaattgcggcgaaaagctccgccgaattcgctaatcaagagggcgtcactccgaacttactcagccgaaagttgtttccctagctagttcacccgttgctcgaattggctggacttctctccctttactcgcttattaagcgctatgctcttctattttcgtgagcttacggtcttaagcgttgtcattcctggcaggtctgttcggcacgaaactccggtgcaattaagtcctatggcggcaactaaatcctagccaatggcggcaaacttcaacggtgctagattggtgggaggctaccgcaaacatgcaagagacacctaagaagatactccgcactttgatgttgttggtcgcctgggagatatggaacaaaaggaatcgcagaaccttccaacagaaggagctttcagctacctctcttttagccaagatcaaggaagaggtcaaaacttgggccttagcaggagcgagaagtcttaatagctggctttcttttagttaactcggaccaaaggtcctaactcctttcctttttttctttcgctttgtaaaattctccttctctattcaataaaattggcgctcgtcgattcgttcaaaaagaaaagtcctatggactatggtgtgtgctaccagtttaacaatttctcatgggtcaatgagttggggttgttgaaacttggccggcgcaaaacacgttgcaagattgttgtcatggggagtaagatggactaacgtgtaagcatgtttgctgtcagtaatatacattttttttcctttttgttctacctcttgctatgtgcataaactccttttattaatataacgccaagcaggccattccaaaaaccttttcccatgggtcattaactactgcaccttcccgtaccaagcattgctagcaattaatagcttgcaacgccatgtctagggatgaaacgattggaaaacaacatgcatcagccgtttaagtaatcatatatttctcggaaacgaaccgataacgatgaggctgaaaacaaaatgatatcaaaaatactgaaaacgtgactacatgaacaaaaccatgtcaatatcgatcggaaaccagtaatgaatatcgaaaacattaaactcgatgtttaacttaacatgactatataatattgtctctcctctagccttgtactcaaattagaaatttgataaatatttatgggtctcaaaactacgggtcacgggtcacatagatacatggacgataaatattgagatatttaaaaatacggtgattaccgtattataaatgtagcatttttcatgagactttggtaaattaaagaaacggttggtagaacaataaaatcgtttttttatttttaccatttctatttttagttattgttttcactcctgtgatggcaaaggcaaactggtcaccattgcttcctacgcatccgagttagccgcaggctatttcataacgtatagttgtgaattgtgagattttcttttagtttcacagtgtatggtggcgcaccggcagtccggcacatcccggccttgccccgataccacgactggccctcaaaagccttatcttttcacttatgcttatacttatcagctaaaacttaaattttctatcttagatttaaatttaattttgaggggtttttttatcgaaatttatttttcagtctttgcttttagatcggtaaaaacatgtatataaaagttttattcacaattttttttttttgcaaatatgcccgcgtcgcggtcacggtcgcgtagtcgcgcgcgcgcggcgaacgcgtgtgcgtcgtgcggggtgattctgttcaccgccccatgggccgcacaaaggggtccaatctttcaccctgcagaatgggttggcggtggacgctcgtaacgctagcggctagctgggcatagcattttgcaaacaaaacacacatgataagctactgttatcctaacacataatccctagtactacatatgaccatttatttctactactcgatcgagcaccatgactccatgaaagcttatctacaggtggttatattactgcaaattgtcttcactcgattcgaacatgacgactactactactacatgattattgctagcgctgctgctccaacggcgagggcaaacggacggagagctcctccaccaaggcttgccgccggagaggccaggtgcatggtgaacttggagcacgcagtcgtagctcagcgcgacagcgacgctctctcccagcccccatgcgttccagcagcatctcggcatcgctcgcgccgagtcctgcaggcactgcacgcagtccgccggcgcgcggcccgccgcgcactgcgccagcacgctcccgccagccccgtgttggcgccgtcgtcgaactcctgcgtcgccgccagcatcgtccgccccgaccccgaccggttcgcgacggcggcggcgagcgccgacacggcgccgttggccaggtcgaggaacgtcgggtccaggttgtcgctgaacggcaggatgtcgccgtcgaagaaccaccggtggaacgcgctctcgcggggcgaggtcgcgtcggtgtcggcgtaggcgaggtagcacccgctgagccacgcgccggcgcggcgggtgtccgcgccgcagccttcggcgacgtcgatgacggcggcagcgaggcagtcgcggcactgcgacggcgtggagtcgccgaggcaggagccgcgagcgaacgcgcggtcgtcgtcgtcgccgccaggcgcccgtccgccggcgccggcctgcatggaggcgaaacccgtcggcgcggcctggtcgggaaggctggcgagcagcgtgaggaggttggcgcggaacgcggtgccgttgctgccagtggacgtcgccatcggtgccggggagcagtcgatctgagggaagtagccggtcgtgtagagctgagtaccgcgggctacaatggcgctcgcgccgccgacgacgacgaggaggagctgggcgacgaggaggagggaggaaagctttctgagcgccatgagcgatggatggcacgacaccaaaaggtgtgttctatggcaatgggcggatcgaaggagtcaaggaggcgggagcagactacggctgtatttagttcagcccaaagtttaaaatttggttaaaattagagatgatgtgactttaaagttgtctgtgtatgaaaggtttgatgtgatagaaagttgaaagtttggaaaaaaaactttggaactaaggctgtgtttagattcaaactttcaactttttccatcacatcaacatatcatacacataacttttcaatcacatcatactaacttcaacccaaactttcaacttttgaaggaactaaacacacagcctaaacacagcctaccagtgtgagcagtggtcgacagagccgttgcgctactacccgaaatggcacctgagggatgggggtagcacgcgccattgcaccagctgcaagcgagcacagcgtgcgaatggcaaccggcaattgccgcgaaaggctcacgccgattcgagaatcaggagggggcgcgttacgttctactgatccctagctcgctgcagacgacgacgcggccggtcaccacccgttgctcgaattggccctctctccccttactcgcttgtattttggtgagcttatgtttatgctaggtatagcagagaggtgccattcctggttgatctgatccgctcggcacgaaacttcgacgcaagtccatcctctggtggcttagcagagttaccatttcttcatgggccattattggcgcttttcccgttccgagtattgctagcaatagcttgcgttgcacatgtcagtggcaaaaggaaaacttgcctgttgagaggcaatatcgctgaagccacgcctctcgatcgaatcgaaaccatccaaagaacaaggcgattagagattcaacttttaaatagaaattcaaaatttgaaaatccgtttttttcttcaaaattttatactcaaatttgcaaaacgcaaatcacaataagaaactttaagcgctctgcattgaaagcttaaaaaaactattcccaaatttaaaacatttaactcaaattttgaaattttcaactaaaaattaaaaaacatctacccggatctgaaaaactttcaaattctgaaatgcccaactaaaaatttaacttttattgaaaaaacaaaaaactctacccaagatttaaaacttccagcacaaattttataactttcaaccctatcatttaggtatttcattatacgcgttggcataaactgaaagaaaagactgttgttaggcttgtattgtgtcgtctagttgcaactctcatgtgtacaagaagggcgaagacgacttctattgctagcccaacggtgccaactagctgctccgcatcagggtttacaaaaccaatgaattcgattggattttgctaaaaaccaacgtttctacgtgactcggcaatagttctcctctaaatcgatgggtttcttccaaattcaaatttggattaaaaaaagtgaaaatatttagaaaaaatactataaatagtatggtataggtagaacctattggcatataattttttttagaaaaatgctgaattccaaatatgtcatccttgttaaaaaaatgttaaaaaaaactaaggaggtgttctgtgctgaactctaaagttgtactaatgggctttaatttagatggtgggcattctatttgggcaacggttggtgaaggatgtcaagatgcatattgaattgtgcgtgaaatgtcatatgtgttctaaattattgccttctatgaatttgtatagcatattgtgtgtatgccaatgtgaagttatcaaatttataggaaatggaccaaaatttttagaaaatttcccccatttttttagccttttttttcagtattttctacatttttaggaaaccggcttgcgcgggtgcacacgttgcaccactgctcgaaatggcaccggaaggggaaagtgttatcccaagttcgccatgcaaagacgacgaagctgccaccgccccttctcgaactggccttctctcttcactcgcctgagctgagatgctcgaattggcattctctccaaacaacataggcccgtccacccaaacaacagaattcatttcggaccttactattcatcacctgtaagttcaagtgtcttaatttagttttggtgattaatgacaaatctaataatatgagactaacgtttttatgagcttctctttaactagtctcgtttagatatgaaaataaaaatgatgagaggtatgtattaaacttcacatattctaacttggtctctcttgtggatccaaaatatagtgtgagctccgtcattaatcttgattgattatgtgcatatgtattcctttatatccatatgtatgcacatcttgagggggagcttattatatattttgtttattataagatctctaccttgatttgaaatcatctttcatcccatctctctatattgtttatatcgggttattatctatcaccaaaaagagaaaagattgaaagatcttggattaaacaatttgtgtaattgttgctttgatgatagatgataaaccgatgtttatgggattaacctctctttttcataagttgttaactaggttatttcccgatgatgagatgtggtagatatgcattctttagtgatggaccttaatcatgataaggatgaaatgcatggagataaaacgatatgtaccacttcttatctcctactttttgataggttcatatatatgatttccatgttattgttatataagtgtgagactaatgtttactcgagtcgtatcttatttagtctcatttacattaagaacatggagatcatgaatgtatatgttttatgttggtctacatctttactacatatgccttctctatgtgtataggataaacccccattggtcattctctaattatgcatacacttgcatctcttggtatatttatttgtatgcatatatttagggggggcaaatcctatacatttattgtgcatgttctaaatccatgttattcacttattatttatatcgaatctttgcacttaaggttgcatacgagtatatgacactggtgatgttaatgaatactaaagaaacatatccatatctttcatatgcaaccggtggtcatcaagtgaaggatgacaaccgatttgttgagactaatgttctcctttgagatgtgaaaaggaataggtcccactatgatgaggctgatggatgacaccatgggttaatggtcaccaagccaaggacatcgccatgttggtaagaatgaaatcaagcttgtaatgagaagaaagtcttgacaaatgatggtaaataccttggtataaacatggttgaatcaaatggtcacaagtgttgatctcgactcaagcttgaccccaagatggattttgcaaggcaaaggtataatgtagctaagaatgttttcttagccttttcccggtcttgatgtttggtgtagaccggatttgctagataggcgccgtactatcaagaggggtctatgaagcgagcttgtggatgatcttgtgccttattagttcatatgcatgtaggtgtatttggtgggcttgtctagccaagtgtggtgagttttctcaagtcctaaacaaagagatatgtgggcaaatcctataggtttgggtagcctcatgtggttatgtccggtggagtatcctttggagtgtgagccctttctccctgagaaaatttgtgtttcttggatggattgttcatgggttggatagccctttgaataagctttccataaagtccaagaacgccaaattccgagacccgagtcaagagatatcgtcgttttactaacggtcggttgagctgaaaagtgaattgcggtatgaccgtgggccttaggccggtctgaccggccccacaggtctggtttttggtggcgatacagagccgccagagccgcaaccagtcagaccgagccgacggcggtctgaccgagccgtggacggtctgaccggccactacactgtggtcagaccgaccaggttgagtaggctcaatgattgccctgtaacggctagttttctagccgttacaaagtagtccggtctgaccagcctcacaacagcggtctgaccgacagagcacagagttggggatttcggttccaacggctagttttggtggttgggggtatatatatacccactccccagcagcaagggtaaagttttggcactccattgcattatcttgaacccttgcaagagctctcacacccttgtgcacttagtttttctagtgaggtgttagagagtgagttaagccaatccaagtgcattgcttcattgttatagctagtgtggcacttgatcatcctcggcaagcatcctagacttgttactcttggaggttgccgcctcctagacggcttgtgtaggtgttgcccggtgacctctccgaggagattgtggaggaggcccggcgccgtttgtgagttgtttggagttcaccaccttcggagtgaaggaagaactaccccgagtgatcgaggcttgggtagtcctctccgtgggccagctcccgccttgcccaccccttgacaaaggaggcgtgcggtggcttcgtggttgagcggtggagttgggctcgcctcaacagggattaggaaaccggcgagtttccgaacctcagtgaaaaattccttgtctattgtctcatttatttggtgcatttacatttgtgctatttacattcatagagacatatttgagcctatatcacctaggtttacaaaacttaacttagttgcttagttaaccttgcaccttaccttgcctagcaacttaggttagttttgtttaagtgccattaagtttt

SEQ ID NO: 9158 - DNA, 2477 bp, Oryza sativa
tcccaattttgatggagctgaaactgtttggttgagctccagctccaggaggggtggagctggagctggagctgtgctaaacaggccctaactacccgggctcaagctctgagatcgtcacgccgttcgctgacacagctggcggctgccctcctcgcgcgggtgacggccgtcgatcgttgtagtgatatcaccgccagaacggaggcgtcgtccaccgagcgtggtctcacttacgatagcaggagcagtacgccggccgggatcgagggataacctgcatgccgcgacgatgtggacgtggagtggctgtgtcgtccagcatcagcgccgcgcggccgacgcgtcgggccggagccccggttaaatttcttctgcacgcagctgagcatctcggcacgaggctactccctgcccagcgacgccgcgtcgccgacgtaccgcctccgctataccgatccggcacctcatttgtcacatacccgtgccttcaggcacgggaggggagaaagggtgtgcatatagatggccatatggcccacccggcacggcccggcccaggcccggcctaggcacggcccgaggcgatcgggccggcacggcacgcctggcacttcgtgccatgccgtgcctgcccacgggctgaacctcaggcccaggcacggcccgacagcagtcgtgccgggtcgtgtcggcccgacggcacgctgagcccaccgtgcccgggccagcccaggcacgccaaacactaactgccacttgttcacttcagttttgcacatacatatcgaaaatgccatgtccatcacaaaaatcagcacaaaaccatccaattcacaagttaacagatcacaatatcacaagtctcagattacaatatcacaattcacaagttatatagtatgtgcagtatgacaattcaattcactaactcaacttctaagtctcacagttcacaactcaagtcacaaatccacaatcacaaaacactttcaaatactaagtctaacagttcacaaatcacagttcaaactcaagtgatcagtcacaaacactttcaaaaataatagtagctgtgtagtgcaatggttgcctcattaaaaacctttctaggtaaaaactcacacctcgtgagaaaaccctagaaaggaaaaagagtgcatcccacagctttcatctaattatcacattaaagtccaagtccagtacaatcatccagttccagtggcactgccactggttacatcatcaagacataaattctcaaacgattttataagctctacattctcagcagtgtgctgcaacttcttgtctgcctgcacccagtccttgatcaatgccaaagcttgcaccatgttaggacctagacgtcgtcgtcgctcctcgatgatcctgccagttaagctaaaagcagactccgacgatatagtagaaacaggaacagtcaagacatctctagctaatatggacagaacaggatatgtgtgtttgtgctcatgccaccagtttaggatattgaagtcatcgtcgaattggttgacagtgtcactatcaagataggcagacaactcagaggcattcaagttagcattagaagaaacagcctgaatcaaagcagtagcagaagttctcctggaaaatggaccagcaccaagtccagaacctggactggcactagcaccaagtccagcaccaagtccagaacctggactggcaccagcaccatgtccaagtgcatcactggcaccaaaaatctttccccaggctatctttttcttaccagcagtacaacctggggttattctttgcaatctcacagcaccaaacttactttcatactaagagaaaatgtcagacaatgcagccctaacctcagttaaataagtagagtaatcagaggtcaaaatttgtgacataatttgtagaacattgctaaaacctctgatcttagccctaggatccaagataaaagcaaatgaatacagaaatggaatctcagaccagtatgccaagaacttacttttcatgggaacaacaacatttctaaagttattatcattctcataagtgttaagatgtccagcaatctcaagaatgtgatgcataattaatggagatgttggataataaacaccagacaaaataacagttgaatcataaaattgttcaaggaataaaagcacagtttcaacaattgtccagtgcaaatcagtaagcaatagtctaccattttccctaggataatgagtttcaataaacaatgaaaaaagctccttatgtgggaagagatgcttgagcattagataagttgcattccatctaacatccatgtccaaaccaaacttacgaggtcgaacacccttagcaatacaccagtttttgtataaagcaatgcgctgattagatgcattcacaaatgagatggctgttctaaaatcttgaagcatgggtttgaaaacttctagaccagcctt

SEQ ID NO: 9159 - DNA, 658 bp, Oryza sativa
aggtgtgtggtttttttttcttaaactccaaatctcttttttttttcaagtcgccgaaagaaaagtcgttaataacctgaagagactctcccaagacagaaggagagaaaaataatgcactcgtgtaacttaaatagtgtagtttagcaaattcgttaaaatccccttttgggaatcttcggcctccccagcggcaggcaggcagcgcggcggcacgggagcctctctcccctcctcctctgctgcccgcgtcccccctttacctcgcatccgccggggatctccgcctctcccgccatgatggacctggatccccgcctctaccagaacgtcgtaagctctcattctacctacgcaccctgcgcccttccttcccacttgatctttgattacctctcgcaactcgattgctttaagtattccttgttggttagaaggtaggttttctaggaacccatctctcctgttgctggaggagggggggcaaagtaggtgctttagcgaatcttgtttgcttcgagcgctgccattatgtgcccctgcttgatcttttctccgtctgggtgcgaattcggctttcttgtgtaggttgcatccgtttagtggggaggatgccatggttagtttggttgtttggggcgctcatgctagggctttt

SEQ ID NO: 9160 - DNA, 156 bp, Oryza sativa
tttttttttttttttctttttttttttttttttttttttttttttttttttttttttattttttttttttttttttttttttttttttttttttttttttttttttttttttttttttttatattttttttttttttttttttttttttttttttt

SEQ ID NO: 9161 - DNA, 1159 bp, Oryza sativa
aagaggcattgtctagagtaatagaaaaaaccttatcagtcaaaccatattcttcaacaacagaaagcacacgttcagtaatattctcagcagtgtgcttcacatcaatcagcaccaaacccaaaatccttttctctaattgccaatcagaattaacaaaatgagccacaacacttaaataatcctccttagcattaccagaccatatatcagatgtcaaagcaacagagttaacagacttgaacctctcaataagcatagcacgactcttgtcaaagtacttaaaaacatctctactaatagtttgcctagagacagcttggaatctagggttatgaacattctgaatgtactcctcaaaagtaggagattgaccaaaattcagtggtagatcctctacagcaatcaatttaaccaactcagttctagcataatcaggatcatattcccatggacgaacagtaccatcagcattgagcttaagcatagactgtgacaaattactagcagttctaggtttgcatgacttgagatgcctaagcaaatgaccagtgccaccagatgaatgagcagacaaagttttttttgcagtgattgcatttagcagaaatgcgaaccttcgcgccattgcgtgattcaaagtgttcttcgaagtcatcccataccttggatgatcttggccgcttgttggtagcactggagtcggtgccggacaacgcgcctgagccaccatcaccgtcaccgccaccggtaccgtccacgtccggctccgtctccggctgcgacccatcgaagtgaggaggtgacgaagtgattccgaacacctgcacatgttcctcctccaagtcatcttcgtcatcaccccgcatccccatcaacctcaactcgtggttgcaagaggatggatcgtccatcgtcggcactccggttcctcaacggcggctaccgctcagcgacctgcaagacacacagaatgagagaagagagcagttagggaccggagagaagttgaaaacccagagaggagagaagagcagagataggtgtgtacggtgtacctgcgcatccggagcaccggagttgccgttgatgatagagatcgacggatctacgagaagaagatagcaaagactgggtttggggagtgatgtgacaaaga

SEQ ID NO: 9162 - DNA, 17676 bp, Oryza sativa
tctataggtgtgcagtttgtaacagcgtgtagtgaggcgtgtttcatctacagggtactagtatctactggtgctgcttgatttttgtcaggcgtgtgcttacgtagctcagcaattttggaccgtgatgggggttgccggcatcggtcttcgcatgagcacaatgaccccgaaggcccgaagcagaacatgtccgacttggtggacacatgcccgcacctactgcacgaacaacagcggatccagaaaaaaatagcagtatgatctgagcaaactatataaagttatagtccaccaacccatctacgtatggtaaaaaaatttagtggggtcttcgtggaggttctcatagtcttcacacctgtagtgaggctcgagacaccactgcccccatgctggatccgcccctgtgcacgaatcacaccatgaaaattacttagagcggatacaataaactgattcagcatgcatgctccaaaatacgacatatcatcttattcttatatggatgggaaaaaattgagaagggagagaaaagtgggcgactaatctggcgccggtgctagcacggcctcacacgctcatgcagccgtgaagacgattaagagcaagtttaatagtaggctgtaaaccgactataaatttatatggaagaaagataatttaaaaaataaagagggttgactcttatacaagagctagccattcacatacttcaagataaatacattaaatgcaaaggtgagagatagagagaggaggagaaaaatagagataaccttatggctgatctactatatatgttaacctaatataagctataagctcatacttggctctattattaaacttgctctaacagcatttacaatgctccacgctatacagtggccaacaattttcttttttaattatttttacatatattaacactaaacatatccaacgtgtctcgagctctcaagctactactgtactcttggacttcgatggggagagccatggctgcggtggagctcggggcttgtcacaaagacaatggtagagttgaaggtcggtggagaatctagtacatggaggttaggtggggtgcctacctcgtgaatgtgggggtggataattaagctcatgagacgacaacgaacaatgaatgagctcggggatataaagctcgatgtaggagatgcttgagcttgcgagctcacctctgcgagcttgtggaggaggaggtgatggagttcgaggatgtagagagttcatatggagcttaacgatagaagctcaacaagaagacatagtggatctggagcttatctgcaatgataagacaatgattagaaccatgaaactcgacgaaggagcttaacacgttattagaactcaatctcacctatgcggagtctatgaagcatgaggcactggagtttaaagaactgcccttaccgtcggctgatatagtcaataagtaagttagctggtaaatggggagtatataagatagtcctgatttgtcggcttgtcattttcttaaaaaactttgctagactgtaagattagtttcacgtaagtggaaatcattccgatttagatgaagggatataaattaaaagtttttgggttggatagtcttctataaagtaaaaaaaggtggagtatgttttaaacaaataaaattcatgagattattaaatggacttatttctttggtcgtagtattattttctgttggcccgtcttaagttgttagaaagagagaataggatagtggcaagaggtgtgtggtttttttttcttaaactccaaatctcttttttttttcaagtcgtcgaaagaaaagtcgttaataacctgaagagactctcccaagacagaaggagagaaaaataatgcactcgtgtaacttaaatagtgtagtttagcaaattcgttaaaatccccttttgggaatcttcggcctccccagcggcaggcaggcagcgcggcggcacgggagcctctctcccctcctcctcctgctgcccgcgtcccccctttacctcgcatccgccgcggatctccgcctctcccgccatgatggacctggatccccgcctctacgagaacgtcgtaagctctcattctacctacgcaccctgcgcccttcctccccacctcatctttgattacctctcgcaactcgattgctttaagtattccttgttggttagtaggtaggttttctaggaacccatctctgctgttgctggaggaggggggcaaagtaggtgctttagcgaatcttgtttgcttcgagcgctgccattatgtgcccctgcttgatcttttctccgtctgggtgcgaattcggctttcttgtgtaggttggatccgtttagtggggaggatgcgatggttagtttggttgtttgggggtgctcatgctagggcttttggtgaagaaagatcgggaatttgttgataaggtgcttgcagtgcaaaaaaatcggtacttccacgatgaggtaggttgaagtggtcaaatcaggaactttcttcattatgtgtggcttctagtgcagaaaaagataggattttactgaaatcgggcggaattaattggcatgagcgctggaatccagcagaatgaattggcattctactggttatgacttaggcggcatgccatgccatgccagcaaccacagcttaacgtatcattctcttcggcaatactccagggggaaatccttgttgaacaggttgtgctgagtgtaaagtttgaaccaacagtgcacatgtttctctgtcatgtatttgttgaataagaccttgggatactggagcattttagacagtagtgcccatttggtaaaatctaggtaaaaggggtatgcctgatatttttccacaaattgatgtgacaccaaagctagcgaaaacgtggtgttgaagtcttttctgttgttgccctaaaatcagatgctggtctgtgctatctgctcatagatacttctgcatttatcatcgctcgattagcatcaaatcattattgacaatgctagttgcatgaatatgccatatttttttgtttgcatagatcataaatgtagctgtgttcattaagcaagtatataataatatcactgctgatattttccataaacagaacctacttataactgtcatttgtcgaggcttgaaagttttcttgttctaaatttcggctaacactggatgtctatgtttaccttcgtatttattgaaggtatatactgctattgacactaaattttcattttttccagtccgtgagtgataacgatgtccgcaacatagtgttgtcttatcttatgcacaactgttttaaggagactgctgagacattcttatccagcactggtttggaactgcctgttgattacactgtagatgtagataagcgtaaaggtatttattcacatatcaacactgaatcttgtatctttctttggatgttcaacacttgtaaaattgctgcataagcactttatattgttatgttagttcatttgtatctttttatgaatgctcatgtttttgtttgtctacacaatccttagcagcttccctttcaagtttcatgctaataaaagatgtgctctcagctcacttgttttagggacaaaaaggctgtgctaacgacaccgttcattagctgaaataatctttgtaaaatcaacccatcaatggaattgcagcataatttagctagtgggacatggagtcatttcagttcagtatagatgcagtttttgtttacttgtttgttgtcaatcattactgaacttgttggatgtgatctctgttgcacataattgcaaatgcaagttttattgaacacttactacataagttacacatgttatgaagtaatagaattgtgtatagctatattattctttagtaccttttccgtacaaagtgtaagataggtttttttctaatagcatgccattaatatagggtttatttcatggtatgactctttactgtgctgttacctctatactcctcatacaaggatacctaactttcttgtgcaacatggatttaggattaaatatagcccttagaaataataaattaataattatggggtttctggaaatttccgatgctctgttatcttggatggaatttgtaacttcatttgaaatagttggtggttaaagcagataatatggattgtatctaatctatcatgaacatgtacactgtgccagtattaaaaaatgcatctgcattccatttgtctagtcgcatgcacttgcatctaacgcttttgttttggtttctttcagcgatttttagttttgtgttggaaggcaatgccctgaaggctatagacctgacagaagagttggcacctaacttgctagagaatgatatggatttgcattttgatcttttaagtcttcacttcattgagttagttcgttctagaaaatggtaagtagctttatttttggaaaaaaaataactgtgccatgtattttggattaatctggatgttttgactgacagcacagaagctcttgagtttggtcagaaaaagttgacgccatttgggaaagtgcccaagtacgttgagaaactagaggtaacttttcctaaacctacatatgcttatattagacagttttcaggtcatgcaaattctgtcttcttgtcaggccatcaatttagagaactggcaatgatgttaaagaacttcactaccatttgttacccatacaaaagaggcaaaacaaaaatattggtcttgaaaaaactttcagtatggtgaatctagtttatcactatgcatgagatatagatttctattcaagtacttagctacttgcaaaacagtattggtacctggcacaccttcatttgccctatgttgccgccttgtagatctgatttgtcatcaaagttatgtcagcctgttttctgggctatcatgtattttgttatctttattaaatacatcagatttaaatggcagcgcggtttttgtattgcatttgtttagtaattgctggtgctatactgtcctatccaagtaccgatgctaggtagtccatcattatcaacgccggccattgggtattatatttattaaatgcaaaatatggtgaaaacgtttgaagtagaggtgccgcttaacaaaataaatatggaacatatggtgacatactttttgtgtattgaacttatgattggctgctttgtaatgctatgcttggaatactatgaaaaggtaacttttgttttatatgtataggactttatggccctcctagcttatgaagagcctgagaagtcacctatgtttcatctactaagcccagagtacaggcagaatgttgcagatagcttgaatcgggctgttcttggtatgttctaagatattgttcttggtatgttctaagatactatttgctgtggtctcatccgctgatgacacgattgtgatctttgtctcatgatcaatgacagcacatgctaatcgaccagcatattcatcattggagagagtgatacagcaagcaactgtggttagacaatacctacagcaggaagttggcaaggtaacatctctatctttttcttcatctcacgatcaatcatgattctgtacggctgcatcgtatcttgttgaacatctttttttttgttcttatctatcttaattatggctatttcttttattgaggtgcatgtttttccataatcataagttactacagtccacttaaacttctatttaactattggtgtgctttaacatcatgatgcatacatgacatttcaactcttggagcaggattcttacccgccattttctttgaaggcctttctgaacaagtaaggtgcaaccaatcaatcgttagaaagacacctccagggctccagtcctatggccaccagagttcccttcagaatgtgtaaaacagttgcgtgaaagcaagcgacgggatgctcatgcacatattattcagagaaccgccttctggattaaacgatatcatcagtggtgtaccaacaatatcatctgcatcgaaagaggaatgttgtataactgttgtttcctcatttacagttccccatttcccctttacccgttgacgccatcgaaagttgtacatatcagaaccttgagctattctgtatgttcgtgcagagatatcgtcagtttgaaccaatctgcagtgcacttattactatgcctgatgcttggtctctacaaactattggtgtgttttatggcgtccatttcaccatatcgactgttccattcaaccaaagataaaaggaaagcagagcaagtgacaagaccatgggaggagaattctcaaaaatttcttagaatgtgcacttgatgctatgcctgatgcctgatgctggtttctacaaaatattgatgtttttcatgccgtccatttcacgacatcaactgatcgattcaacccaaaagatgaaggaaagcagacaagaaagtgacaatacaatgggaagagaattctcgaaatcctcatataatcagaaaaggaaaacacgggtgccaactttagttttccatcgtgaacgccgggaatcacgaaagatgagagcgagcggagggcaacaaaaaaaaaaaaaagcttctttccgtcccgtgaatcaaaccgggcaaatcgtagaagacctatacgcaaattgcagaagacctataggtaagcgaatccagttcttccccagtagtagctttcaagtttcttgagccgtttacgctgcagtggctgccagctgctctgtgaattttgacgatgcttgctcttttttttttctggccctcgttttaccggttccactataaataggcaggtgagtgcttcttgtcgtaatagtaagctcatcacttggcaccagctgtgaaaaaagcttaattagtcaattctctccgtcagttgattttgtttggccaacggaacatggtaatttctccctgtttgttcattaacttgtgtgtatttatctgcatgtatgaatgattgcgtgcgtgctggcaaaaagaaggaatggaaataaaaaagatggttctttgatgtagagttctctgggaaacgaacatttatatgggagtatgtttagtgtcttcatgaaacttgttcgtagtttgtcctgctagtttattatatctttgaagtaaactttcagtttccaggttacactttcagaatttcagtagcttgcttggttataagatcaaaatgacatactgacatcaaatatctatcctgcaaaaggtagaaactgaaccaagcttagcttttgttggtcggtagaattttgttaggaccaagaggcttaactcatagatatgcaaggataacagaaatcctgttagtcaagaagagtaatactaccaattatattgatttaagtgctaatagatggtggattacttcatgatgtatcatgaacctaacacaaatataatgatctgttcatgtccaatagagctttaaaggattcaacgggaagaacccgatactcgttgggccgtggggagggttgggaggaaccctttgggacgacggcgtgcactccacggtgaggcaggtcgtgattactcatggtgcagccattgattccatcaagatcgagtatgacctgaaaggaaagtcagtctggtcagagaagcatggaggtgatggaggcaccaaaactgatcaggtttgtctgaattttgtccccaagtccctgacctgagaatttaagtactcagatgtgccaatgtcatcacaattttattccatctgcacaagtatgctacttaaaacttaaaagtaacattcttgaacggacatgtcatagttgtgctaatttgctaaatagattaagctagaaattcattgctgcaactgttttctgcaaacagaagacatgaacgtcttgctactttttctgaagaaatcacatactctgacaagaacgttaggctgcaggcgtttgagtttcagactgaggaagtggtgctgtttctaacaggtgaaactcgactaccctcaagaaatcctcacctctgtcagtggctactacggatcattgggaggctgcatcgtcgtaagatcactaacattcaggagcaacctctccaagtacgggcctttcggctccgaggaagggacgcccttctcgctcccagtggcggtcaccggtaaggtcatcggcttccatggcaaatccgggtggtttctcgactcaatcggctgccatttcaagaaggagaagaacgccactccgtcgtccaatgctccttcagctctcaggagcatcacgagacctcatgacaagaatggcaacaggtacgcagatagcaatgctgggtatgacatggttcttgccgtcagagacagaggtgacagctacagtgtcctgactagcaacaatcccaaggaacagtatcctaaccaatcacaggatgctactctctggaacaaggtaggataaattcagaaactctacagtgattacttggttcagagtcctttacatatattgtagctgaaaggggatttattagtacgtggaattttgctgtaatgtacagatggtgtcactgcctagtttctactcggataatgggaccatgacaataagcactccggtgagatttggtccctggggtggaaatggcggcaccatattcgacgacggtatatacactggtgttcgacagatcaatttaaagcgaggattgggtatatcgacgatgaaggtcctctatgatcgaaatgggcaggctatatggggtgataagcgtggatccagtggggcagcaagggctgagaaggtgatgcaatttctgaatttcagcttctgaaaaattactctgaaactgcacttcagcttctgaattttcagtttcaaacttgtgatgtactgctactagtactagtcctgatggtatggagattttgtttgacaggtagtattcgattttccatcagagatcttaactcacataactggttacttcagttcgacgatgatcatgggatcaacggtgatcaagtctctgacattccacacgacgaagaagagccatggtcctttcggggatgagactggcacgttcttctccagctgcctgaccgaaggtaggatagtaggattccatggcagggatgggtggtacatcgacagcattggagtccatgtccttgaaggcaaggtgttgtcacagagagctgacagagcattgaccgaaacgagcccgtctcggcacgccgatatgcttgcagtagcacagagggaaataggagatgaggtaagtgtaccatgtcccaaatgctaaattgcaagaagtattagtagattttcagaacatctttttctgtgttgctgatagtgaaactattatgaccaatgaaaaaaagtgttttctttttttttgtgagtgtgtaggttacatatggtgtggtgaaagaaccaataccagtagggccagggccttggggtggcgagggaggcaagccatgggacgatggtgtctacacaggagtgaagcaaatctacatcatgagagccgatttcatcggttctgtgcagattgagtacgacaggagtggccaatccatctggtccacaaggcacggcaacggtggccagataacacacagagtgagtttgattactcaacttgctcacctattttcagtaacaaaattcaagctgtttcataatgatccgagacaatgtggcaaagcagatgaaattgtctgcactgcaagcatcaaccagtctcatgtaaccaaagcttaaagacttcagatgagatttgtatgatgctaattaatcaactgttcaccaaaatgccggtgcagatcaagctggactacccacacgaggtcctgaactgcatatacggctactacaacacctgccaggatgaaaggcccagagtgctgaggtcgatcactctcgtcagcaaccgggggaagtacgggccgttcggcgaggaggtcgggacctacttcagctcggcgacgacggaagggaaggtggtcgggttccatggccggagcggcctgtacctggacgccattggcgtgcacatgcagcactggctgggtgacaggaacagaactgcagctcccagctctaataagtactacatctccaagtacctgttttgattgagctctgcagaattgtgttcttaactttgtgtttgaagcatatgcttttgatgtgaagtccaaagtccaaacactttcagatttgaagagtggcgtgtgatttattgtgtgaacttaaaattattatccgtgtgcatttcctagattcagaggcctggaatgatttgatcatcttccatatgaaacaaaaaacatcagaatgtatgtgatttatttgtccggtttggagatttgattctctccagcaatggagttgtttttttttctttcagagaagtgataggcctaccgatcagactaaactttctgtcgtgtcaaagatcaccaaaagaggtagtgatctgatcacgatttcgttgtcatgtttcgggttcagtcgtcttacgtttgcccagctggtttccgaggtggagtcgctatgggatgaggacatcctggcgttattctttctttcactggtgacatcaaaggcggcaatgcatgcatgaagcatgacgtttgatgtgctttcaggattaaaattgctgcatttgtgcttgctgctggtaaacactaaacatgccatgttcttgagcccaacctggtggagagagcaatgcagagggagtagagtatcaatgctaatttggactctagctgtgtgacacaggtttgcagagagattcagagaaccggatgatggtgaagtgggtgaggaacagggcaagtggcatgttcactagtagcaaccaaaggacaattcgagcctagtggacactctatactagtagtactgccacgcaaattgctggactgaaattctgtcaagtctgaaaggattggatgaaccttgccaaaatatggtagtacacagcaggatttacttatattccaccatagatcagacactacgcacgaacgatcgtgtgtgtgccggtgtgtttaactaatgaaatgacggtgatttagccggtgccatgatttgtcctgatgaaaaacctcgctggctagctcagctagctgcgacgaacatccatggagagagataagattctgtgattctgtccgtccaaatcgccgccctcttttttttctggccaaagtaggaagaattcagagcagcaaaaggaattgcagtttcgcagggccacacgaacctgtcggatgcattcgctctggacagttttgaactcccctctggacgtggtcatcttaggagaggaagcaaaggaatcgtagggctgagaaaagaacccgtccatgttcatcctccaggcaatgcatgctttcccgccgtcataaacaatgtgctgtaattttcagagtcctcagggtttcagatccttattatttgtccacgagacttagagaaatgatacagtggcgcatttgataattggtaatattatgtgatagggaggctcacggtcatggagaatctcaccgacccggatggatcgatggatggatggatgcagcggtggaaggcaaagtcaatcccctagctgggagtttggtcggcaaatctgaagaccggtgatggagtagagtagccatccagccactagtggcgcatttcgtctagaactagtagtattacgccaagttttctttttttgagaacttattacgccaagttggaatagaattacagggatttcttcctctacctcgcctatcttacaacaggtacaatagcagactataaaccagctataaacacatttcgagaagattagagaggatagaaaagagcagcaggatatagatttgtagatagctgcaacacaaactccaacatgcatttgtatattacaggtgggacaaaatattaattgtgtagtattccctccgtcctataaaaaacagagtctagaatcggatataacatgttactacgaatctagacatatgtatgtctagatttgtagtattatgatatgtaacatccggtattatattggttttttataggacggagggagtatatgtttatagatagctattgaatgaattaactactaaattgactatatgactatagatgatttaaggccggttcttctaattagcttggcgccaacaactatccgatcgagcactgaaatttcgcatgtcgcgtcgggcgggggggagctgccactgccaccttaaagcgagccgcttctggaacgagatctccgctgttgcgaaaatcttccttgggactcgcgaaagacggggctcgaatgactcgtggccactggattttaaactacgcgcgagcctacttgcctattgccgggaaggccacacttttgggccttttttctcatgctgcgtccatgacaatagcatggcatgttggggggatttgttcattctctctcccggttcaggatgagcccccggtatcgatcggataatttttttagcatgtgttttttaaccatccaagcagaaactccaagttgttgctacttttgaaataaaaaacaattgagaaaacctcaaagaaaaaagagcaaagtggtagctacactaaattgcaagtttgtccagcggatataatatatttaacagccactactcctctcggtgaccttatttccacctgaattatatgcgatggaatcatggaataataactttgtaagcagtagtagcagtcaggtatccctaaattgcaaaattgtccagcggataatatattcaacagccactacttctctcggtgacctgattttcacatgtattatatgcattacttttacatggaataataactttgtgaagagtagtacttgtcaattaatgcctccatctctcaacagataacaccattgacttttggcacaacgtttgatcactcgttttattcaaaaaaatgtaaatactaaaaaagtacaagtaatgtttaatttttttaataaaaaacaagtcacaacaaaataaataatacatgtattttaatttttgatatgatgaataaccaaacgtcataccaaaaatcaatgaaacaaaggaatataactatatactacgtatcttaaatgcttccagcatgatgtacagttctctatctcctggtgatcttgttgaaagcaaagctcctcaatgcacacatgcagcacagcactagccaaattcccagacacccacatccctgtgcagggctttccacgcacgcaccggcaagatggatagagatatatcctgcagctcgatcgatccctatctgaaactgtactgcctgtgatacgatcttactccaactctctgacggataaggcttcatcttgagcctctcgcagcttagctatatctctctgctgccgctagctgatatggctctctcgtatccagtcccgatctcgatctctctccaactgggtcggccatccatcgatcgactcatcaattcatgcctctcgatcgcgagcatatatggtcatcatcgatcgatcagttcatttcagttgctggatggaccaaatcctgtgccttttgagatcgatcgatcaaaaagagaaaggatcaaagctatagggaccaacaaccaacggccggtcgccggctggctcgcacatgcgcatgtcgtagtagtacatatgcgttggctgacacacatgatacacgtactacacgcatcgactggtgatatatcgatccatctccatctcatctgcatggcaatggccatatgctgcagggagagaccacaccacccactgtctctctatccactacatcttctgtaatctctcctatacctcgcaagtatatacgtgcgagtgcatgcagatcgagctgatcagatgagatcgatcgatcgatctttgcaaaggcaaaggagagagaggaggcaaacaggatggagaaggcactagctagctgtagctttgttgctcaacgtgcaatgctgggtgtagatgatggagtagggggggagctagggccagatcttggagggagaagcccttttggggatttggttctttgcacaaatgcacaatgcttgccgccgctagtggcctgcatggatggatagatggccctggggtgccaccatgcatgcatcaccggacagatggatagatcgcaacagatcacggatacatatcgatcggtacaatgcaatgcatccactgtcagcagctacaatgctagtagcctagtaccatatcgatctttttggttctcgggtaatagctcagtacgacgtactaacgtgccaaacgaaagcatgcatgcagtacttctagctgtggtacaaatcgacaagtaccacgtactagtgtacgcatggatgtgattaggctgcgttggaagaagtgttgtggcggagcaactgctatacgtacgattttttttagatgtttatacgatgaaacgtttctctcctagcccataagtgctcttgactgccacgtgcgtatgcgccgtgtgctcgtgcccgttatcgtactaagatcgtaagaaaaaaatcgtacgtacatcaatttcctattacaaacctgaaaatatattcatttgatttttcttttttagaaaaagaaaacttctgtatagaaaattttgcacaacacaccgtttagcaaatccaggaaacgtgctaacgaaaaacgagtaataagttgatgttttgagttgccaaaaagaattcagccttatttcgtactcctccatcattgccaacgagtaattcttaatgcatttgacgaagttaatgtctaacaattaaaattttaactactagtaacttttaaaacttacagtttaaagacaatacaatgttatgcatagattattagtcctaaaatgtattttaaaaaattaaatatttacttgttttttatatattataatagaatcatatagtaaaagataaagatatattttgaagatcgttgtcattgtttaagacgttaaaaaactgggagagctactatatatggtatatgcactagagttgtataaaaaagatccaactctaatataattctgatgtataatttgtgtgcgagagagattgagaaatgggtggtttggcagtgtgatgcatgcatggcggcagggaaggcaaacaaaggtgcctactgttggcgcctccctttcaatgtctccaggaccgttgaccgatggtcaacgagcagcagcttagactagccacgtgcagcgcgagggggcgcgacgacgacgcgtggacttttgactgatgaggccgtgagtggactcgcggcgacgacctagtctctcttgacatcgactaatccctaattaaattaagttaaaccacattcttcccatgattcattagtgtcagttagccttaagagagattctgcgtgtgtgtgtgcgtgcttttgttttaagtggggatcgtatatagtttggccgtgttctggccagataatattagtggcgcttttgaccagagatatgcacgcgtgatttctgacatgtatggagacgatctcagtcaggttaatctgaacttggattgtagctgtttgtttaatttgtagcggtccagttgattggaacgtactacttggttaagactaattaattaccatgtgttacaagcatgtgacttaatacagattaattaattaaatatataatatttggcataacaactgtcgaaaaaggcatactatttggcagaacatcatatcgatcctaaggataacgcacagatatataatattaaatactaaataaataaataaaatagacacgctagctagactagctagcttggagtaacgggggcacgaagtcatgtttagttcccacacaaaagttctacgtcatgtcgcatcgaacgtttaaacacatgtatgaagtattaaatatagactaaaaaataactaattatatagattgcaactaatttacgacacgaatcttttaaacttaattgctctatgatttgacaatgtggtgctctataaaaatttactaatgatggattaattagacttaataaatccgtctcgctgtttactaacggattctgtaattagtttttttattagtgcctaaataccctatgcgataccctatataatactcgatgtaacacgctaaaactttacacccttagatctaaacacccccgtgatgtagtagtacaatcttgttcctagttggagtggtgcacactcccttcgttttagaatgaaagatattttggttcaatcataagtaacttttttattgaaaaaaagtaagtcatacatccattttttaagtaatagatgacgtcgttgatttttatcacgcgtttaaccattcattttatttcaaaaaaatatgtaggagtaattataatttattttgttgtgagttgttttatcattcaagatactttaagcatgatttatattttatacatttgcataaacttttgaataaattgaatggtcaaatatttattaaaaaatcatcggcgttatctattaaaaatggagagagtactaactaagcaatccagtcatatatgtatctaccaataaattgatcactctaggattaacatgtttttttttatttttaatgaaaatttctagagacatttcgctaggtgagatgaagttaaaatgacttgattgaataacagcatagctagcaaaaagaatacattttgagatttaacataacaatattcctctaattaagttttttcccttgatatatttaagtctagctagatgcgagtaaagatcgttagctttgaaataagatatataacacattttgagatttaccagaagaaaatcctcttcgtaggtatagtcagttaataaccttttaacataaaaatcattcatcttattaaaaaaatatatagtgctttcatttatttttctgttatctttttactattaaaggtgatttaaccataacttatattttcagtgattaactataccacttttcatagagaatctcccttaaaatctattgaatatagatataatatgattatagtataataacattgtaattaacttatatccaatcatacaaaactcagtgttatgcaaacaaaactcagtgtgaaggcgaagtcacaggatccagcgcgcgcatgtttttttttcctcacctccgtgcacgaatcggcttaaagtacacctgacagctaaaaatttgaaagatgttttctctgattttctatcaaaatatattaagcaaatctgatacactaaatataaatatgatgaatgataaaagcgcgttgtagcatgaacgatttttaaatatgaagaatgttcaaaagtcaacagccttctatctactacatttattcctaaatatttgacgctgttgacttttttaaatatatttaatcgttcgttttatttaaaaacttttgtgaaatatgtaaaactgtatatatacataaaaatatatttaacaataaatcaaataataaaaaaattaataattatttaaattataaataagatgaacggtaaaaaatatttaaaaaagttaatagcgtcacgaaaggagt

SEQ ID NO: 9163 - DNA, 7883 bp, Oryza sativa
ccaatccgtgctactggatttgcgcacagctgcacgtgtacgaccgacgaacgtgcgtcgtacttgcgagagtgtataccttcacatatgttcaaccatatagtaaactccatattgtagcatatctatttttacaagcaatatataacatcattgacttttatatatgttttatcattcgtcttatttaaatttttacaaatatatacaaatataggtaatgtttaaagaacatttcaatgataaattaagtaagaataaaataaataataattatattttatgtttaaagaacattttaatgtttacgtgcgtacgttcgtagtagtgagtgtacgtgcgttgtgagtgtctgcattgtactgtgtaattcttaaaaaaaataataatcatatttttttaataaaataatagtcaaacatattttaaaaataaacaatgtcgcactccctccgtcccataaaaagcaacatagtattaagatgtgacacattttaatacaacaaatctgaacatataggatgtgtcacgtcgtagtacgaagttgaatttttttggacggatggaatatattataaaaacggaaagagtacaatatatcttaggtgtagctatatttatggcgccatatttttcatcaaaaaatagtcggcatgtatttatattgtaagtccctaaattacatatgtaattttagtgtatttacaatgtaagtctcaaaattacatatgtaagtattaaaattatatatgaaaattcaaaaattacatactaattacatatgtatgtggggtataaatgaggtgtaactactgtgtaagtgactgaaaaaaaatcaactgtaacatatggcgccatatttctagcaactccgtatatctttagttttcgcataagaatacacgtatatggtcggtacaattatgcaactccgagggcaaagctagcgctgctgcatcacggcgcgttaggtcacgcaatgaactggataaccaaatctcatttttcatggcgtataatttccaaaatctcgatgaaagtgactggagtactatatgctagtagcaagtagtacgtatattaatttattttctatactagtacagctagctagggtgtggtgcagtgttagcaacatttcttgccgacatgtacacacttgaactcctatggctatggcgttcatttgagtatctttctgcatgcagctgtgtaaacattatctgtaattgttgcgtacgccaataagattagtttgtgctattattctctacaatcatctctgactaatctgtcaatttttctactgtgctactgcgaggaattaatgcacggaatgatcatcgtgttttcttacgacatattgctggtggcggggtgatcgtcctcacatcctgtgttgatagatttggctgatcagatcgactagtcgtttccaaatactcttttactaattggtacagttaatcgttaacatcgtcgtgcaggaaccccacacatacatacatacacacacatatatatatatattttttacctcgtttttcatatatagcaccattgatattttaacaaacatttaactattcatcttattaaaaattaaatatagaaaactaagttataattaaaaattttgatgattaattaagtcacaataaaataaatgataatcaacggcccctactaaaaatgacttttttgaatgggcaccccaatagtttacggacggatcataagtgttcgtgtatgtaaaaatcgaccctcatttttccatacagctccttaagatattcgtatgaaaaatatttttttcgaacagaccacttaaaatatccgcacatgaaaataagggtattttcacatgcgggactcttatctcacccgattgcaaaaaatacccctagaagtttcccactcctttttttattcttcactctctcattctctcccccccctcacccccactccactcctctcctctcccgctctctctccccatccggcggcggcgggcaacgatgatggtgagggcttcctcctccccccctcctcctctcccttctcctccatcccgacgttggtggagggttcgggcaacaggggagggaggaggaggggcgcgatggcgtggattcgacggcggccaccctccccccatgcaacggtggtggatcgacattggggaggcactggaatggcagattcggctctggctctagctccagcaacaggagcgggcagacccggctgcccctagccggcttcgaccaacgacggcgacgacgaggagggcggcggtttctagggttatgttttcgtgatttctagtttctttttttcggatttctatttttacgtgcagacgacataagcacccacacgcgaaaatcgtactttcgcgttacaaaaatagcgagttccgtagaccatttggtgtgtgcggatcgttttaccacctgcgaaaaccagattagaccatataaaaaaaccgaagtcatatattaaaaaacaagccacaacaaaataaatgatagtcaacgcgttatatattaaaaaaataaacaaatgtgtgtgggtatagaattaaatttgaaaatacactgtttattcattttttttcttataaatattcgggatgtaaaaaattttgcgtaaatatactgttgatctcgcataaccattgcgcgagaatgacgtgggaatgacatcgtggacggtatcgcgcggcgaaggcgcgagaccgcacggtatcgtgggacaacagcgcgagaccacgcggtctcgcggaatggtttagcgagacagaacggtctcgcgcaagcactgagcgagactggtgccacgctgattcaattagcgactaattatcttgattagcgaattattaattaagcactaattaggataattagttgctaattatcattagttaattgctaattaagtaattaagcactaattaaatggagccggtggacaatttcgctgtttgattccgcgagaccgaacggtctcgctcttccattgcgcgaaaccgcgcgctctcttgccttcgcggcgcgataccgcccatgacgtcatacccacctcggtttcgcgcaacggttgtgcgagatcgacagtatatttacacaaaaaaatttgcatcccgaatattcatgaaaaaaaattgaatgcatagtatatttttagttttaattctaagatgtgggccctgtgattctatgaagaggaccgaacgtagcaaccaaagcagataaacagtactactccccggcggcccggcttaatgccccggatatggttgcagttgcgcaaggaaatcttatgcgtgcgtgcataaggatcgtgtgcccgtacgtgcgtctgttcatgtatgcgtgtgtgcgtagtatatatgcatgaatatgtcacagtacgtaatgcactcgtaagcgttcattctagctatatatacccacatcttacaccatgaaactatctcgtttcaaaatattcctctcagcaaaaaggtcgttgtcaaaccttaagtacttgtgtggtcgtattcctatatattccacacatcctccggtagttttctttatgtagatgtttaatttaaatttgtactaattgggattggacttttctttaagaacgaaatcatatgggcgtgggcacgtaccaccttgacagacaggcacacgctgacagtgaaacggaaatcctaatttggatcggtgtacgctagctcgcgattaacatgacagacacgtgcaaattagtatatatcaatttcccagaataaaaggtaaaaaatcacctacaaggctacaaacacgtatatagtcggatcaaaataatcatcgtgaggtgccaataattaaggtaacggtgtggagcaagaacccaacaaaaccaaaaaccagacacggccgtacggtgacatcagaagagatgttctcgctagctacgtgctgatcatgcaggacatcgttggttcgcttgcatgtgcaatgccgggtgacacgatcgagatgtgatgcgatgctatctcggcgcgagttaatgaggatgagccaaaattagtgctcgcctcatcatatccccggaatttgactgtttgaaacgcctgcgcgcaggatcgatcggctacgttgtctgtacgcgcgcggcgttctcgcgtgacgcactttggcagatccatcccgcaagagatcatctcgatcggcgcgtcctctcctccccgtgcgggccgggacaaaccgtgtcgcgtcacgtattttatctccgtatatctcacggcctgcagtccggctctcgctcgatcgcccgtccgtgcgtgcatgaaaccaccatcaacacatgctcgtgtcgatcgatctgtataccacgtaccactacgactacgcaacaacacatgagtaggtttttgctctcaacatgttccgttttttcccactagaacgtaggttgtgctagcttttaattctggcacaaggttgttgcagcgatgtgcatttatgtgccagtaccgaccatgtgtaccaaactaatcggattgatcgatcgatcggtccaacgcgcgaggtgccggcctgtgcacgcgcctatccattggccgcgccgcggaatcgtacgtaccgctagctgctgggctcgatcggtcgatggaccggccggttccctttcgttgtcccactccgccggcgacaactgtgcatgccggaccgagacacgccggatcctcggcctgagccagcggccggccggggcggttccaccaggtgcatctcctttgatcgatcgatcgatctcctagacatcatcgttgttagtgatcaaagatgtgatgggcggtacgtgcagcattgattgctcggcgtgacgatctctccaatcggagcgatggagcggcacttacgacgagcagagacgggacctcctccgtgtcattaggaaaggatcgcacagtggacagatgatgacaattgacagtctggtaacaatgatgatatccttatattaaaaaaaagaagaatgataggtgatatatatactactacgtagcatcacagtataattgaggagaaggattttaatcactcaacggccggtgagccgtccagaactacgcatcgatcaatcaacgtcttttaacatcgactaaaaatgtttgcgtgccacggttactagcgacacgaatatatcgagtatatagtggagtactacgtgaagggatcaaatcaaggtggatgaagacgtaccgacacgccatcggccttcacgttattacatcctaacgctgtgcacagtacgtgcccggtgcccctcgatcgccctcgtcttataaatgcagaagttgacgcctggcgtacgtgacgggctgaccggcatgcatgcatcgcgtgctacacaggtgagggccggccgggagctagcaacgcactcgggacggcgcgctttaacgcgcggccaaattaagcagcgccgcggaacacacaggactcgaccgatcggcacgggcgggcgcgcgagctaggtgccgaggtggcgacgtcgcatgggcgcatgcaacgcccagcaggcacgcacgcgagagacccgaccgatcgacaaacgtgcgagcaattcgatccgtgggaccgaatcgggcagggggatctctcgcgatatcgatcgatagcgatcgagcgccggcggccacgcgaaacatgcacggtcgttgattagctacgagagcctacgactctagcaaggcataggcacacggaccactggcgccgcgccgggcgcgcgcgcggtgccgggtggccgatcggctagctataggctgctgcatgctggatcggaagggaataatcttaggtcgactccagatcgacgacttaggtaagcatatgcatgggaatgtccgtttgctgctggatggtccagtagatggtcctatagctcgcaacgtacgtactgccattaccagaaggaatggaatgcgatcgatcggtcgatttgccggaacactgcaattaatgctgcatttgagcaagttcaatagtatagccaactgttggctctaaatcatatatagccaatttaatagcccattcatataatagttatctataaaaatatacacattattaatacctagtcttacctctcatacactcataatgtattagagttcgtgttgcagccgacttcaaatctgtagcccgatttcttctctctcttctcttttcttctcgatatgtgattatagctggcttatagcctgctattgtacctgctcttatgctcttgcgacttgcgaggccggtttttggttgctattgacttgatttttagtctttaatctattttttttccgtttgaagaaaaaaaataaaagcattatttatcctttttattacatagaagatgcacacacatctcaacacacgcgttcaaagagacaaagactaatggtagattttttttttactttaatccatacggttctgaccttttaattagataacgatatggacttcaaaatatattctttgactataatttttttattgtgcatataaaaagtaagtaattatttaaaatatttttaagactaacatatgtattacatatcatgttctagtagtctcttcaatccaaaaactattagcaattaaagttttaattgtttgacctctgtctagtttaaaacatcaagaattacgaaactggatgactgtagtactaaaatttgaaagttgtgtatcactccttatttggtttctcctacattactcgatttttttttgtttcagaatataccatctgaaaactcaaaactgcatgtgctattatcttttacttttatgctcccaattcattgtgtgcatttattgtgtaaacaacgatccgacatttattgtacctcccaattcttccctcctcccatctatccacatccactatccgtggagtcgctttagttaggacgatagcatcgttttgtattgggatgacaggaatgcatgcatatctcacacttctgaaagctcggacgcactaaactaaggattgattagaaagagtggtgagaagaggagagaaaagaaaaatgtgcctccataaagcaatatatgggccggtaatgtttctgatttataggataatttaagaaatgttttgtgtgttatggatgggtcgtaatctaagggcccctttgaatcacaggaatgaaaaaacggaggattaggaaaaacataggattctgacaggaatgtaagtgtaaaacagcggattgcaaaacacaggaaaaacataggaatgaccgtttgattggaccacaggaaaaacacaggaatttgaggagagatagactcaaatgatttcttccatgaggttctatctcttgttaaaattcctccaaaacttgtatgggaagaggcattccataggaatttcataggattccatagggtttattcctttgatttaaagggctttgtaggaaaaaaaatcctataggaataaaatcctctaaaattcctatgaatttcctttgaatcaaaggaggcctaactatacgtcgtaggtgggttaaaattttattctgtttcaaaggtgtattctttattttttcacaaaagcgcaaaagaaatgcacgtaagtatagcagtagaaatagtgttttttctgttatataacgcaattgaccagactggccgttaaggtgtattaattcttttattaattggcatattttgatatgaatcatcatgcaaaaaataatacatttgaccagcatcaatttgtttaaaacaatccagataaactaagtaaaacatattacctggtgccatgaaatctttttatgaacgttatattatactccctccatattttaatgt

SEQ ID NO: 9164 - DNA, 17934 bp, Oryza sativa
aaagctgaagtaaaagaaatgcaacatgaaaaaaaacatttcggtgagcttgaaacatcagtgtgggctgattgattacggcagagcgtgcaagcaaaactaaagccgcagaaatgctttacgtattttgagatgaggctgggaaattaaaaggtatgtcgtcacttgaattttgaagtggaaatcggtactacaaacagtacactttgtgctgtacgttcagaccacgcaacatatcacaggtactgtacgtatatatacgtgcgtacaacacaagttgataatcgatcatgacctccttgcattggtccctatagctaactcaatgtcttggatcgatcaacagtataacaacttatagctcgcgcatggctagctggttctttccatgtacgtttggtacatgattggtgcacccgtatcaagttgcaaatccacaacatgctcgcgatcaattgagaaatggaccactcactcagttcacacaccatgtatgtatatatatatatatatatatatatatccaatcaagccctctatagtgtgactagtactgtctcgatttatttcttcttgatgaacactcaatttttttttttgcttttatgaacactcaactatcttatatctcagccaacgattgagccacatgcttacccttacatcatattacttgaatgttggcgtttgatccttatttggtgaagctcgagattctgagtagcggtgagaattagtttaaaaggacatggattttaagctttgtattctaaattctacaattacactaaatacacataattaattttaaaaataagctgcaacggctagaatctctaagccacggatatctcagagctaatacgcccgactgcaggatgcgatcatatccggatcaccttttatacctatacctatatagagagctagatttaacctagctcgcacgaccaagcacgtgtacgcactacgcactctctaccgtgagttaattcgcgcgcgtgcattaactggagtctggaaatggtctctgctggcctggccggccggatcgacccgggcggccccgcgtcgcatcatgtaacaactctcacaagtcgctcgtatccccacccgccaaccatgtcttgtccctcacgtgcgcgcgagcacgtacatgtgagaaaataccatgtcctccgctccgattccccagcgcgcgcccctcgcccggccgaaaccaatggccgaattctggtgggcgtggcgtgcggtgcagcgccgcaggggtcgtcgtcggatgggagagtgttcggaaaaaaaggcgaaaaggcgcggacgcagcgtatcctgccgcgatcctgtgcaatcgaggatgtggatggacacaagcgacggtttgctgtttgcattgatctctctcccgttgttcttgccgttaggtggcgcctagcgagctacggttggagctagctagccatccacgcaagcagcctagtatgagatatacggagcatgtgtgtgcgcaagcctgcaaggccatccagccgcagccatgccttttgttgacacactgaaaccgagatgttgaccatcagctgctgttattactactagcacactgctagttgcacatctttctcctttttagctgaagatttggtgcagctcgtactttggtaaaatgccttcctgatcccgcagaaagcgagcggattcggggtaaagctcgatgctgctgtagattctccccatctgcatgctctaacgaaaggttggtcaagatacggaaacgggagaggatctggatttcttttggttaactacctgatctcatctccctaaaaaagctagttagcgactctaagattggattatagtacgtacatttgggccttccctcgagttaacacgcctaaagaactcatctagaaagttcatcgcacatggcagcaccaggacggggagccggccgggcggcgtacatacgtcgccttagatcccatttgccaatttggatcatatcgatcaaagtgaactaacccagccagaatgcaagaggagaagtgagatcttgttatctctgaacctcttgtcgttggttcagtatgatataaattcaggccgatcactcgatccccgatttgtttcccttttttcttttgcgattggagtacggatctagttgggcgtggctagctgcctgcctggcttagctgtaattccgaattctgcaccggccatcatatgctggggcgggcgagtcaggcgcgaccgcgcgagatgtgcatgagtcgtggcgcgtcacgggagttgtttattcagggggggcggccgtgttgtgctcctgcgtcactcagctttttctctctcctatcctcctcggtctccccccctttcccactttgtcagttcgtcactccaccaccgcctctctctccccgcctctcgcctataaataccgcccccctcgcctcgccaccaacactcacctcaccatcatctcttctcctcgtgctcgtcactcgcgagcaaatacatcgccatctctcctcctcctccttgtcgtcatagtgcacgcaaagaaacacggtttgcaatggcgtggtgcttggtgttcatggtgttcttgatctactgcctcatctcgactgtcgggctgccggtggcgccggccgacgaggcggcgatgcagctgggcggcgtcggcggtgggcggctcagcgtggagccgtctgatgtgatggaggcgtcccttgactttgggcggctcaccagcgccgagccgctggccgtgttccacccgcgcggggccggcgacgtcgccgcgctggtgaaggcggcgtacgggtcggccagcggcatccgcgtctcggcgcgggggcacggccattccatcagcgggcaggcccaggcggccggcggggtggtcgtggacatgagtcacgggtggcgcgcggaggcggcggagaggacgttgccggtgtactcgccggcgctcggcgggcactacatcgacgtgtggggcggcgagctgtggatcgacgtgctcaactggacgctggcgcacggcgggctcgcgccgcgctcgtggacggactacctctacctttccgtgggcggcaccctctccaacgccggtataagtgggcaagctttccaccacgggccccagatcagcaacgtctacgagctcgacgtcgttaccggtgagcaccagacaaaacctgtacagcatctcctcaaacttcttcttccccacctcctcgccccaaccaaccttccgccatgcaagcacacacgacagttatccctcgtaagtttctgacgcgtgtccgtcaccgcgattcttttacagggaaaggagaggtggtgacctgctcggagtccaacaacccggacctcttcttcggcgcgctcggcgggctcggccagctcgggatcatcacgcgcgcgcgcatcgccctcgagcctgctcctcacagggtacaccccgaaatcccacccagcccagccgtcacacccaccactggctgcgtacgtacgcacgcgcgacacagtcacacacatcatcggatcacctcactcttctcctccttccgttgagctgatcgagcgagcgatatgatggcgccgctaatctacccgttcgctccccgtgcgactttcccttttctcggcgtcatctcactctccctccagggcttggcacggagcacgacgtgacgacgaccccgttcttttgcgtcaccgccctcgctttccaactaatggcccaatagggaactgaggcatcagcgagcagccatgcaagtggcggccgggcgcgccacgccgcgcgagggaaagcgagcgattgatgcgcgctgctgggctggctgatggcctctcgggggatctttttgttaagtaccgcaatttcaccacatgtcgatcgaaaccccacaaaggggcacggggcacccaattgaaacgtgttgccaattgtggccgtcgcaaaggaaagtcaccgttgggagctgacacgtaggacaggatcgatcgaccagcgaccgagcagggggtagtgttaactttatgttgggtcgctgttgaggtctacggtctccgagaaaaagcgtctggagatgggatttttttttttgtgtgcgcgtcgggtcaggtagtggaccaggttggttgggaatttggggccgacccgatggatcgaccgaatagtttgtgctgaccaattggtggtctgcttataaatatactctatatagaagcgtttggttagctgatcgtgcgatcactcacaagattttgttgtcatatgcagctcaattagctaactaatccatgctaactaagcgtgtgtgatctaacgctgattaagctgtgtccatatgatcggtacggcccgtgggtaataataatttattaatttgtcgttctgacctgcattgccaggttcgctggatccgggcgctctactccaacttcaccgagttcaccgcggaccaggagcggctcatctccctgcagcacggcggccggcggttcgactacgtggagggcttcgtcgtcgccgccgagggcctaatcaacaactggaggtcgtccttcttctcgccgcagaacccggtcaagctcagctcgctcaagcaccactccggggttctctactgcctggaggtcaccaagaattacgacgactccaccgccgtaaccgtcgaccaggtgcgtgtccgtcgtgccggcgcgatcgcgcggccggcgccgtctttcctgattcaccaataattctctgcctccccccctgaccgcccatttgtttatgacgaaatttcttaattattcctactggagtagtttagtactctaatggcagggcacctagtcaatcattgggccatgtttttagttagttatgggcggtttagtcaagctctctagtgtaatccaagcccttgatgattgtatgattgcacccacatgctgagcacagtggatcggtggatcttgcaaacgtactagtagctgtctagatcttagtcccactgacaaaacatgcactattttatcgaccacttaattaatcaattaattacgcagtactagctattaccactagtatagtactatacgcaagtgatgaaaaagaaagacgaagtagatcattctaaactaggagtttaaataattagtttcgatttttttttccaggacgtggaggcgctgctgggcgagctgaatttcatcccgggcacggtgttcacgacggacctgccgtacgtggacttcctagaccgcgtgcacaaggcggagctgaagctccgcggcaagggcatgtgggaggtcccgcacccgtggctcaacctcttcgtgccggcgtcccgcatcgccgacttcgaccgcggcgtcttccgcggcgtcctcggcagccgcaccgccggtggccccatcctcatctaccccatgaacaggcacaagtaagcagctcgccacactcatgcccccatatactatatccagccaatctacctgtcgtaacagtaatccagtagcactcgcgcccgcagcgtcacatgaagcgcggccgtcctctcacatgcggcgcaacacgggagggcgcgggcaggtggccgatgggctgcggcgtgcgcgcccgcgcgcgcgcgagagagagcgtcccatgattggcgcgggataaacaaatatacctccagatgggcagcagattgcacaggatggatcgtgctgccgccatactttaattccgaaacgcagccgccgcatctccggtgactggaattggccgcggacataccgcgcactagggcgacagggccctattctaatcgctgcgtggtggcgccatgccaatgctaggaacagaacagaacagacggggggcgggcgcatcatcagtcaccttcaccgccttgcgccgaccggttattctaaccagggcgcgcgccgctcccgttcccaatcgcctttccacggcaccagttgttaagcttcgctagtggccagattgcacatatgtgttgtcgctttcacattagtacttaacctgaaaggacgtgtcgatcagaatcagcacagatcttgctgctaactgttgttgcttttcctactctgctccaatctttcctctctctttttttttctcggtggatttaaatactaaagagaacttgatttgcgtacgttgcaggtgggacccgaggagctcggtggtgacgccggaggaggacgtgttctacctggtggcgttcctgcggtcggcggtgccgggctcgaccgacccggcgcagagcctggaggcgctggagcggcagaaccgggagatcctcgagttctgcgacgaggccggcatcggggccaagcagtacctgcccaaccacaaggcgcagcgcgagtgggaggcccatttcggagcgaggtgggctcggttcgcgcggctcaaggccgagttcgacccgcgggccatgctcgccaccggccagggaatcttcgactcgccgccgctcttggcggagtcctgaaacgaagacgatcgacgaacaagatgatggctagctaggcgcatgtaattagtaagaatcataacaggtgattagttagtcttaatctgatgtgtagattcctcgccccataaaaaaaaatctgatgtgtagacaattctgtacagagggatgtatcagtttcatgcaaaatgtgtgcaatgtttttttgccggtaaagtcggcgtctgcctccagttcctcttcgaagcgtcgtagttacccaaggacgagatatctcaatcactgatccatcaacaggttcaggccctgttccgcatggactaggaacagattagtgacagaatctggctccttggcgagttgtatcgtgggtgaaagtcaagttcgaaagggaaagaaaggatggttacctgatacacgtgttttggcccgtcggtccattgaccaataccataccagcaatgcctactgtaactcctgtctccgttggggcctcacatatacagtagtattctaggttgttgcactactcctaaacagcatcaaaggtcgaattgtactacaactagtactcaaactattgacagtaccaaggtactatactacccaactccacactgcaaaagatcctacttccgtggctgcaaattccgttcttccgttcatgcacttaagctgctcatcgacccgtcaggcagtgcaacgtcacgaaggcacggagcatgtccactttagcattacacaagaccgaagacttaatgaactgaaaatcaggcgagtggcgacgcgcgccgcgcggagccgaacagaacagaaacgccgggttcccgggcggatcaacgggatggcccgcccgctgccgagcagcaaatttgcccagctttggtgcgtgcggagacgatgcgtaaagacgaaaaaagcagcgagaccgcaacaggcgccggcaagggaagggacggcttcggcggcatgcagcggcgggaacgcggccaggttcaccggctcttttccgttgatgcgcccacgcggcgaagtctctcgcctttgacatggcacccgtgttgctccacccgtccgtccggtcccccgtacgcgaacgcgactacgcgagtggctggctgtttggcatttttggctctaccaagagacgtcgcgaggagtcgagcaaggacgaaagcgtcgttcccatgcctgacgtgccgaaaagaaaatgtttgtcttctctgcaccatgaacagagctgcgatatggcaggatcgatccctctttcaccagggatgcaggcggtggctgcccggtctcatcggcaaaaactccaattaaatttagtattgatgagtaaattgatgataaaatttctatagaaaatattgaagtttgctcgagctaaaaaaaaatctttcagctccacgcctccaccactgaattcggggtgtgagattgtacggtgatgctactgcactgtggcttgatgccctgagcctgattgtctgataatttgattggtgcctgtgaatgtgattgctgtgattgattggcgtggctccggaaaatctggatgctggactcgaatggttggcgccattaaccagatcagtagaataataccagttccgttctaaagtaattatttttctacgattaaactttgtgttaaaatatttatcactctaaagtagtactccatcaccctccatttaaatttctccctattacaattatcactatatactcttaaccatacatcgttaaataagggttactatagttttttaaaaaaaaaacttttatctatatttaactagctagaatgataaatacttcctccatttcaggttataagatgttttgacttttatcaaaatcaaaccgcttcaagtttgactaggtttataaataaatatagtaatatttacattaccaaattagttttattaaattaataattaaatatatttttatactaaatttatcttaggtaaaaaaattgatattttttttctataaacctgattaaacttgaaacagtttgactttgaccaaaataaaaacataacctaaaacggagggagtattttggtacgaggaaatactaacggcaatcttgttcggcataagaacttcttcaggtttacaagggttcacggaactcgtggcccaacacacgggaatgattgggccttcaaaaaaggtctctcatgggccttggcctgtctactccatcttaagattgaaaaattgatgtcccatactcctatttctgattagattagtctgtcgcagacatgaaaaatcgtttttcacgtaggcaagtgaaaaaggccatgttttgcagtcgctagaatcttttgttctcatgaagtaatatgttgcttcgttcaagcaaattgaattgcagacaaaaagaaaatcggactattaatataaggtccatgaagttgcccccaggattcgtcctcgaactcacgccctttgcggttgtgttaagtagtatcaaacaacatgtgcagcagtccgcgtgagaaactcagaattcatttactgtagtacctcgaacagcatctactgcttgagacgtcaaatcgaatctactcctatgtatgtatatggccgtatccgtatgagcagaagtattagaagcttaggaataaaagcagtagcaatacctgttctgttcctaatccagacgaccagcattagcaaagtcgaaaaaaatccttatccccaggtttcatgttcttggcaaaccaccgaagttgatcaattcctggttgcttcgagacaaacccatgtggagcaaaatagcaagttagttcatggtttgtccgtacgtttttcagcaaccaaacttgaaacaaaaatccgtcatgctttattataaaactatttatgatcataaagtacagatagactaacaaggcaagtgaacgggtaaaaaaaaaacttttagagtgttggcaccggtgtcattagcttcaagaaaaatgatttacttctagatgcttttttttccaagcctatttataaaattagtttttaaaaggctaaaatacagagacatacacatatatatccaatcacctttaaaaggatcattcctcaatgatcatcttgatcttggattctcgatgggaaatcctctaagcacctcggtgactgaacccataggttggccactgggtgttggctaaagccaaccacaagagttgtgatgaatagtggagacagtcggggctcttcgtagagggagggggatggggttctgcaactgaactgatagaacaataatagatcacccacaaatcactttgctttgagctatgggactgtctactggtagaaaaaaatccgtcatgctttattacaaaactatttatgatcatgaagtacagatagactaataaggcaagtgaacgggtaaaaaaaactttcagagtgttggcaccggtgtcattagcgtcaagaaaaatgatttacttctagatgcttttttgcccgaagcctatttataaaattagtttttaaaaggctaaaacacagagacatacacatatatatccaatcacctttaaaaggctcaatgatcatcttaatcttggattctcgacgggaaaccctctaagcacctcggtggctgaacccataggtttgccgctgggtgttggctaaagccaaccacacaagagttatgatgaatagtggagacagtcgggactcttcgtagagggagggggatggggttccgcaactgaactgatagaacaataatagatcacccacaaatcactttgctttgagctatgggactgtctactggtacaattctcgtcgtcagatctgccaaaacaaggtttacaatatcaacatataaacttctttatttttcttttgtgaaaactagacatttcggtccgacttgagatagcaaaccattatgtaaacatgacattttttaatcaaactaaaatttaattttttgataaaatttagccaaattccaccagcaatcaatggttttcaaatggttctaaaaaactgaaataacctcctgagagcattttttagtgccggtatgattcacatgaaaaacaaaagaactgccaagttatctatacatgttagatgatctcgaatatcgtgtgacgcatcatacttgatcgactaataaatatccaaaaatggatattggaacgtattcacatgatgtagcctctctacacgtcatcaatattatctccgcaaaatcaacttttgattttattctttttatgtttataccgcgtcataaaaacaaggtacatgtgaaaccgtactaatctactttacgccatctcccacgtccccctcttcttatatttcacctccacgccccccttcgtctacctgcttgagtattccctaccttcaccataggcggagatcgagttccacatacggtattttctactagtactctatttttttctcttctatcaccattatggttgaatatttccttttcaaatccttaacccttgaaaccacagacaccattgtaggttttttcgcgacctcgaatcatctccgatagtgtcggctaggcgcgccacccatgcgcgctggcgacgctccgcgcagagcaaacgggagattatatggtatcaaaacaatgacttatacaccagaacaatgacttatacaccagacgagatccacgcagcatgttcctctctatttctttctttcttcttcctactagtagatctagatatatgatttcaaaactttggatacatatagttttgaggtcttccatggcgtacggtgaaaacttcctttttgcacggccctccccaccattgagatcaccgtttttttttttttggcctatttgcggcgcgccccggtcggccgtccctgtagctcagtccacccaccgctctcacttccatacgcggcccgccgcacgggtgcgcatctcggcgtcagaaagggctacagccctacagtgatggatcggacggaccgtgcggggaagaaagagaaacacatcggcgcaaggcgcaacctcgtctccgccccactcgccgaaaatataaattccccaatccaaaatattacccatcccccccctttttttttctctctcctcccttttcgtctcgccgccgccgccgccgccgccgccgccgcagtagagtctgcagcagccgcagccgccgccgacgcggcggctctctctgctcgccatccgcgtccggcgtaccggctgccgacgcaggtgagacgctaggccctttcctcccggccgacacgggatcggggaggcgcgcgcgcgtggcgccgcgggcgctgatgagatatggttgcggcgggggactagggtttgagggttagatgcgccggcctgtttggtttggctgttggggattttttggagtcgcgaaaggaattcaacgttgtctcgaggggaggcgtacctgagtttctcccgcctgcttgtagctttgcgttccgtatatatttccagtgaaattcggttgcccgcgcttcgtaacgaagggcttttggttttatatggatggtacttgtgtgcagtgatcatggatttctgtgggtggattatagttattctgaagccggtttggcttgagttttgagggcttagcacaggtttgactagcctgccattttgatactgtaaagtacacatgctgatatagtgatatttctggatttctgtggttgggttagttaccctggaatcggcttggcatgagttttgaaggcttaggcgcttagcacatgtttgattagactgccattttgagacagtaaagtaagcatgttgaatttagcacatatttccttgtttctgtacacagatccgaagtcaggctctgtacggttctacgattatttgatggagcatgatatgacagttgaagattttattagaactaatgggttaggggcaagtggattgatagagaccaataatcaaggtgtatccacttcttctgtgtctgattgtcggtcctgcgagcatgtcgagaatgggagcccttccacggcccctcccttttgggactctgatggtgaagatgacgatcctggtatgcaaataacactacttttgttcactgtgatgataattaccgtaataattcaaaatgatagcgctagagtttgaaatttttatagcctatttatgggaaaaacaaacagccatttctcaactaagagttatgattagttccttaggaagataatattatgttgaaatatgtgtctggcaggccagtgctggaaactgtaatcttgagggacgcgcattaggccctgtttctttcagcttgggattattataatccagattattgggagtaagcagaaagaaacaaacaacttattgaagtagcttattataatctgttaagctcatttaggtgagctttttccagattattgggtgaaaaattacccaccatgccaccccactccctctttagacttgcaaacccaataatctaggctccattctactacagattataacaatctagcttatattaatctgactcaataatctagattataataatcttaagctgaaagaaacagggccttagtatggacagagattacatgcttaaatttgctatgaagacctgaaagaactattttttctagtcatactcaaaagtatcattagtttgtttactcctattgtttcttcctcttgtacacataacacattcaacgtgccagtgcaatgcagttgcccttctgaatattgcacttttggccacctgtacttatctctacctttaagccctatgtttcactctgggttaaataactaggttaacttaactcatttcttgtgtttggcagcagacgtagttaacctaagatactgtttagcttgattagtatctgtttagctgggttgacagttcagaagcctagaagggttaattgtgtctttttagctaattcactttttggttattcgctaatcaccatatttctgcttgtatccagaaacagttgcctgaaaacatgtgtttcttgcttgcatcccaaatacattatgttacagttgacatatttttatgtcatcatcatatgccgtgcattcctatccatgtcaatatatcaccatgtcattaagttaacgaagcttcctaaaaacttatctccaaaagtattatttgccgttgtacatatgaattatttatccacgaagaatgctgttatccattctattcttggtctttgtaaagttgaactgagtttagggcataaaaagagttttggagtacacatgctgctgtctatggctactaatatatgttactagtatttaccaacatttttgtttgacagaagtgataaacctgcgaacttcttgtcagttacagttcttgacacaatagtaattatagttccatcttcaaattaacctgttttttttttctttagcgatgtttctttctttattgtaattgaataattgcagctacatttcatttggctaatctctgtcagttacctcagggcctagaccttcagatttatttgggcgatatacttggagaattgaaaacttttcaaaggagaaaaaaagagaaatgaaaagcgaaccatttgaagctggtggttacaaatggtaggattcctgatggtaacttactagaaaatttggtcacagcaattctcttttcggagctggaaactctaaattgcttagtagctcagtttgtaatgcattctgcttagattctctattccattgactgacaaatcactcatcactaattgttatttgtgcaggtacattctagtttaccctcaaggatgtgatgtctccaatcacttgtcattatttctatgtgttgctaatcatgacaaacttctcccaggtttgctgttattatgttggctaaactatcttatgtgttcctcacagtatttaatcacacccttaacacatttcaggatggagccatttcgcacagtttactatagctgtgggtaatcttgatccaaagaaagttaaatattcaggtgaggcaatctgtgattcttattgtttgaattaaacactctgtttcagagtttaactaagtaagtttgcagacacctgcacaaattctggaagaaagaacatgactggggatggaaaaaatttatggagttgtcaaaaatccaagatggtttccttgttgatgatgttcttgaaatcattgctcaagttcaagttatcaggtaggcagtttaccaattttcaggattagcacctaaaagagtaaaatttgtttgcagttctatatgattgaaataaattgcatatctatggccttatatgtaaagcattccacagatatgcttttagatatgtttttcctatgtccctgaaacacgaaagatcacttcatttaattgttcctacgatgcttttgtgctaagatgattttgttgggggcatttatgctctccataattcaagttttactcttcatgtgcagtttcgacttattgaaatcttaactgtaccctgttgtgagctgtataaacctttcttttgtttttattgcatgttgcaacatgttatactgcgatttattcaaagatctctctttgttaatgcctctattttctctaattatttaagtcctagcttctatgtttaatttgtcaatgctcaactatggtgtgctcagaaatttggttatatacttataaattgattgctggacattcagtaactgttctcttctgcttttcaatactggagggagaaagtggatcgcccatttcgttgcctcgatcgcccttatcgacgagaattactccgtgtctatatgaccaatatagagcaaatttaccgacgctttgttgaagagcgcaaaagtaaactttgcaagctcattgaagacaaaatgagatggtccaggttatacaattaaagttatcaacatcctgttatcctttcataatgattaagtatctgtgcgccgctcgcgtgtgtgtgtttttaaaaaagttaatactaacacatgcatatctttgtttgtacttgagtttccgtgccttcttgcttgcaattgaccaaagcacaaggcatcgcatgtcgacagagaagagtgattgtatacttgaaaatatagtgaaacatttctttgtggagaaagaagtaacttcaacgttagttatggactctctgtatacggggttgaaggcgctcgagtgccagagcaagagcaagagcaagaaaggcataatagactcagtggattttgtagagctgccagtgcctatggtccatgttgatgtggacatgtttgttttggctggtgatgtcatagctttgcttgagagggcagctttagaacccttgccttgtcagcctgtgtctccaaaggatgacaaatgttcccagagccgcactaaggtaggtatttttcatatgatttattcattcagtttctggactatacagttaataatattgagtttctggcccccaaaatgaatgttagtatttcttgtttcactgatatggaattaatttagtttagttcaaatctctttagtttgcatcctatgtcaaacttatttccttgtcttcccagtttccaccattatttgacctatttttagacagaaggccaatggcccagcttatattgaaagccaaagggttttacaacgctgggggttacccagttcaaaagcagcgcaacgcaggggaagtagtttgccttacaacagctttagaagctgaaacagagatggcacgcaggcccgaacattaaaaacaaagcaaaaagagccggggcatcaggaagtcatcccacaccggatctcagtgattgcacggctgccaggatcttctcctccagctggtccagttggacctatttaatattttaattttgcatcctctttcatgctttctccatagtttgttgttaagcaagaatgattctttttttcggagtttgttttcttgaaccttctgatttcaatgaataaatgtggttaaaacaatcaccaaactgtagcgattcattttcattactagctcttcttatgacatttcaatttgattggtcatgtaaagcttcaaacagtggttttaccttcaaaattccagtttggcatctttctgtactttagttaggagaatatttctatcttaaatattcaagttggatgaatagaatttctagaagtaaatttctctggtggtcaaagttgtaccttggagactgagaatcaaaacaaggcttctttgtgatgagacttgagtagtagtagaatgagagtgaatttcatttactttcccattttgtggtcttgatatgtgaagattgtaagcatttgtattacttgaatgcagtatagctatttatctcactgctcagtttttgtcattctcatctttctaggatggcagttctggagaagttaacaaagtttcgattgaacgtgaagaaaggcgcctaactgaacttggtcagaagataattgaaacatttgcactatcccatatattcaggtaatatatttcagttcaatcatcttgttacctccacatgattggttttctgggtacatatcataaatttgtaaaaccatttgtcctatgttgtccttttatgtgattttcttagtaccatattttgtttagtgcttgatcaaccagatgactcatgtggtcacattcaacttttttttttggcttgtatcaatgtgtaattgtgaagtggtttaatgattttgtgtggtcagtttccgagttagtatgctgaggctgccagcatcacacaggtctggtggtggcagaagaatgttaatgggtctaggtggagagtaaataaagtgattggaacagaaaccggaagagatagaggctcagttcttttctttcttaaattcattaaggacatatggcatcctcatatgcatgcccttaacctttattaatgtggcaatacttaacctatctttattcgtatcctcgctctttgccaatgcaaatgtctaggtcatgaggattactaattcatgcctctaacttgaaccctgttgcacagctcccacccaactgaacttttcttgccttgcctgacatgggtacctatgttagacttgcccataccccgtagtacgtgtccaccatatatctcatttctgttttacattgaagagtgtaccttttgagttctattattactgagttagcacgaagcttttccatgaagcctcctggtgttttgcattgcagtatctcccttaaagttccataaaaccaaacaaacagttctgtaacacaaaactggagctcatcctcaagttctcttagaaatatactggcatagtccattatctcttagattagcacaagataaccttttcatccttttgcattgcctcttacattttg

SEQ ID NO: 9165 - DNA, 5030 bp, Oryza sativa
  unsure (1)..(5030): unsure at all n locations
ttaagatcagatatcacgcaacagggtggttagcattctgtcttaattttgcattacttctcttggcaactagaatttgtcttaattgaatttatgcacagagggaaagctcgcagcaggagcacaagcaatatgaacattaccgagatgtggatgatcttccatcaagcacgactagctcagacaggaatacatctggctgtggcccagctccaaagcttgatcaagagactgttctacttaccttgaaagataagcttcggaaacttgggcaacgtttacatgaggttaaggtattctttataaaatattgagctatatttccactattgccttgttcatttatgttatgaaattgtcatcttaaagcatatcaccgtcaccattggtttcatggactcagttttgttgtctagtagtgctttgaatttgcttgtttatgttggcaatgaaataggttagctattctgatgatagatttagcaacaattaacaatatggtttgcaaggagtttgaacttttactagactaaatcataggatcaaacaccagagccattttattatgctaacaatatggctagacttgtaaaactcttctgtaccatttgccgattaactgcaccttctccctgtttttactgtaaggatgataagcacagtaatggaatactgctagatagcattccaaatgaaaacataactttgcattctttttggtgttaggactaatattacttcagcatcacaaatgcacacacaaatacacaacaagctagaaaatgcaagtacagaacacaggagatcacaagatacaacagatccataaacaaattcattgtgttatttacatcatactgatgcattgcatggatatgttcctgacaaaatatgctttggtgaattcacttcctgaattggaattttatttagtattttatagtcatttcatagtaacacttcaattgtcagttatcttgtgcaattgtttttgtactgctgaagattgatgtatctatttctatttatgtttgttaacagaaggaaattgagggcaggaaactactccaggctcatttggaaaagaaggcagcagctgagtcagcaactggttcatcctcatcactctcatccaattctttagaagagactccagaggttctgaagagcccagatcaatcttcagtaactatctctgatgctgatattaatgcatcaccttcaaagtttggtgccagtaaagaagtcactccagtaacaccaaccaccatcctaagcactgagcctgtgcctactgttgcttccaccctgagtaaagatgagccagttttgtgtgaagatcatgtatcatgttcaactccacaaattgatactccaatcacctcaaatccaccgcaagttgttaaaactgttacccttccttcaggcatgctgcttgttggtcacgctattcaagcaccgtctagatcacctgcaccacaggttgatagggtctctaaagctattgctgctcccaccaaatcacctgctccacaggatgataaggtctctatagctgttccgactccctcaaaatacctgtccacagggtgagaaaatcgctaaagctatttggtgcccccaaaataacttgtccacaagttgaaaggttgttaaaccattccacaccaaaaaacctgcacctctgttgacaaggtacgtcacttgaccctgtatcaaagcaaatgtcttccatgtctaattcagaagcccgagaagctattcttcccaaaaaggctgcagtcctgtctgtttcccaaactcctgcaatatcgaggccttcaagtgctcctctgttccaggtaccaagatcaactttaccacctacgccagcagttcaagttcccccaatgctttcccgctcaatgaccctggctggacgatcgaggaatgaaccatccccttctgttccaagttatacagcacagacctaccgaaatgccatcattggtaagagtaatcttgatacagcatcagcaagtcttgatcattcaacttcttttggccaaaacgtcgcactttcacagccactatcatcgtatgcatcagcagcatctgccatggtacctccggtcggaaggaatggccaattaccaggtaaacagggcttcatgtttgggcaaggaaagtccgaagcaattgataactggaacccatggaaaggtgatagtaatgctaacaaatacatgtggaaagatgattctccttaccatcaaatgaccaagggtgatgcacatactcaatcttggagggacaattcttatcagcaagcaggatgcagtggaacaggggaacaaggcgaatttggggggcttcaatataggcagttccagagggagattccaacaaaccttgtctcataccaattgccagggccagttggagaagaatttccacaccttgatatcatcaatgacttgcttgaggaggaacaaagcagtgggagtatggcagagcctaccctccacggatatcatacattgggcttgccgtattcttccagaggaaacttagtagactctgaagtgacttccataagtagttctggccggttaaacttggccgatcattactatgacgagggctacccgatggcttatgacaggctgaatgctctttataggttaagagaagggcaaaattccacattggatgcttattccaatggaaggatggactcgattacttcaaaaccttggctacataacttctcaaatccagcagtgaaccttggagttaacccaaatggattttcacagcaaatggggaactacaccaatttagggagtgggagggtgaatggagaacatctgtatcgccatgccaacgggcaatggtgatgcctgtacacaattgataataaatcctgctataagttgtcacagaccatggtggcagatgtaagcgtcgccatggccaccaggttgtaacttttaattttaaaggggcaaagaaataatacattgtgtaaagcattccagtgtccgttaaattttctgtcggctgctttcatagttttatggttcttctttatttcttttttggttggagtataaaacggaattttaacaagtcagtccagaagagttctatgactacttcatcgggttggaaagttccagattttgcatatacgtgtttgtggttttctcttacaagcctaaaaaatgctgtaatgggctcggaaacgaaagaagtgttgtgattttgcagtggcaggtcggatagttggatgccaaggtaacggagctgagatgttccagggtccaaataatgcaagtatgcagcaacctggagaagcaattcaaaactgaaggtaccatcgaagtctatttcaacttcagattatatacccacatgactcctttgctgctattaagatgaacaaatctgtcttggagtaatacaattaaaaaaattatgagcaaacccaaagctcaaaaaaatgaaaaacatgcacagcttacaattatgtctgccttgtgtttaatacaagctttttctatgcaatttccctcaaactagaacagattgccaagtatacaatttacaagatggatgggtatctgctatacaaataagttgtgtaaaaaactaaaaagaagttgtgcgtgttatttactaccagcaattgctcgcagttctcttaggttgctagcgatttcctgaataaacatcacaccttctttgccattcctgagtgagtttatgctatgttcaataaagttgcggtctccttctagcgtcttcaatcttttgttcaagtttgagatttcttcttgaagcgtgctaagatcagtcttccgactcactgttgaagaatgagcttctttagctaagaaaacgggctcctgggcctctcttgagctttcttggcattgcagtgagccatcatctacaacgtgcattttgttggaaaggtaatcctctatgacatctgaatttgacaagtgaatgttagtactgttgttggagtaggattgaagcttctgctccagcttcgtcaagcaatcaactatatatgccctctcctcttcaaagctcactaatgaatttataccacttggtgtggtaattgcaggagcttcaagaccagtttcatcaagcaaagtttcggcaatgttttcttcattaaaggagacctgattggattgtttctctgttggtccacctgcaaactgcatcctgtagttttcgagctcagcttccaattcctctatttgttgttccctctgagcaagtagctcgttagctttagcaagcgcatcactatcatactctgcttgttcttccatcatccgctggtaatgtaaagcttccatctgcatggcagccttgtcatcctgcaatctggtaatcatagccaaagcttgacttgcagcaatcgctgaagcgttcctttcttcttccagttccttgcagaggaggtgtatagattttcggtcaagatcaatctgtcgtctcaaccgttcagtggcactttcaccttccatctcacttacagtgctaccctccagtgactccaaaccagatgcatttctctcaattgaaattctgttcgtgatgttctgcactatcaaatcatcaccacgcccatacgcacgtgggctagggcctgggtcgacccatggagcctcgagtcctctggaagccgagagctgtgacagcagtaacctcaattcttcatttacactagaagaggaatcctttccaagaatcacatcagtcaaggtgggggatggcaagctactcttggcaccaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9166 - DNA, 372 bp, Oryza sativa
tggatcccccgtgtgcttgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaag

SEQ ID NO: 9167 - DNA, 9275 bp, Oryza sativa
agagtgaatgaagtgatgtccttatataggtaggtatgacggttatcctctatgcgaattgtctgaattgccccataaccgtcatcagggagtaatctgggacgtccatgccaaaccccagcctgaatggctgagatgctgattcggccgaacctgggctgggccctcctggcttggccttcggcctgtggactccctctgttctgccttatccatttctgtgaattttgggctgattctctggtattttgatgaagttcacaacccattcttgtatggatacatgtttctccctcactttggtctaattttcctcccaactcctaggtttattacctgcatcaaataaacaccaacacttgtggaatatgtgagatttaatacctatcactatgttggatgttttattatctagactttatgcagatgttggccgtaataccctgtatattaaaagatacttatgttttttagtttgggttgacttgtttaaaataaagatgttaacagaaataaataaaagaaaataccttttgaagtgggccaacacgagaaggcccataaacccagcccactagttctcccctaaaatctagagagagaggaaccgaatcccacctcccctcatggtgccgccacccctctccctggccggcgcctccttcctcccctcctcctgtgttcgcatctctcacctctacagcaaattgctctccctagatctccaccttcatagcttggatcaagaagcgaagtagaaaaacggaacgaggaggaggtgaggagtaaaaggaggggtttgatcggagtttcccctattgtctcctcacaagttctctaaagaaaccctaggtgagacttatccccttgttgtatcagttattctagcatggctttagtgctttaattcgtggttagggaaagctagagaaggagtttgggtagttgcggtttggtttgttgtagttctgcatgtgggcagatttgcagtgcttcagtgtttcgatgttttggagctctaaatattattttctgcaaaagtgtataactaggaagttgtagataatgtttggatctatcttctgaccaaagggcgcgattttatctcaagtggtttaggagatataatttttttaatataactgttgtttttgtgtcataatctggatagtagaggtttttcttagatttccatattggtaaagtacaccctgattggacgagtagaactctagttatggttgttttagtgtggacagtctgaaattctagacagattctgaagcctgctttcaagcgcaaattagaccatttttatggcagaataaaaatatgttttctacatcaaagttgtaggtattgttctgtatattttcaaagtgtatatattttcagtcatagcctttccatttttcaagatataaaggtttgaagcaggagtcttgtgtatagtccaagcggcgttccttgttattgagttttgatgggatggagcagtaggttcacctttttcattgttttatatgcatgtttgaatgtgtttgctaaggttttgtttgtgattaggtggtggtccttcagatcgtgcatgataccaacccttcattggaggcaagagcatgacgaactaattatgtgattcatggattgtttgctctatctatttatttccgatatatttctatgtgaaatctgactgcttatattcatattgttgttcacgccatttaggttttcatgtttatcttatgtttacgacgttattcttgtttcaatattccggattctggttctgggtaaataattcaagttccatgcttgccatggatgtgcaatatggtttcaatttggttctttgattctggttttcaattattcaaggaccatgcgtagtcatgggagtgcaatttggatctttattcatgttcctgtgggtaagcactgatcacgcttactcagctttgccggcaaatgttaggatgtattcactattgtccgggatagaaactactatttcaattcgtgcctgcccaggatgggaactactatcttctttaacttggtgtttgaaaatgtgtttcctatcaaagaaagaaagccttctattcatgctttattgccaatgtagtgtatatgtgttttctagttccatattgtacttgctgagtatttttatactcactcttgtgttttatttggttttaggtacgcattgagaccgacatgcacgggcgggaagtagcacccttatatacacattacttgcacactatcaaactatattgcttatgtccataatgacacttaaattatatcatggttcggtcttgtaataatcttttagatatctattagtttctttccatggaattataaggaaggatcgcaccgtgggaatgatattattattagtagaacttataattgcctgtcgtggatgtccgtatttacaggggagactgccgaaatttctaataattttgggagttagtggtttgagtgtttttttggtgtggcactttaggtacgtggttacatggggtgttacattggcggtatagaattggcatttaataactaccagcatggatcgagtcaacttgggagaagataacgtccggacgatcaggatatcatacgggatacttaggctaaataccaatgcacgtggttggtgaagattccatatggcatacgatggagatattgtgtgcatatcgtgcatatggaatacgatggagattccatatgactcccttgtatacctctgaattttgatttggatcccttccatacccttgccgtcaattgaccgttagttgaccgtttaataggtatagaaaagtcagttttacccttcaatacatgaggaatatgtaaaaatttgtaaactatattgttgcaagtatagaaatttgttgtgtgattataatattcgtaagtttgttgtacatagaaattttaataaatattaaaaaaagtatgtgtagcattttctttaaatgataaacatatttttggaaagcattcctatataatatataggataggaaaaagtgttgaattaccgtaaaaaaatgctacatatactcttttaataagtaaataaatattagttttatgtcatgatgtaaaaataaactttgccatgaataataccttgtacaataaaatcatgaatacaataattttatatataacaaaattatacacttccaacaatatagctagtctgcaatttcctgatttctttcatgtgtaagggcaaaatggtcattatcataggaattaaacattcaactaacggtcaacaaacggaatgtgtatgaaagggatcaaaaccaagattcaagggcatataaggtagtggacaaaactcgggagcatagaagggattagctaaactttcagaggtatagaaggaattttctctatatacagagagggagggtgtgtcctcccggtattgtttcagagagagttgagttgagagaatagttagggtttcgagtttagtcgagattttggtgaggagtgctattgttgcactttgtaaacacacagaaataacaaagttgtaattctacgtttgatgatgatcttcgatttgtgtttactcgggttcggcagtccaatcggcgagacaccggcgatcagaccgacgacattggatcggtcagaccagcggagcaacgatggtcagaccgacggcggcgacaggagccaggagcgattcttcggcggttagaccgggcgatcaacatcggtcaaaccggtggatctactccggtcagaccgatctatatcggattcgagggtaacttttagttccgtaaaaagttccggtttttgggtactacaaccattcacccacccctctggttggcttagttcttgttgttcgatcctacagaggatgaagaggtggaggtcgctctcgcggcaccgacagcgagcacacgagcccgagcccctgaggggatgctaccgcgccgccgccaccttcctcttatagcaacgctgacgccctcctccacaccgccgcttgcggccactcgtgcgctgacgccctgctcctgcctgccacgctgacgtcctgctcccgccgatgccgccaagaaaaaggttgagagaaagagagagagaggaagaaagggatgtgtcattaagtccacaattttttatttttttatttagattgaacggctatgacatgcgggtctcacactttactcagccgccacgtcagccgaaaatggccactatgctgtcgagggaccaaagttaaatggtattgtgaggtgagggatgtgctatacgtggtatttaggttcagggacaaacttcagactcggcaacaaattaaggaacctaaagtgaacttattccatctaaaaatgaaaaggatcaaataaattggaacagaatgccacgaattgattagtattgtggagaagatcgtcgccacagtggttccactcctttgtacacatctcggttcacgatgcatgccattgttgtctcaatgatcaactacattgcagtaatgcaaattaccaaagttctcgtatgcgttagtacatatgcacgcacaacacatgggccaaagttggcctcctcttgctgggctttggcccagcaagactccatgcacggacgtgatgaatacaaacttctagacggacgggcaccatgacagcgtgatgaaaaattgagaagcgcaaccgtttcactatttctccgttttcctccacgtgtcgctagactatttggctgccaccaccaatcagctagcaggaggcactgctgattttctttacataatttgtgagatcagggagacacgtggtccaataggcagccggcaaaactgccggcttgagattagttgatgagtaaactttaggaaatactaacacaacgaaaccaagcactcgactaggttgaaaggtatttttatggttggaagttggaacacatgaccaaaatgttgaacagtgatagcaagatattttatgcttctattcttgacataacaagagataatagtgaaatagaaaaggaatgaaaagcaaaaattagtttgaaattaagttctaaatttaaatatggtaaattgcacatcacattaagttggtattatttatctatcaaactaaaaatatatatactacgaaattagcacaagacagtaacagagaaaataaaagcacgaatagtacgatggtgtagtcacgtgtatataggggtattattgggtctaacgttttagcctacaaaaagttaagaggtgagtctaaaatgaagtaggctaagtttttatacatttttatttattcggcttacttaatttcattgttgtgtaactaacacaaacaattgttttgtatttgcgactgcagtagctatggctaggtgcagcggctgcactgactagccaaatggacactatgagtaggggtggatagcgagccagctcagctcggctcggtccagctcgttaggataatgagctggctcggctcggctcggctcgttatcctaacgagctagaaacccagcttggctcagctcatctgaaaggtcgagctagctcgttaggctcacaagccgttgatgggcgcctgggcagtgggcggcgtgtggcacggggcggcggctggcgggggcggggtaggcggcggccgtctagggcagggtaggcggcgccggcgggagcggggtaaaggccgtgctggacctcgtcggctccactcgtacgcgcgtgtgctgtgcaggtccaagcaatgaagcctcgctaagactagctgccagctgcgacgacgggtcatcaccggcctgcctcaatgacacctggtgccggctggggaagtgcggcgccgacggcggcagcgaccctagcggctggtggcagcggccctagcggctggcggcagcggcggcacggcgagaggtgacgccggcaccgactggggaagtgcggtgccgacggcggcagcggccctagcggctggcggtggcggtggcggcgacacggtgaaaggtgacgccggcgccggctggggaagtgcggcggcgacgcgctgtggaaggggatcgaggattcgaggttcgagcggaggcggagccaaagagagatgcgatgcggataagccgccgatgcggtgagaagtgaggagaggactagggttttgatgttgtgggcttgggcctttggtgttgtcttgggctgggccttttatgttgtctgttggagtcctggctcgttaaggctcacgagcagctcgcgagccagctcgagctggctcgttatctctaacgagctaaacttctagatcggcttgttaggaaaatcaaacgagccgagcttgtcataagccgagcgagctaaggagccacgagcttcctgtccacccctaactatgagggctaaataaggttgtgagaaaactcatgtaccttgatccatgttaaacacctctacgtgtgtgtataatgattataattctaatgccataaatataccaattgagaatgcgctttgaatagaaatttggggtggtcaggtattcaagggtgttcatagaggtgtagcttacccggtgcactggacacccgggtagcatctaattttttttaaccatattaatcatatattactccatattagctagtaataattagactgaagatttccgataattttcttctggatttcgccactgcgggtatttatcgtcggtctctatctctgtaagtacttaatttattctagatatagctatactcctcaactatatatatatgtggctgtgatgtatgcgcgcgtttcacgtgaaataaaaaaaaatcgccaacagcaaggataaccactgctcagcgccgtcgtgagatcatcacctccagcacctctattaattacagccgttttaggaaactaagttggcaccagatgagcccgatcgaggtacggatggagtacacgtcaagcagtgcgaagttgagcaagctgaattaagtatccttaattatggagcaaggaacgatcgataaaaagaagaagaagagagagatcgcacaaattgaatagctgggtagtggttgatctaaaataaagattacatcaacatctaaataatctttgtgttgatattttttagttgatgtctctagctgcgctgatatggtcatatcatatggagtatataataagaattcagcaactataccagtgaaggtttcggccagcaaattggaccgtgctcctgccttctaattttgttttttttattgaaacacgatatgatgaacagatagcatataaacaacccgtaactaatcttgatacctcgcactataaaactcgctggatgctaggaagaacgataaccaaattaaagtaccaaacaaaccaggagacctcgtgttacattctagtatttcataatactcatgtgaacatgtgagctcaccgccgcgaagtgagtatagcttaactagttaggttccttgtggtggaaccagcccacccgggttcaaatcctagatttgacatcctaaatttgacacccatcgacagcgaggcgcctgtggtgacttcgttaggttagggtgtgcatgtgtgcctttacaggggtgagcgcctgctgtgtttctcaaaaaaaaaaattgagctcaccgccaccgccctccccaactagctcacacccaaaaaaaaattcgcatgtgagctcccagcattatctttacgccttctcctattggcaaacattttcacattattttttaaaaaactatacattatagtttacatgccacacatattttcacaaacatgcaaagtcaatctatctataaatgaaaatatatactaaataataaatactccccacgattcaaaattaatgtactaattcttatagcaacattttgtatcggagagaggaagacctaaaagtgcatatgtgttttgcagttgcctttgttattattttgttgtccatcaaattgaattttgcatattttgtttctttaaaagttgaatccattccaaccattgcttcaaaggaccattattcccctcatcctaaaatataaagaattttgatcaaatgggatagattctaattctacgaatatcatccggttaaatccccttatattttaggacaaagggagtattataagggttgaatgacgaccgattgcaaattataaaatcacagattgaacaaaaacaagaaaaacctatctagaataccaactcagatattttccatctatggttggtgagggtctgcataaccattgtttcttgcaaatggccttacaagttatatatagttattgtctttcttaaaccgaaaacagaatcttcttaaatcaacggctgattgattattttgtgtcattcggtcggagagtaaatgagttgcaacgcaatcattcacccatatatggccattaccatagccatcaaagtcgatccaacgaagacacagctactaaggacgccacaccaacatgatacctctaatgtgatgtctccaagaaggttaaaatattgtcactgtcgctattccagacattagtgactaattaagtttccacttggagaatccatcccgagatacagagagcgttggcaacattgtctccgaggtgtttgacaggttttatgtgctagttggtacaactatagcaatagacgaatacggcttgctagtccagttactcctgaaagtatacgactgccatggcaaatagagccaactacgacgccaaatgatcagcagcaaaagcaacacacatcgtgctgctgaaactcgtctgtctcaatcgaccacacaccgtttccctcccagatgttttaaggcctcccaattccactatctacgagagaataatgttaaacttattctcttgtaaactccctccaccctaaattatagattataggacgctttctttttaaggaaaattaaactcggtaacttttaactaatgatcatactaactatatatgctagcatgttataccactagatttattaatttatattttaaagtgctttaatgcgatgctaattctatatttattgagaacatagcatgaaataaattactaaattatattattaaagaccatgtaaaaaaatataggccttataatttaagacggatggagtattgactaaaccgttagagaaaaatagatgctaaatgagtccttccaggccatctcgtgacctactactttaaaagtgcacctcttt

SEQ ID NO: 9168 - DNA, 8825 bp, Oryza sativa
tgtcgccgcctgccggatccgccgcccgcgcgctctagtcaccagggaggggagaggagagggaggaggggaggagccgcggccggatccgtggcagggggagggcggccggccgccggatccttgcggggacggccgtcgccgccagatccgtgcggggacggccgacgcccaccggatctcgtgcctccaccgccgcgccgccaccgccgccgccattgatgccgccgcttccgcctcccttaccgacggcgccggcatcgccgaggagggagagggagatgggaggatggggaggaggagagggagagggagagggaggatgaatggagaggtggtggggagggtgcgcccgtgacgggagaggataagggtgggcgcgtggggtgggctattttcgtgtgcgggacacttaacaagcccgcacgcgacgtccggatgcccttttttatttttctgtgcggttgcacttatgggccgcctggaaacaaactagtctggtgtccaaaaaaatatttagtgtagtagtgctactacacgctcggcatggggatggccagggaggggcgagcactagatcggtccacctcgatcaagttgataatttgcgctatatttactattgtttttgttaaatttgaaaatgttggtattattaattattgactcctccaacagctattggcactcgatcgtaaaaaaaaaactaaagttaaattaaactaataacccgaggaaaaaattacaaatatacttatttttttaataatatatgtttatatacatgcgggacagcgacggttccgtagattcaaaacacaggatcgatggccctgcgcgcggaaccgtcatggtcccgcagctccaaaatgcggaaccacgacggtcccgcggttccaaaacgcggaaccgcagtggccagcgacttcagcactgtgcagcatagtttatacactgttttgactctgtgcagcactgttcacacactgttcatgctcggtgtccctccattgtgcggaactgacacgggaacagtgtaaaacagtactggaaacagtgtcaaacagtattaaacacggcgccacgcagtaaaaaaatgttgcgccgcggttccgcacactggcgctgcgggagcgtactggctccgcgttaccggcatgcgggactggctcggtcccgctgccccattccgcgcgaacgccttggccgtccactccgcgccgtcacgccatacttttgttgcgctccggcggaaccgatatgcggattagttatattttcacaaattctttatactagtgtatataaacgtaaatctttttcaaaaatggatattttcaaaaatattttctatcggtttgatccccttcctttgtgattgtgtagctcggccttccacaatcccttcccatgtcgttaatttgcaccaacctatgaagccacgatcgcccaaggaaaaaaaaatggaagaatgaaaacaaccccctacttttagggcagttgagccacctccaatcacatcttaaatttgctacaatacaactttagtggtttgtagtataagtttaaatccaatccaagagaacagaaagagctggcactctcgtaattggtttttgctatttcggtctcttcgtgcgtggattaaatttgattatatatataactaactgggtggcccgcacaattgcgcggtagcactcatacaaaatcatttttttaatatgattttacttaaaatttattaaatagctatctcgttgacttaaggatttgattgaccaaaccttatcatccttgtgtttctactttcgtagtctttaaaagacacaccagttgctactctttacttctgtcacctcttctttcttttcttttttttttgcttgtttggtctaccattcatctctttgtaacatttaaaaattagaccttatggtttgtagagtttattttcttgttaggttttgtttttataattcttagaagtcccgtcaaacgttgtcattatactcatctacggtctatccgatgcctcatctatttattgtcattgggattttaaaaattgaatataattatcatttgggtttatttttttactttctagaagtcccgccaaacagtcagcggctttgtcactgtatttccctacggctcacccattgcctcctctctgtattgtcattgagatttttaaatcgggcattattattattattattattattattattattattattattattattattattattattattattattattatttactttgtagaagtcccgatactttaaaaattggaccttatagttattatagtttgttgtcccgtcaaacgctatcactatactcgtctattgtacgaccgctgcctcctctttttattgttattgggttcattttttactttctagaagtcctgccaaatcattagtggctgtcattgtactcctctacgactcgcccgatgtctcactctttaatgtcattgagatttcaaaatcaaacatggttatcattagtgtttatttaattaatctcgtgttgtaccatatatgaactattctttcaatatacttcattttaattttgaattttaattatttctaaattattcctattagaaatctttattattattgcgattttaaaaatcgaacctgatcattatttggttttgttttttaaatagtttgtagaagtttctctagccgtcattgtccatctcctttgccactctagtcttgtcgtcttaataatacaatacaattcattttatcttttattctatatggtagttttctatcaatattttttatttctgattttagttatttttaattgtatttgtacttgaacttttatttttttctattttgaattttcttttatttttatttcgaatttaatttatctcatgttattctctagattgacagttaattatttaaatattttcttcttttaattttaattttagttatttttaaattttattcccacttaaactctattttctctcgctgattaatgtgataacttttatttcagattccagttatttataaatttattcctatttgaaatttttttttatttttctaatttagttatttatgttttttattataaatttcagttatttatatattatattcatacttgaatgcaattaatgtggattttttaaaaataactaaatactatttaaaaatgagcttgccttttggcagtccttgtccgatggggaattcaaatagatggattcttgttttgttttcgagtatttttatatttttctagtatttttacatcttgtgcataggatttgtccggtacttatttctgggcaatcaatctcaaccattataacatctcatgtccagattcatagctagagtttgcccccctttttaggggggatagagggagtatgtccaccatgaattggtgcagatttttttctttacttattattaatttggtaatttctagatatccttatataatatttggatatattattaattgtatgagccattgctgtaacgggcagactaccaagcaagaggattgattttccatttttactgagcttctctgatttttttttttttgaaaaaagaacttgttagctgtccttgtcagccttgcccgattggaatttgatagtccgaatagaacttggactttttaatttttgctgcgtagtttcttttaaaaagtttgaggactcttacttttttatatttgtacaatcaatctcaatggttaaattatagatctatcataattcaatggtgtagattttctctttttcttcgattaatgtggtaatttctagccactacagcgaacatgtagtctcctttcaaggctgttttaaatagatatatgtaacataataatttatattttctatttttgaaaaggttctatgaatgatatttaaatcgcatagaagaaatgatatctcatagcctaggacatgggacatatccgggataaacttatacctaatttgttttttaaaaaaacatttaaatttgctatgtataatacatgtgcatatgatttgtggattaagaacagctatatttgattccagaattggaaagtagcaaaaaaaaccctccagatcaacgtctatatttgatcataaaatattttactttgtagtttgtaataatttttccttgataaagaacttttttttaatgtattgatgcttcttttctagtttgtaccccacctttcaaattccacgtccgccaataatattattacagcttaaaatccatttctccattcctcccttaaaaaaacgctagatataagaaatagctcttatatcaaaatttattaagagatggctgagaccatatttgtggtgctaaacgaaaaggggaatatatatattgaactaccattgaattgaaaatttgacatatgagatttgtctacgtcatcacgagtaaaaattttattgatagatttactcacgggagtaaattttttactcataatgacatggacaaatctcatacattcattttttatcgaacgataattttcgagtttccacgatatgtggtttgcccgatatatatatatatatatatatatatatatatatatatatatatatatacccacgtgaggacgtaaggtcactatctttccacctctatataagcacgtagcattagtataggtcggtattaagcaagcggcaatacacaaacacacgggtagctaagcaagctagcctcctgaatactgtcatggcaatagagtcagctccggcgcgaaatgagcggcgcggtcagcacgtcgtgctgctggcgagccccggcgccggccaccttctgccggtggccgagctcgcccggcgcatcgtcgagtacgacggcttcacggccacgatcgtcacccacaccaacttctcctcggcggagcactcctccaccttctcctccctcccgccgtccatctccatcgccgcgctccccgaggtgtccgtcgacgacctccccgccgacgcgcgcgtcgagacccgcatcctcaccgtcgtccgccgcgcgctcccgcacctccgcgacctcctccgctccctcctcgactcccccgcgggcgtcgccgtcttcctctccgacctcctcagcccgcgggcgctcgccgtggccgccgagctcggcatcccgcgatacgtcttctgcacctccaacctcatgtgcctcacctccttcctccacaacccggtgctcgaccggacgaccacctgcgagttccgcgacctcccgggccccgtcctcctcccggggtgcgtgccgctgcacggctccgacctcgtcgaccccgtgcaggaccgggccaaccccgtgtaccggctcgtgatcgagatggggctcgactacctccgcgccgacggcttcctcgtcaacaccttcgacgccatggagcacgacaccgctgtggcgttcaaggagctctccgacaaaggcgtgtaccctccggcctacgcggttggcccgttcgtccggtcgccctccggcaaggcggcgaacgacgcctgcatacggtggctcgacgaccagccggacgggtctgtgctgtacgtgtgtctgggcagcggcggcacgctgtccaccgagcagacggccgaggtggcggcggggctggaggcgagcgggcagaggttcctatgggtggtgcgctaccccagcgacaaggacaagacggccagctacttcagcgttagcggcgacggcgacggcgaggacagcccgacgaactacctgccggaggggttcctcgagaggaccaaaggcaccgggctcgccgtgccgatgtgggcgccgcaggtgtagatcctgaaccaccgcgccgtcggcgggttcgtgtcgcactgcgggtggaactcgacgctggagaccgtggcggcgggcgtgccgatggtggcgtggccgctctacgccgagcagaggatgaacgccgtgatgctgtcgtcgtcgcgcgcggggctggcgctgcggccgagcaacgcccgggaggacggggtggtgacgcgggacgaggtggcggcggtggcgagggagctcatcacgggggagaagggcgccgcggcgcggaggaaggcgcgggagctgcgggaggcggcggccaaggccacgcgggcgccgggcggcccgtcgcgccaggcgttcgaggccgtcgtcggtggcgcgtggaagaaggccgccgccgctgcacgtggcggtcgtgccggcgagcccgacgacaacggaacagcagtgacggcccaatgatttgtgtcggtgtcggcagatcgatctggttcgttccctcgcgcgcgcgcggcgttgtgggctcgtgcggttcccttcttccccccggttgcaaacacgtttgtctgcttggttggtggtggtctgatgtgtgtcagtgtcacgcctagctaggcctagcttgtccaaccggagctttggtgtttgtacgtaccatacgtgttgtgctcggtaattgtacattaagggtgtttagttcacgttaaaattgaaagtttggttgaaattgaaatgattgatgtgacgaaaaagttagaagtttatgtgtataagaaaatttgatgtgatgaaaaagttgaaagtttgaagataaagttgataactatacaagggcatactctctctatcaaaaagatataataatatagaatttgatttgatataatatagtagtataatgaatcataaattattggttgttttatttaaaaacgaaaagagtacgtgatgtgctatagtgatcgagatgtgtacatgtgataatgtaagggatttttttaagtagtaccactactataataccatttttccgggcagttagatttattatcccgtgcggtcactcggcccgccgcagctcctcgtctaagaaaatcggtactttcgcgtgcgggccggctgaccgcacgggataatcgattatcccttgtggtcgacttaacacgaccgcacgggaaaatcgattatcccgtgcggtcgtattaagtcgaccgcgtgcggtcagtttcaccacccgcaagaaaaaaaaacgaacaaaaaaaaataaaatcgaaacaatcccgtcgtcgtcgctgtggtaatcgacaccaaccctggcagtgccatgtgtggaacagcaacaggcttaacacaagaacgatgatggatgggtcagtggatgcagcagcaaatcggcataattaatggtcccttcattttcgcaaattacaacggaaaattctaaaaaaactgaaattatagatagaaatcacgtggttcactgatcattaaacagtgggcgatggcactggccttgttcatgccatcgaagctctcactgacactctccatggtcgtcgtcgccgtcgtcgcgccgccgctcccgtcgtcgtcgtcgtcgccgtcgccaacagccgcgtcgccgcagccgccgctccgcctccgccagcattcgccgtcgccgccgctcccgtcgtcgcgcagccgctgctcatcgtcgcctccggcctatgctgagcgcagcaagccggccggcgatgtcacctccggcgggggcaccctcctgcctcgccacgcgcagcccggcgagcctgtccgcgaggccgtcaccgtggagatggcgccggagacggtggtgcaggcggccttgtcgaggaagaaaagcgcgaactcgtcgccgcactccggctccgcccaggagagcgtctcgccgtccatcctctcgaaggcgtcgccgggaagggaaggggaggggaggaaagaggaaagaggcagatgtttacagagagagagagaggaaagaggcgtgtagcagtgagaataaaaaggaaaaagaaagagagagggtgtgaaaaatttgaagtgggtgagaaggaaaaaaaggggaaagagaatgtaaaaaatttgaagtgggtgggaggaaaaggagggaggtatttttatgtgcggtccactaataaaagtccgcacgtgaaaaacgattttcccgtgcggttcttttaagtcgaccgcacgggataatgaggattatcccgtgcggttggattaagacgcccgtacgggaaaatgcatttttccgtgtgggcgacagtctggcaccggtccctctattttctcatacagttccacttacgggccgtatagaaacaaaagaagatggcgtccagaaaaatttatcttggagtagtgtacggtcacatcaatcaactctagttcatttttttctatcttattccaactacctaatccacatacagccaagaaacacttattagaggcattttagtcatttatctccttactcctatatccttaatttctcttactcccccgttccaaaatataacaacggattatatgggatacatatctctgtttaaattcgttgtattaagatgtattccatccaatcttagtttactatattttaagatggggtgtgtcggtgacatgggaccgggggtatcttgactagaggtttggggcagccgcggtcacccacgtggcctgaccccctcggggggggggggggtcgggcccgagggtgatgtggccgcccctccctctgtctccccgaggggttgggccgctcccgtttcggccccgagggctggggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtaaaaacgggctgca

SEQ ID NO: 9169 - DNA, 9978 bp, Oryza sativa
gtgtcaggcgagtgatgacgctgggcctcactcaaagacaagctgtgatttagcttctaggcgagggcgcaagccagttttttttttggaagatagggtgagtccccacccaaaagaagagtaggtagaagtggtgcatgtggtatccccttagatataaaaggaggatcttgcccacttaagaaaggggggcgaaaagagagagaagagaagggaagacgggagctcggagagaagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccctggccgaaccggcaaaggggggcccgcgcggtctcccggtgaggagccccacgctccgtcatctagcgcgccaggtagggggcgcgtgtgtttttctaagccctcgtcctctttcgtgtgcgccaagcttctcccgctcagcccaatggctgaacgggcagtggcgcacaacctctctccgagcgctagcggtgacgacggggagcagaacccgcgtcgtcgagctcgtactccaccgcccccctcttgccaaagtcttaggcgggaggaggcgctcgagggggtcgaaagatcagcgacttcgccgcccacgagcgatgaagaaggacggcgagacggggagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcacagcagcgcctaggcgccggcgggcggtcctccgctaccgaggcctctggcgctgccgccgccggctccatgtcgtcgaggcggaaggcgcggcgagcggcggccgttgcccgccgttcatccgccattccctcatcaacgcctccgacccaagaagatgtgcgtggggggccagatgcccgcctcgatatcgagtgccggcgcgacgctcgtcgcgccgcccatgcaacggagggcgcttcctcgtccggagcgccacttcggtccgggcacgggggccggccccccgtgtccccggttggcggtgccggctgtcgagcctttgtggcgagccttcggaacgtccgttggcccccaaggttccggcccaccaactacttggaagaacgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatatgggagggtccgtatcgagtgatcggcgtcccccggccgggctccgttcggctggccacggccgacggcacagagctgcctaacccgtggaacatcgaacaccttcgtcgcttctacccctagtgggggtcgggtgtcatgtctcgggctcgggccaaccccgcacccccccccccccgggcgtgtagagttggccgggggctaccacatgcatatccttatcttttttctcttccttatttcaataaaagcattttcgatttcctgaggattgtgtctgtgccatcgtttccttttgaagaatcttggtttgaattaacacgctcgtgctcgaccctgccctcggtggcccgggccggctaaaatcgccaaacggggcccagaaccgagccgtgccccggggcgtggtgaactccgggggggaatcggcaaaggcccacaattgggtcatccataaccctcggtcaccgcgctcccggcctggccagtctcgacacgtggatctccccaggcactagccctgacccgcgccgtttgaggctggggcctgggcacgagcccttgttcaagccaagacacagaaggaccgcggcacagaccatcctcgtctcatacacacaataaacagagctgacgcaaaaatttcatctttacttgattacagattaaatcagtctatacaagaagggggcccgaaggcctcggaagaagaaggaaaagctattaagattggcgggggcctgggggctcactccgacgcgcccgggttgtcggcctcgtcgtcgctgtcgtccgcaccgtcgtcaccgccctcctcgtcggagtcgagcgcgaacgcgagccgaggggccgtaccctcgaagctgtggacgatttggtcggcggcgtcccggacctgcgcgcgcgcgccatcctgggttccaggagggaactcgtccagcgctgcccacggggagaagtcagggtccctggcctggtagcttgccagtacgagctccaccgccccccgggtgaggtccctcgaggatgacttgatcgtctcctcgagctcctcggggagccgctggagggccccggccatctctgagaggcgctgggcgaggccagcgcgccctgcaactcggcgatggcgtgttcggcggctgcgaggcgggcggctaggtcgccgtggcccgcggccgccccgccgctgtgcgccctcgcgtccagctccttcgcccgcgcctcgagctcagcggcccgctgatccagtgcggccctctcggcgcgggcgccttccagattgcggcgcgcctgctcctcccacgctgcctcacggaggaacaggctgtccgccagccgctgcgccgtggcctcggcctcctcgagagctcgcccccgctcgatgagcgcgtcctcgcggaagcggagtgcggactcctcttcggcgcaggcggcctcgtgctcacgatccgggaaggcggcaacacgctaccctcgagcggtgcggagccccgtgccatgacgccggcggaggaggagcttgagagcgagcgagtatggcaagggtagggcgcaggaaacgagaagttagagcgcaagcggcgaaggcaaggggaataatggcgagaggaaggaaacgagtctcttcctcggcgtctttatacccttgccaacgctatgcccggctcctcgcttcccgcgcccactatctcgccccctcgtttctcgcgcccactcctccactaatcccgctcgcccgtttgcggcgcacgaggtggatgtgcggccgtggcagtcgagatgggacagatcgtgcgcgcgttaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgtgcaccactggattcctgcccgcctgtagagaccggccccgcctgtcaccaggcctaaggagtggcgtcatgcccgagcactttcctcgaggagggcgatcgccctggcataacgccaggggctactgtcggtgacatgggaccgggggtatcttgactagaggtttggggcagccgcggtcacccacgtggcctgaccccctcggggggagtcgggcccgagggtgatgtggccgcccctccctctgtctccccgaggggttgggccgctcccgtttcggccccgagggctggggcgccctgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcacagtgtgtgaccggtcacagaccggtcagatcgcgggttaggtggcaacaggcggcctttcgcacgcctcgccccgtcccgtcggaatgatgagagcctctaggcactcgtccctagccggagccggcgtgttaactcctggagttagcacgtcagtcccagctagattcataccaggcttcatcgcaaccattacaaggaagtcattttatgaagaagggctgacgtgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtaacagggagatctccggtgtcaggcgagtgatgacgctgggcctcactcaaagacaagctatgatttagcttctaggcgaggacgcaagccagttttttttttgaagatagggtgagtccccactcaaaagaagagtaggtagaagtggtgcatgtggtatccccttgagatataaaaggaggaccttgcccacttaagaaaagggggcgaaaagagagagaagagaagggaagacgggagctcagagagaagagaaagaggaagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccctggccgaaccggcaaaggggggcccgcgcggtctcccggtgaggagccccacgctccgtcagggtgtatattttaagataggtataatatcatgggaaaaaagggcggaaactacggactcatttgttttggagggaaaatggaaggaaaatgtagaaacaagattcatgtactattcatccattagttttgtaggatttgagcatgaaattttccttgggctatgattcttaagaaatttcataggaaaatttgcatccacttagagctcttttttctattcctacgaataggatcgaggtaaattactcattgtttgatgtatttgacctcaagttacatggttaaagcattccaaccttgatcatattaacttaatactaagcattcatatattttccctaccaaccatccaaaagatcaatcctatacttttttctatcatttgttttgcacatgtgttcctatgttttcctattcttatgatttggaaatcttgtaaatcaactgagccttacatatgtaatgcagtaatggaaacctaaaaaaaaatcgttggatcgaaaaatagacgtttaaagttcgtccacatcatcacgagtaaaaattttacttcatgagtaaatattttattgatttactcacagtgatttagatgtatctcatatgtctatttttcgatccaaccgtaatttctaggtttttaatatatatgtgatttgatattttagctagtagtattggttaggaaactaggcagctcgcgcgtgttgcacaagcttcgtcatgcactactgattggtgggtggcaatgatttttcccatttaagggattgtgtggacctagtaataaattatctgataaatatgttatatgtatagtggcacttggaagttggaattgattcaaatcgtcacgatgctcaactcgataagtttgcaatttaataaccgatgtcgactccctagtcctcctaatatcttggcaattatggaaggaacaaaacttcagagttttcgactttgctctctcttcggtctcagtggttctagagtccattctcattgagggtcacctatagtcgttagctgccgttgcttctttcagggttttcttgtgagggtagtgtggctctgctcccttcctgcaaattggagttgcgtttagtcttcgttccttagtttttcttgtttttgtcttttctcccttcccatggcataagctggtctggctgattgtgctgtgtaaacaaacactctttccctctaatatattgacgcgcaatctttttgcgtgttcgtaatcgtaaaaatatgtacgccaagtcactacttaattagttgacttgttacaagcaaatgtatatgttttttttcatctacttacgaaaatggttgtgtgctcttataagaggcctaaaattccattacataattcactctagaagaaattaattacctcccttaattactttcatatgtaacggctcactaccggttatttcttacgtcggttcaggaatgttgaaccgttagtggtacctagggctggacaaatagctcgggctcgtgaactcggctcaagctcggctcgggctcgcctggctcggctcggctcgaatcctgaacgagccgagcccgagcctgggttttagctcgtttgtgaaccgagccgagcccgagccagctcgcgagcagctcacgagcttagtaggctcggtttgaatagaaagacttctggccgaaaaccaaaaaagcccatcaatttgttatatgttggctgcatacaatatacctaattatctttgtagggacttgagagttattatctgaataactaagtcattgcaaagcaacacaactgctgctggcaatacaactgctgctattgcaaagctcacgagccagctcgagccggctcgagccagaccacgagccgagccgagcctaatgtacagctcggttggagaaccgagccgagccaagccgagcctggcatttcgcgagcttccacgagccgagccgagctggctcggctcgtttccacccctagtggtacccccaaaaaaaataatcatccacaccatatactaatcgccatcattgtgctgaggatgccttgcctgtaatcgtggttgtcgtcattgtcaatgtagccactattacaccatcgccatcgctgcgcacgaagatgagagaaggatatctttcataaagtctattaatatccgaagtcactgctttgtccctggacccataaacaatgggtcttaattcaggagaaagaaccagcaataagtacaaaatccattctggttctacatttgtttgaataaaatatttcaccaatttcatgcgtctaataaaaaaaacttttcttattcttttttctatcttctcattcatcttcactatacccctcgtcttctaattccttccattcaagtggctggcatgagggtcccacagcttgtcgacccacatgttagtgaccccacgcgaagggcagtatttcagaggagctcatctgaaaagagagcaaaagaggtggccgcgttatatctaggcatcagcccccatcacaagttggccctccttcttgttatgactattgatatggtgccactgccagcatgtcgtcatcatacctgtcaccaagacccatagacatggcaacgttggatggggcagagcttgggaagatgggtgattgggccagttggatctagccacctagaagtcggagatgttttgatccgatgaccctttatcttagggaggttggtttgagctcccacaacaattggatctggcgacattgacgttcgggagagatgtggaggtggcggtggcacttggcactaggatggaggagaagacgatgaccgaagcagtgcttgagagaagaaagaggagagcaacggccatggttggaagcgaagggaaatgtgaagtagctaggcgaaaggtgaaaacgacgactacgctcaggagggaaggggagtgatcgagtggatggcagcagcagtgctcggctcttaagagagagctgggagtcaacggtgatagctacgctcgacactcgggacttaggagggagctaggagcagtggtggtgtttctagatcgagactcgaggaagagagaattatagtattactagctatatatggatctaggtggctgtttctcgagatctatagcggttggtggtttgtaaccgtttaagatgacaacaatgcatctattcataaaagatgattcgttagaggggaacatatcctatgcacacaagcttctcatacacactccatatacaccaactagcaaatgtcacgaaaaatcctacaaaaaattggacatttactcctattaatattacacatatctataaagtttcatattcaaattcattatattttagtcgtaataaaaaagtgcaaaatctgacagttttaaaggtaaaaatttgtcagaattttgtccttttttttgttacgactaaaatataatgaatttgaagaaaaaatttcacatgtacatgcaatactattcaaagtaagtgtatattttttgtagaatttttcgtgacatttgctagttggtatgcacagagtgtgcacgggaagcttgtgtgcataggatatgtttccttgttatacatgtctagtcaagtcatatgttattataaagaattatagatgttaagcaccatatttataagggttaattggatatgccactacaaatatgccaaattagaaaaataacactactattcacaatatcggccgggtgccactaaaattttgggaaattagatcatctcactccatcgcgttttccatccactccccgtccacggcgccaacttcgccaatgccttcccttccccgtgtgtggacgccgccgccactccactcgacggagatgatcaggggcagggaagggtgctgctacccggggggagctcatctctgctgtggacatttaccacaggagcgcggtcatcgtctcccgtgtcgtcaagacctacatgccgtcctcatggttcctcacctcgctgttcaccgtcgtcgacgccgtggaatgcaagaacccggtgccggcctcggtagagtcaacggcggagctggagctgagctggaggcgaagggaggcactaggggcggctaccacacgaaacagaaagggggagacgacgcacagggcttcgtctcgacggcctgcgacggcaacttccctccgggacgatgcatggatccaacgatatcggaatagtagtggtatttttttaatttggtctatttatagtggcatggatccaattaaccctatttataacggcccttagttccaagttccaaccactatatacgacggtcctacttgactcgttacagcctgacagatagatagctggttctgtagcagtgtgaaatgtccagtctaatcgacttaagcttccttgatgagtgaggaattgaggatcaccacgacagcatgaaggaatcgacatttcttctttaattcattcaagtttattgtttgattctatccattgttctctcattaactcttgctatacatgttttttttaaaaaaaaatgatcaaaagaggatagggccgggatcgtctgttttcgtttaacagtaagagacttggcatagtgtttaagaaaatccgaaccaaaaatctcacaaacacactactccctccgtactctaatataatattttaacattttaattgcactatttaactactttaagaacaattttttgtctttatatttgtacaattttttaaaataagacgagtgatcaaacgctacaacaaaatagtaaataatattatattaagagacggatgtattaattaggaaaacccggctaagaagccacacgaataaaaaaaataaacacttacggcgatatgactggagctcaaagcatgtgtcatcgttgtgtagctcaaaaaagcagccccgacgatttctatattgcaaatgcacatttgctcgtacaaactacatgcatttaacttcaccagtgaaatattatatatactactacctccatttcagattataagattttctatcattgtccatattcatatagatgttaatgaatgtagtcacatatatgtatatatatatatatgtatatatgtatacacgtatacacgtatatacacatatatatatatgtgtgtgtgtgtgt

SEQ ID NO: 9170 - DNA, 11354 bp, Oryza sativa
tacgtagctaatacagcccgatatatggcgttatatgtaactatatctgtacgcccgaagaaagaagtaacaaattaagctatatacctctcaagatacaatgtaattaaggacctagctagaagatatatatatatatatgctgcctatatatatatacctcctatatacggacatatataattcaatttagtccacgacgttgttgctgaagagcttaaactgtccagcgtcgagcacgagcttccgtatggaggcgaatgcgccgatggccccgacgccggagaagacgaccatgatggccgtgttggcgaggaacatcggcgaccgcctgggcggcgcgagcgcgatgttgtacatgacgacggggaggacgaagtcgagcgggatgaaccccacggcgccgaccacgccgacgatgtcgccgaagaagggcagcatggccgccatgaacgcgcagaaggcgaggtagagcgtccgcaggagcagccggggcaccacgttccgccgcgagaacttcccccgcgtcgcgtccgcggagctcttctccatgatctcgtacgccacctgggagtagacgaggccgatggcgaggagctggaggaggacgaagaggacggcgaggccgagcagccacgtcggggcgagggccgggccggtgtccggcatgaggctcttgaggacgttggactggacgtggctgccgaacgcccagtagccggtgatcgaagggatgtagaaggcgaaggctatgacggagtagcacagcacaagcgccttcatcatcttcccggccgccggtggcgccaacgtggcctgcaaacgccgatttgaaaacggcccaccataaatcttctaaataggcccgcataacacttcatatgggctttttaacaattgatatgggcttaattttaggagcccaataagcccagcctgtcgcgtcagttggaccatattgcggcgattttgctatatatttgtcgacaaatttttcccccaaaatttgacagatgtaattacagtacaatcgtagtgtaattacactgtaacttgcatgtaattacactgtaactatagtgtaacttgtatgtaactttcaaaaatctctccgttacatgttatttcggtaaaatggaggtcgtgggaacaaattctttcacatatgtgtgtgctatgatttgttttctttctcaccaaaacaaatcttgtaatagatccaacgattcaaaattatgtgaaacttacatataagttacactgtagttacatgcaagttacagtgtaattacatataagttacagtgtaattacactacgattgtactataattacatctatcaaatttttggagaaaaatttgtcgacaaatgtataggtagtccctattgcggtggcttacagttttcggtgttttcctttataatttccagaggaacagatagtctaaaaagggctagcatgtaatttcagagtactagcgaatctaccaatatggccatagaactcttgttggattccactaagggatttttctgataagtgtttaacatatctagatctaggtacgttaagtcagatttttttttcttgatcaaaagtcagaagacgcaatgatgaatacctggatttcaggcagtatgccgttgccgtaaacagaagccaggatagaaatagagaggaaggcattgaaggtctgttctgatttggacgagctaagcgtgtaatccttccccggagcatcttttgacagacctgttaagaatgatggttaacatctaggacaatgagagttagacacttaaactaccagtgcaaactgcagccctcagttgtacaattttgttttctgatatagcgtagctgaagaactagtaatcatgaatttgttaagtctggttctggccaaaccaatcaaatagcttgtgttgtgcctaaattagaattacaggtacaaaatggcataaaagttaaaattcctaatggtttttactggaatctgaaacgtctaataagtaacgacagtaatgcgttttgtggacatatcatacctagttgagtttgttccgttatcatgcatcaaaaaacaactgaaaagaattggctgcaaagcgcagtaatcacgttcattccatttgtattttgtcttgtgtttatataaacaatggagcagaatttactgtatatttatgaagaatactactgatagatatagggcatctgattcccgatctaattcccaaccttttgtggaatctaattcctccatctgctgcagcataagtttctctgaaatcttaacagaaaagttctgggaacacagagaggaatgaacatgtgacgcgagagttcaggcgatatacctgcaccaatgcaagcagcagatacaaggatggtgtagcccaagctcaagagcagagaggcaaagttaatgtgccgcagggaatggaatgatggtagctgggagaggaaggccagcgccacagctactatgatgatgaagtggtacagtttcaggggaccattgggagaaaggctcgtatacatgatctgtttgggcacaacaaaagaccagtttatccaattttgcaactgataatttgagctgtgaacactgaacagaaagaagttattaattagttgttttttcatgccaatagacgaaatctgttatgcaatttcactaactgtaaatgactttacagttttagaagattgtaattactagcaggccgactacagtactgactcctttctgacagaaaaaatatgggattgccagttctgttctatcattctgcccccttattgttttcttgtctgaacttagtatagaagtacttaggttgcaggcaagagactatgcaaggattggaatatcttcttcctccatacaattttaagctctaaaaaaaatgatgtatgttgacagctatgcagacatgctacgaataaaatcatgtaattttagagttagccttcaatagccatatgttcaatccttccaaggtcagaagtacaagcacatgaaaattgcacagcagcatagggtttatttcctttgcttttacaatcagtgatcaggttttgttccaaaaataagtttagcttttattgtggatatttgcaatcaaatgaacaggaaacaacctatacctgtttcaaattagaactactagagcgatgcatagccatcaatatccattgcaggacttcgttattacttactacctccatcccaaagtaagtgcagccataggtatccgtatccaacgtttgaccgtccgtcttatttgaaaaatttatgaattttttattaaaaaaagtcacacgtaaagtactattcaggttctatcatctaataacaataaaaatactaatcataatttttttttcaaataagacaaacggtcaaacgttaaatatgaaccgtgcaaaactaaacttatttttggacggaggtagtattacttattggttgcatgattatgacttgcttgcatattacaaacccacaagcaaagccaataaaatattaataaccatagtatgaatcctcccacacgcattagcaaaattagcatgccagcatatcgtctgggaccagctttcttactagtttgaatttctgtcgttgcgtcagtggatactggataacagaaagcaaccctcctatcctgaagcagctcgagtcaaattcatcagagccaaccatttagatcacaacaaacatggatggccaaatatttattgatctatgcaatacgatatcttattcatattctacattcacattaagagcatgatagcttcttgattttgtacggcaactatgtccaggcattcccaatttgttggatatactacagcttgtccaaacacaaacgacatgaaaactttgttccgaacaataaaccaatcatagacaacagcaattggcaatagtatgagcttaaacttatatgcatatcagacagagagttcaagggggttatgggaagcaacgatttgcacctcgaggcaatcggcggcgagcaggatggtgccgatgctaacgccggtgttgatggccgtctgcacgatgaccacgaagtaaaacatccacccggaccctgcgtgcaggagcagacgaacaaaagaaaaagcgatactatcatgtcgataattaattttgtgtctttgcgttggcgagctcaccaacgcgcgccatcctaattaatgggagcatggcggcgagtcggcaacagcacggcagctagtgtgactgtgtcgctggctgctccaccgccgcccgtgcacaaaggcgcgcgcgcggcgccgcgctgcgtccaaacgagcattgatgcgggtagctaaagctgtctgcttcgcttgtgggcattgcaccgaacgcacatggggcaatacacgggaatgtcatgtgcgtgtggtgatggggtgcagtggaaaggaatggatcaggggagttaatagtaataccgaggacgtcggcggcgagctcgcggaagcggatgtggcggcggccgcgggcctcgcagtgctcgaggacgcgggacatgagggagtactcgtagaaggtgacggcgccgacggcggtgagcacggtgagtcccagcgcccaccccatcccgcgcagcgcgtacggcagcgtcagcaccgtcggccccacgatcgccgtcgtcaggtggaacccggcgtgccaccacgtccctgcaaggtcgccccgcgacgggacccaaccacagatcacagcagaatcagccctcgcattgcgcgcggaaggcgggcggggggtggaggggtgtgacctacctttggactcgagcacgaaggcggcgccggcgtcggcggcgggcggcttggcggccgcgccggcctcggcgtcgaacgccgcgtgcgccatcgccttcgtctccagtcgtcccgtgccgcgccacgccacgccacggtatttatacgcggcaaaggcgacgcgaagaggagaggattcgctcggccactctctctctctctctgtggatgcgtgtaaatcccaagcccctaatctgatgaaccaacttaatcggtgcgttaattgagcggtaacgaggagattaaatgttgtaatctcgcgattactgctccaactgcgagtgccagaggctttgcggggatccgctttgatcagttgatcgtctactagtaggagtagctgtttggttctcgttgggcgcccggcccccgtatttatgctgcgtggccggatcggcggtgaggtgaggacgtgaggaggttaattaaaagggctctgttccaagtggacgtcgtcgtcttcggattagagtaaaacaaatcaaattggccaatctgactagattcattagactcacttctattgagtggtagcggttaacttttcacttgcatgcaaaagatgagcacataataattaagtatcaattattataaacttaaaaataagtttatttgatttttaagaaaacttctatatatttagtataaaaacattactccctccgtttcaggttatacgatgtttggacttcgatcaaagtcaaactgcttcaagtttgaccaaggttatagaaaaaaatagtaatattttcgactcaagataaattgattataaaaatatatttaattattaatttaataaaactaatttggtaatgtaaacttagtctaacttgaattagtttgactttgaccaaagtcaaaacatcttataacctgaaacagagaggagtatttaatagtttaggaagcgtgtgctaattaaaaaacgaggaatttgtaacatcaaaacgcccaaaccaagcgtgctaatgaaaaattgtgcttgttggcttataggctatcgtcggaatttgaattttagaagttattttttgttgattttagtgtgtgttttttctttctatttttttatttttttagttgattttatatcttttggataaatagaactatactataagttttaccctaaacacccttggatgctttctagaattgttgattgtttggatcgatggcaatcattattgtctcattttgccaaatttttgtgatgttcacgtggctttacatttcccatttttggacagaaagttttgttttatcccattttaagcccttctatttggccccctgtttcatttcgttgggaatgtttggctaaactactggatactaattacacgaccaaatggtagcaaagcgagatgagcgtgtttaagttggtgaccaaagttaccacaaccaaaccttaccaaaatttagtcacgatgacgatgagtgtgttttagtgtttggctcggtgaacaaaactgcctcaactaaactttatcaaattcccctaatacaactttaaatataatagaactcatgaaaattagtgcaaattatgttgtccgctctcatttactcgtttatgaacagttgattgatggagaacaaaggtaaacttgttgagagagaggtgataacaccctaggctctagcctacaacttattgaaggttgtcactactcggaagcccctctttctcctttttcagagttattgctggcattgagtaacctattcttttccattagttatctaggatattttattctttttcttgtgttttccctagatctttgataaatgttcttttcactcgttaaatctttatattctatttaactggaactcgcttaccgtaactattgctataaaagagccataaaaatcacatcatcacttatctttgacactctcggatgatgctttagcattccaattatcacataatctttctagcttccatgatttctttttggttgttggatagaatcatttttttggtgagatttatagcatttggttcatatttgcatttttacaactgtactatagcaccatcctacggtaacacacaggatgtcatctagtactacaacatttatttacttgtaatggcttttgcatgaccactttgacaagaaaggtgagaaaggtagtccgtgctaaatatcgccaccttatttaattggttataaatatctcctctagctttgtcaacaacaaaaaaaatataggttttggtcacaaggcagctgtgggcgactgcagtcgtagccgcagaaccacctaacaaacagccccctaaaaactagataccaaggtgcacactctaagggcacctttgattcagagaaaaacataaaaattctatagtaaaaaattctatgaatgcctttgaagtaaatgattgattcctatcatatcttttaaaaatcctatggaatggacaatcctatagagattttggagaaaatttagcatgagcttcaacctattgaaaaatttcctttgagtctatctctctcattcgattcctatgtttttcatgtgatccaatcaaacggtcattcctatgttttgcaatcttctattttgcactttcattcctatcagtattctttttttttctaatcctacgttttttcattcctacgattcaaaggggccctaatttatctacagaaatcaatggatttacataatcatcaataatcatatcgttgtaaaaacaaaaaatgacgaactcataggcagaatctttgttgagttttgttgtagcaattagtttggtttattcgctattttatttatgtcgatttacctaaaaattgtattaaccaagctacacttttttttcgttttattacaattgtttcacctttttcagtccaagaacaaagtaaacataggaactgttggatacgagttaataagagtggtaaactaagtaacttcacttgataaataggtagtccatttttcaattttgatttctaaaaattcttggtagcgtttgaatgtagatttaaggacaccaccctgttgtttttggatgaagagccgatggatgatggatttgtttatatggatgaaaaataaatatgatctaagcagtactgacgtaaaagagttttagataaatcatgtattttttaaagcacgggacaaataatctgtaaaagtaaccaattatcctaggcctccgtagatcaatttataccagtaaataggatatgccataccggcgtactttctccgttcctaaaaagtcaatttgtagatatgaatatgatatacatctatctagttcatcctggaagttagtccttttttctaagacaaccaactaggtacgaatatggataaaaatatggataaacatctgtctaggtttgtttctagaagttgttttttagatggagggtgtaccctaaaggtttgtctctctctctgagatggtgtaccccgaccattattttctcgatattaggaggaacgaaaagtgaaaaaccaagttggtaagataccgccagattacagctgatgcacctgtggaaaaccttgggtaactttcctgcggttcgggatgtttcagaattcagattgaaaacgttgtcttggacggacgttccaggaagattgcctctgcaaccacggatcatacatttccgcgacactgaatcatacacactttgtgctcctttttgctaccaacttacttgattattgcagttctttatttcactcgcaatgtacgatcgcagtgtaacatctgtagcggaggcaaaatcgaggattcggacctccgagtcgaaccgcactacacgcagtgcggctgtggaaaacggctagccccccatctttctacgtgtaatgttttgttttaacatggaaaaggggagctcattggatctatctaatctttttttaccactgtcttgatctggcaacaatgtactgacctgtcttgtctggtgtagtagaaatcagtgttagtggatgacttgtgaggcgcggcgagccaattgccgcgcggcaacacagaccacttaaggtagctcgagttctagcccaggggcaataacaatgacagaaatattcgtaggagacacaagaggggcagaggcttatcaggtatataacgaattgattcggattgatcagcgcatgaagaaacagccggctccaatcatccaaccggaagtcaattttagcatgcttgaatgcttatgtgtgcttcagtacttgagttgttgtctgaaagaaaatactatgttagtagcataaggggaacaaacgtaatcaatgaactggttaacacaaacgccacaagccggcaaatacggtttagttacagtacagttcatgtgcaagaaacttcagtaaggaaattactttggtctgaaaggatataagtacttaccaaaaattttggagcatgagtgccgcaaagtgtggaacaacaaccatgctgggcttccggactagttttttagcaccatggtgtcacaaaaggtgattcagggggaggcgaccgtgagactgcaaatatacaaatctgggaggcggcgaccgtgatacccgcaagaggtgattcaccagtatatatttacaaatatatattagaaaaatgtatagctctaccaatatattacaagccgacaattgcacatatacctaatgcttcccatggtgaggcaacataccaacatggtgatagcacagataagaaacatatacaggcagagcagagaagttagagctgcctggtagatcgaatcgtttcagtaaaaggcatggaggtttggaattagtaggaggaagattattaatagtaaaatcatgggaacatgtgatctaccagcttcttggacaccacaacttgctgcgtagtccaggcttgaggtacacttaaaaagcttcaatctcactattagtagatatcacaaacttgcctccaatttgcagctacgaggggtaggagtaataatagacccactatccagctatctaaactcttcagggacatgcatgccaaaaccacgcttcagcttctcaatcctattcaaggaaaatttgataactgtaagtcgatcgggatagtgataatagaagcaaatttgtcaagatgcctgggtgagagctaagaaattgacttgcatcagtgccagtacagttttgtattgtttgtaacaaaaaaatatctacatccaaatatgaacaaaatgatcgacagaaactattgtcattactaatgggtgccacgagctactgcaggaacaaagacaattttttagaaggaaccatgaaaaggtgcatttttccttaaattccttgactgacaaaaaatattaatttagacagagcatcaaactagataaggtctttaggtttggtgcgatgactgtgtgtagatttagtggaattcctatagtaaccgtggtgctactttttatattttgatctgaaatagttagtagtaatgactattgaaataaaataaattgtggcaacctgtatgggattattttccatcgtgttgagttttccagtagatggtcctaagaaattcacatgtttcacttagtaaagctaagtgatctagccagtagccatgtatacctacttctaagaatgagccaggaaacattgctctagcatgcaacatgacacaccattaccgcaaacacgactgatgataatgcatgtacacagccatacagctataatgccaaattgcaagtgctcagcccaaattcaaatcatttcaaattacaagcaacatggatgatcatggccaagcaacatgaagttcatggccttggtgattttatgatggaagttggaaaacaaagtaagcttgcaatgcttggatggaagattatatatacatcagcactacggattgttaacaaataaagaatagacaatggtaagatcaaaatggtgaaatatctttgatatcaattgtattcacagacattatgcttttgagatatatcagatgtttaatctcagaaaaagcatgattgtgatcatgagccaaatgaattctggaaaagaaaagcagaatacattactaagttcctgcttttatactaaagcagtttgagcaaaatccaatggacaaagtaattaatattcaaaaaaatgcaatatatgttgagaaaaagaaggtacgccttatataagataaagcagtcgactgtttggacaaaaaaaatgtacaaaatgtaaaaaaactcacgtgggagcaagtttgccaagactgcgtagcttcttgccagtttcttcatcagtaatatttccagaaatctctacagaatatgatttgccagagatgcgtggaagccctcttcctacaagcaaatctagatctctctgatgaagttctctgccattcacgaaaacaccactatccccactagcacagttactggccatcgggtaattgaattctcttatgaatggctgcgcattttaaaaaatcatcagaagttta

SEQ ID NO: 9171 - DNA, 612 bp, Oryza sativa
acataaattattaaaaaaatggtggggtccacatgggccccacatgtcattctcagcatctccccctcttcaactagagcccctcttcttcctcctctctctctcccttctcccatccccgaggcggcgggcggtgttcgggtgagggatggcagctcgcggcggccgggagaggagggaggcggcgcgcggccgggcgaggagaggcgacgtgcggtggcctggcaaggaaggaggaggcgctcggcggcccgacgaggagaggtgacgcgcggcggcctggcgaagagggaggcggcgctcggcggcccagcgaggagaggcggcgcgcggctgccggacgaggagaggcgacgcgcggcggccgggcgaggagggaggcggcgctcagcggcccggcgaggagggaggcggcgcgtgcggctaccgagcgaggaggggcggtgccgtccggctgggcatcgcgggcggagcggccgacggagtgtagctgtcgcgctcgccggcgacctcctcctctgcatcttcctcctccggcaacctccgccgcccgcggcctgccgccgctccgcccgcccctccgccgctccgtccgccggcatgctcctgccg

SEQ ID NO: 9172 - DNA, 2933 bp, Oryza sativa
gatccccctactgtgatgatcttccatttggttgctgcgccacttctcctctagtttctggagtatattgtagccagccaaagtcccattcatatggtacaagtgcttcacatcctcaaaaagatgccatttccactcttgtttcaaagcaacaggaatctccccagcagttaatggggttagtacttcagcaggaaacttgataacgttttccaatagcacagcatacccttcaatggtttctgaagccataagattcttggcatggacctttccagctgatgcaattttttgccccagaacagatatcttcccatttgatactgcttgcaatagaacttgtgttaacttgccaatgttcttacttggaaaaagaagtgcattcatcccatcatcaatctaagacatcaagataaatgtgtcagttagcatcttaaaatctacaataactggtatttgagctgacaagtacaatcctgatagaatatgatatgtatccgtgaacatacatattttctgataatttcaaggtctggagctataaccagcttctcaagacacatagcttggactagcacactcgggaaggattgctcgttaaggcaagaaccatatataacaaggtcagatataccaaggaggttgtccttatcttcagaagcaacatgttccactgcaccccttggaaagccaacatttaaagaaacagcctataataatcaaacagcacaagcaattagaccaaattttaaagctttaaaacttctgaaaagcaaatttagtgaagaaaggcagaaggagcgctaaataataacctcaagggccatcctatgcttctcagttacgttttctgccaagattctcactttgagttcaagttgtgtgctattctcagaaggatactgttgtaacagagaccctactgcttgtaagacaagtgcttcttccatcaaaaaaccaccatatgaaaattgactaccaacaatagaaattacaaaatcactcggacttaaacccatactgactctcacatcttggtcataacttttggctgaaattctatcttgaaatggtactgcaggggaacctggaatcacgaaatagttaccagaatcaaatgcagcatacatcacctgcaggatgcaaatacagttaaacagtctatttttaggtcgtacgactatattcaatgacaataagttatatgatccaaaagtaaataccggcaatacatagttggggaaaacaataacattcgccctactgaaggcctctttccaaccatctaagatctggatcattccactagaattatattcactaatacgatgagcaagagaactttcttgaacattccaaatgacgggtatggatttgaaaggctcctgcagaagactgtagatagtctaaatcaaacaatagattttgtgtaaactttaaggtatatcataatgctaaacaaatcaacaaacagctatagaacctgttgtttcatacctaccttgaaaataccggtcttgcttcaatagaatttacaagtatgccatcatagctgcagaaataatgcaaataaacctgatgaggaaatgattacgaagtgaggctgaggccacatgttatgcaattgtacaaagcgagaaaaaatgtattgcaggatacaacaaaatgagatatatacttcagaaacttactctagccaatctacagatatatgtaagtctgtgtcctcaggtaaaaggtcaactgtgaccccgatagttctccaaatattagtacaaggaccatccttaaatgtgaaaacctgcaacaataatttgtaaagggggtcaagggcaaaatcacaaaactattttttggcgaaattatagatcaaataacaaatgttaggtcagattctagcacccaacatgctacggatgctaccagtgtcagaaactcatgcataatgttctcattcagcacacttctcttcattccaacttttttttctttttgcaagccagaagcccagaactgacatattagcatatgcaacttttacattactggatactatcacaattcacacatgatggaacctgaacttattgcaaagtatagaatgcgataacaaaagcaaaagcaacaatatacccaacttctacgataataaaaaaactaacggaaaacataacaagagacacaggttgcactcatttcgttcgaccggtaagttcactacgcagtaatgaattcagagcgaaccagttcagcacgcaccttcatttcgtagcccatcgcctctagcaccgaggcaacgctaaccatctgaagctgcattgcaccgggagagagatccccaaacacctacaagggagtccaaacacaaacagcgaacgaatcaaaaaccccacgtcgcgagaagaaacttggcccaaatcctccacccacaacaccacacaacccagctcaactcctcaccatggcaagtcgcggcttccggaccccgaacctcctcacgggattcccgagcttcgccaagccgtcggcctcctccctccgctccctcgcccacctctccctcagcctcgtcggctcgaacgccacgccctcgcctgtctccaccaccccgaggccgcggggcagcagcgcctcagctccccctcccctcccgccgccagctctccgcgagggtagcagcatcgtcgggcgctcgaagacggccgatccggggaggaaggcgacgacgaggatggtgacgaagaagaaggccgcggcggtgccgatccactggaggtagtccaccttctcgaacagcaggaaccgcgccagccgggatctcgcgctcccccgccgcgtcggccccaccacggagcgcagcagcggcgacggcggcggcgggtgaccacgcttgtatccccccgcccccgcacccgcacccgcacccacaccgc

SEQ ID NO: 9173 - DNA, 2354 bp, Oryza sativa
gaaccagtagtagcagcagcaacagcagcagcggcggcggcagcggtggtggtggcagtcgactgtgctggactcgtgagcagtacaagtctctctctctctcttctctcctctccgcgaggcgttccgttcgctttggtcttggagatggggatgggaggaggaagacgaggaaggtggtggcgtttaaggcaacgcgagcgtggcgaggcgagctcgcggccgtccgatctcgatccgacggctcacggcgggggattcccgcgcccggagcatggaccccgctgtctcgggaaccggatggggatgggggccacacgggccacggccgcctggggctccgcgcgctgtcgccaactcgcctcgccggggtaggtatggcaggtgggaccacgcaccgtccgggccccagctgcagtgtctgggtaagcccgtgtagcaggtgagaaatactactcgcggctcgggcgggggtcacgtttcggtcttttcgacgagatgtttttctcgagcagcgctgtggtggaactggaaggtgatggaaatggaataaataattaatccgggcttagtaagataattccgtgtcattatcgtttcttggcacgcaatggaaaagtgttactaccacgaactaaatcttgagaggaaaggattctgcaggtggtggcggcagctttgattggtccgcccgtaaagtttttcagcggggtggggtacacgggggtttagatctttatttttcggggaaaatgaggctgtgactgtgaaagctcagcacagccacagcagaagcgtttctgtgaccgaaaggcggaaagatcgcaaccgtggccgtgccaaagtgtggatgtgcaggcggccggccgatgcagagcgcaatggcggctggagaatgtgtagaaagcatcgcctttgtagtttggcctccctgggaaccgaggaatttagcggaaatttcaaaagaaacaaactaatttctgttaaaagaaagttatacaaaattcttgtgttctaaaggagactttttttttagaattacacagtacaatgcagacactcacaacgcacgcgcattcatccctatgaaaatatgcacgcaaattctacccctacaagcatcttcgaagactgccggcaaatcctgaagagattgacgaagtcaccacagacgcctcgctgtcgacggatacgtcgcctaccactgaaagcacaagtcagcaagaatatactaacatggattcaaacttaaagagaatccgctggaaatttataatcctgcagctgtaagtgggcattttagattacgcagttcattgtctttgggaattaagaggattcgctcattagactaaactaagtgggacggtacggtttgggcgttggatgcttagttcttaatgacgttagcgactaacggagtagcgtgttaacacgtgcaaacaaaatcttcatgggtttcctagctactaatggccaatatgagctggagaatataagcatgcaaattgcgcggtcatgtgcgtgttgaatgccaaagcgtgcaaagaggaggacctatctgcacggcagctgacattgatttgctcatttgcatagtggtagactggtagtggagtgagattttggacaaaaggggctccatcacaagtaggctagagattgtcaccatctcttaggcagcgttctagagggtgagagagtgagtttgtttgtttcgtttttcgcgtacacgtttcccaaactactaaacggtgtgtcttttgtaaaaattttcaacggtgtgtcttttgtaaaaattttctacagaaaagttgctttaaaaaatcatattaatccatttttaaaatttaaaatagttaatactcaattaatcatgaactaatagctcacctcgttttgcgtatcttctcagtctcctcaatcccttcttctcaaacacacccttagatctgctcgcactaaaaccactcatcgtcgagactgatgtatccgatcagtaatcagtttgctttacaatcaagtaaacagtcagtttaatcatggcaatccaagcacaataattaagcattcaacaatgcgctctcccatcatgaacgtgtactgtagatcacaacagtctattcaccgccccagtcgtgtgctgcagttctagaccaacggcagctcagatgacagtttgcaacagaatgcaatacattctcagtttctcacaggactggtcggaataaggtctcctttcaagcggatgaattttggagaattttttttatgaattgaactaattcatgcaaattcttgtaaaattcatgcttggttatttacgacccacatgtactaatcatgcaaagttg

SEQ ID NO: 9174 - DNA, 3246 bp, Oryza sativa
tatcatacgtgtgagttgttgatatggtctaatgttaagaaaagagagtaaaatataggtctggtccttaaacttagactaagaatcttaacaaggaaaaaaagtcaattgcttaacaaataatctttgagttaaataacttagaagagggtttattttaagaatattaaagttgaaatttaagaataatttccaatccccttaaaaaactaaaaagaattccaattgaaacatgatatatctgttttgtttcgaacttccaagagatgaggcatcgaagaagaatatgctccagcaggaacccgacgccgctcactttttactccgaatttgtccacgccaatccttaatatattttttttaacctgtcgtgttggctcatctgatttggacgttcaaaagaattaaagaattactaatactagtacatgcacgtcgagaaagaaagatcttggaagtcgcggatgaatcgctttcagcgtatatataccaatgaaactgaaatatttactgtaccgatgtggaaagagttcattgcgatatcgccaagtacaacactgaaacaaatcttaattttgttccattctttttttgcttatcttgtggcgccctaaaagttttctaacaaaatcacttgaaatacagtttgtgtggctcatgcatgccctcgtggcacaatagtgcacacgaaaacgctggctatgaataatgagaaaagcataatcaatgacaaacgtcctgctgagtgcgagtgatgacaagggaccggccgtagcaccgttttcgcgaaaatcaagcaaaaattgatagtttccaaaccaattttaaaaaccaaaatttgaattcaaatttagagtaccttgaaatttgagtggtttcaccaaaatttctagtgaaaatagatttgggacctaggttggcaaggtcagttttcatgaaaatcaacccgttcctatcagtaatgaaaacccttcattagcaactcaatttacatatcaaaatgaaaaaaaaacatgagaaagcattgtcatttttctctatatcttgcccttgtttttaacatactcttgccatgaggtatctctcttttataacaaccatgtatgtactttttgaagataatgttttggcctttatcttaaaaaacgttgcatacaattacttatagagcccgtccgcaaattacaaatcgcatctcaattaaaaaaaaaacttaaaactctagtctagagagagataacttctattgttaaaccttaatactctctatcccaaaataagattatttttactccctcttatatttataacaaaataagtttatctttgagtaatcatcgcatcggtgtttatgaaaaatataggatgaatgtattggaagtagagaaaataggggatatttgcattatgatttaataaaataaaggtattttttatatttgtttatgcgtgagatgtagctactcctatcgcgatcgagcggttgatgatggactgattggattcgcggctagctattgctagggcaggctctcgtagtagttagctatagctagcttatcggatcagccaaggattggcgtgtggtaagctcacgctagaattggagagcaaagataggagcagaatttgttcggtcgccgcggaaacacaaggcgaaaagggcggtcctggattgctgatcaacgggagccatcggtgttggtcacaagggtaaacaacacaaaggcacgtactaatatggccttgtttagttctaaaaacaaaaattttcacccatcacattgaatgtttggacacatgcatagactattaaatatggaaaaaaaatcaattacacagtttgcgtgtaaattacgagacaaatcttttaatcctaattgcgctatgatttgacaacgtggtgctatagtaaacatttgctaatgacgaattaatcaggcttaataaattcgtcttgcagttttctggcggaatctgtaatttgttttgttattagactatgtttaatactttaatacttcaaatgtgtatccatatatttgatgtgataatcaaactaaaaaattttccccaactaaacaaggtcctaactcgcgtatgtacgtttggcataactatgatctttatatatacgcgtgcgaattgttcaccgtgtacagtgaaagttgtccggacatcctaatacgacaaatccctctttcaatatacgacgatattgactttaagatattagttagaccatctatcttatttaaaaatttgatgaaaacacatgaaaatatgcttaaagaaaacaagtcacaaccaaataaattacttaacatatttattttcgaagaaagataaacggtaaaacgttatatcaaaattgaacagtgttatatgctccattctcggatttcatattgagatatttgatttgagattagaaaactgggaagaagaaagaacatgttactaacgtgttatgctggcaataaatcacaccggatcgatgagtggcctctacgcgtgacacggcagtcgtgacagacgagtgaataaaaaataaagaaaaaataaacgaaaagtaagcgcatgtcatccaatccgagccaacggacgcggcgccctgccgtccggacgagtccatggtccaattcttgtctgttaaataatcatggtggctgcgaccaaaacagatcaaaactagtacacgtcacaaaacaaaagaaagagattaaggtgatgtttgtttgatgtctaacattgccataactagttaaagtatagtggcataagtgtggcttagaaatagttagccaaaatgtggcaagcttaacttcaaatttaagagtatgacatgtgggtccttaaggttatgaaagtgtggcataacacaattgccatagcgagccaaacacatacctaagaaattgtggcataactaaagtgtggcgtagcaaagtgtggcaaccaaccaaacagccccagtcccattactactaggtctacctccttaaaaaaattggtttattttgaaaatatccaaatttatgtatgaaagttaacatattttaggatagagtaattaattaatgacgtacaggtactaaaacacctttcaaatttttattacgtgtactagtactggcaataagagtgtacgactgtacgagaaatctcatctggtaatcccaaaaacatagcagtgataactcagctgaaaaaaagaaagtaaaaaaaaaagtcttccaaaacaaa

SEQ ID NO: 9175 - DNA, 11175 bp, Oryza sativa
aacggggcgcgcgtcggcacgccaccccacacaccacgcgagtacgtacgggacgacgcggcgcgcggctgctcgacggcttcggttctgagcccagcgcgcgcgccgggtggtttggttggttggttgggcgaagaagcgatcgaagccgggggtgtagtacgctcctcacccgactcgtttccgtccgggcgccgcgccgcgccgcctcgcctcctaccgcacgcacccccaacttgcgcccgcctacgctcagcgcacccgtttgagtgtacccggacgggaacctgggcggataaatggtggccttttttggatggatggtgctgaaagggccaggttcaatgaatcttcgattcgtgcgtgctggagtatactgtacagtgcagatcaggtgccactagcaaatgtttttgacaagtaaggtttggtttggatttcggtgattgcttggagtggcgcattcttgtcaaatgagatttaatatatacatataagatatggattttttcatgtggatgcaaccgtttctgttttcacgtggattcttgctaaatgagttatcctagtatattttttttccattgttgtgttcctcataaccaacatcgccttgtttggtagccaccgttacaattgttaaaagtcgctaaaagctgtagcacttataaaactgttgcaaccgcaaaatatcgtctaaacacggcctatattggatttttctaaaaaggcatgattctactttgtttccattaccttttctctaataagacaggtatatgcatctactccctccgtactcgtaaaggaagtcgtttaggacagcgacatggtcttaaaacacaactttgacttcttttttctataaaaatatttattgaaaagtgatatatgtatacttttatgaaattatttttcaacacaaatctattcatataatttttatattttcaaactcaacaacttgagagttattcatgatttatattcccaaggtttgacttaaacattgtcctaaacgacttcctttatgagtatggagggagtactaatatttaaaatccacatactctaaaacttcatttttgttataaacaaactttatattcgaagtttgcgaaacattcatatgtgattaaaattgtcgcaaactttttgttgcaagaaataaattttgttaccaataaatattcattatgtttttggaaggatgcatatttcattgaaaagaagcaactttcctccaaaataacatatcatttccatcatgttaacgcgaaaacatctattatataattaaagaaatagaaaaaggagcctccacgttcgctctcatggtctagaaattctcacattaatcggagaaaaataaaaaacagagtccatatagaaatacaatttagaaatagctaaaattcagaattaaaaaaataaggaatattaaaagaggagactagagtccatatagaaatacactttagaaatagttgaaattcggaattaaaaaataagaaatattagaagaggagtatagagtccatatagaaatataattaagaaataatagaaattcggaattaaaaataaggaatattagaagtagagtatagagtccatatagaaatataattaggaaataatagaaattctgaattaaaaataaggaatattagaagtagattatagagtccatatagaaatataattaagaaaaaaaatagaaattcgaaattaaaaaataagaaatattagaagtagagtatagagtccatataggaatttaaaactaactaaaatttggaaaaaaaaaagaagcctccacgtttgctctgataacattaatcagagaaaaagaaaaagcagagtccatatagaaatacaatttagaaatagctaaaattcggaattaaaaaataaggaatattagaagaggagactatagtccatatagaaatacaatttagaaatagctgaaatttggaattaaaaaataaggaatattagaagaggagactagagtccatatagaaatacaattaggaaataactgaaattcggaattaaaaataaggaatattaaaagtagagtatagagtccatatagaaatacaattaggaaataactgaaattcggaattaaaaataagaaatattagaagtagagtatagagtccatatagaaatacaattaagtaaaaaatagaaatttgaaattaaaaaataaggaatattagaagtagagtatagagttcatattggaatttaaaaccaactaaaattcggaataaaaaggagcctccacgttcgctctcatggcctagaaattctcacattaatcagagaaaaagaaaaggcagagtacatatagaaatacaatttagaaatagctgaaattcagaattaaaaaataagaaatattaaaagaggagactagagtagttattacacattagtagttttgaaaagttattgcaaaatttaaaattatgttgtcattgtaatatattttataataatataatgagaaaagatatatgcttttatatgagagaaaatataatgatgctagccgcgcaatctgcgcgggccaccatgctagttagcttctaaaacatgagaaccgtccaagattataagcaacaccgaagatgtaaaaaagctgtaccaccattcgtacttagacagtatgtcgtgctaggtgcaaaactaacattcacattcacgaccacattcaccgccacgacactggtatttttaatgaatatttttggcacttttttcccatcgcgtcccatttaggtgcacgcccgcggggtggcctcagcgattttgtggtgcccccgtgctgcctctccatctcttttatagcaacaaccagcgtatgcgttctcggtttttctccgcggcgctttcaccgctctctctctctctctctctctctctctctctctcctccgcttcttcctacaaagccgtgggcgctgctcgccgcggcgggtctctctcgcgcgcgcaacaacagcagcctcaaaaccctagctgccctcgcgaccgggtcagggccttcgattggatcggccattcggttcgttcctccaggtgcgcgggggctatcgaatcctctgttctctcttccctgttcatgttgattttttttccgagttctttttttttaaccgtttgatgcagcggtgggtcggggctgttagtttttttttgtcgtttcccctgctcaaatctgtgtatgttcttgtttggatctcgtagagtttgtttcgaagctttctgggcgattctttttttgaaatacaggttggtgttcttcgcctcagcctcttgtaaatcgagtgatttctcggtaggttgtatttttttcctttgcgatttgtaatagtacaagtttttgttcttttctttgtatttacaaggatctttttgctcttaaaagggccaaatttttatgggttccctttatttggacggtctgtgttcattccggaccttttccttttgccctcttttatggtttctgttcagggtgagcaatttggtgatatcgccaccaaatttgatggtttggtccttttctctcatggttctaggtcctttttatgaatccttcactgcaggatgtgcaaattcatctgatatgtttcagtttctacttgtttggggttacttacgttgatttgatgacaccactcgtaagagtggcaaatagttaattattccatttgatgagggaagtggaatatcatttgcagtgttaatctgctgtgctaaatggcactataatatattatagtataatactcttaatattttcggtaaaaacaaaactctttagtagctgatagaaaatgtcacttagaatagtataataggtataatgcctttaatagttgatacttgatagaagtgagtgtttagtggcttcacacacctactgaagacatttgtttgtttcgatggagactgcaaaactgatagatgggctatctagtattagttctaatggaatctgaaaagaatttggtgttcttctaattaccctgtggctaatacctaaccagttatgctgcacaataccatggggtacaaataacctgacttatatattcgatgttacatagattttgccaattccctcctcctatttactttacaaataaacgaaacagtgttatatacaagtatttgatataagtcgtaatgttttgttactgatattcacaatatgcttttttttgcaggatattgttggtacttgcattcctccgtctgttattcaagaaagccagtttacactgagagaaccttgctttatttggtaccactcacctttcctatcttctattttctgcccagagtagctacaattttcttcattggaccattggtactcacatcgttaatcatggtttcacgttatatgcaacgacacactaatctcagttctttgtgctttcaataacaagaaaatgtgttcatagtcgcggttaaagttgccaagagtaataacttgatatggtacccatagtcagggttaaaattgcgaagctgttaggtttagctacctgttaagtaagtgaaaccattcaattcagtccagatggcatctaccaatggagcccaactttgagcattagcatgtccataatattgtatgcatgaaaatgataccgatatagaagtatacattataaaagaatatcatcaatcatagtatttgaaactttcaatcttttgttaacatatgcatgtaaccactaatggttaaagttaattgtggagacactaatgtccgaaatgattcacttacagacgaatgcagtatatttgagtaacggaatgttgtacatacacaaggatttgctttaaagatatgcaaacattgaattgaatccaaattaaactgtaaagaccatttaccatgtgatctactagtgttgatcatgtcaaaagtccactgaattttttaaatagattttggtttccctttgttcttcaactgtcatgatccttcactattatggccctctgtagacattattttcaaagcattgcacaggatgagattcttgactgtggcttaactttttaattagcaggttcattggccttttgttttgcctgagtgaatgcaattggaaccttctgggtagaagctgaagcttagtttggaacttcatcatactgatttcatactcagaaagtggcgagaaatggatcgtgatgatatagctggtttcgtaagtggaggttgcaaggccttctgagttttctgacgaagcagatgataatagagttatgatatacagaagtcaggcaactggttcttttcatttactatttggttgacgtttgaagtttgttaactggaatggacaaagcatcatgtggccttgggtttggtgatagtatcaactccttagacacgtcccgtcattggagcactgttcagcatacttctgggcttaaagctactacaattgactattcaacgtattccagtttttctattgcaagctcaaaaacactaaaaaggaagcgaagtgctatggcaggaccagaaggtactggaaacccattacttactttgggtttagggcactcaccaagttcatctgacaatagcaaagttagttctgccacagcttatgcaatgtctccatcttcattgaaagaggctgatgaggagtcatcagctgatcttggcctgaattttgagctttgccttggcaatgatatggtacattgtcaaaagaaatcccctgttggtgctgagaattcaccattgacaaactctcataaattggatcttcagctgagtttgtctactggatcacctgaatcagctgtcaccaacacaaatatggtgtcaccgattattcacggtggcttggagatacctgttaccaactgttcaccagctattataggggaaggatctgtaccctgtacttgggttttcgagaagtcagtgatttcatcttcgtatgcctctgaagcaacatataccttcccattttcgaaggtacccaaaacaggggatgctgctatgtcttctccagtcatatcgtcaaccttggtaacaagtatgaaaagcccagttgcctgtacttctgggtcaattaatccccaacaacgcaacagtatcactaaaaactgtcagtttccaggatgtgttaaaggagccagaggggcatcggggcattgcatagcccatggcggtggtaggagatgccaaaaacctggttgtcagaagggtgctgaaggaaggaccatatattgcaaggcccatggtggaggaaggagatgccaatttcttggatgcacaaagagtgccgaagggcgcacagaccactgtatagctcatggtggtggtcgccgctgcagtcatgatggttgttcccgggctgcacgtggcaaatctggcttgtgcatcaggcatggaggtggcaaaagatgtcagaaggagaactgtatcaggagcgccgaaggtcattcaggcttctgcatctctcatgggggtgggaggcgttgccaatttccagaatgcacgaagggtgcacagggaagcacaaagttctgcaaggcgcatggtggaggaaagcgatgcacattctcgggttgcaacaaaggagctgaaggcagcactctcttttgcaagggccacggtggaggcaagcgatgcttatttcagggtggtggtgtgtgcccgaagagcgtgcatggcggaactcaatactgtgttgctcatggtggtgggaagaggtgtgctatttctggttgcaccaagagtgctagagggcgtacagagtactgcgtgcgccatggaggtggcaagaggtgcaagtttgagggctgcgcgaagagtgcgcaggggagcaccgatttctgcaaggctcatggtggaggtaagcgctgctcatggggccaggttgacttgaacttcggtgtcggcgcaccacagtgtgataagtttgctcggagcaagactggtctctgttcagctcactgtgctttagtccaggaccattgtgtccgtggtggtacattaggcgctgcaaccttccagttcgcaactgatgccaaattcgacgagatggaagtcaccccagtgaagggagatcctcacgcgcaggcaagcagcgacgaccagtctcatctcggtggtgctcatcctcctgctgtaccggcgatcacctcggatcgattttctgaaggaagagtgcatggtggtgggctactggccttactttcacggggtggaaaccatgcgaatgcaggtaactcaaagaatggcgcccttctaccatgatgacatgggagtgagattctcttcaagaaattggtggctcgcagttttgatctgtttccaagagtttgtgctgtgacggacgggaaaaactagtgttttcacatttcaccagatgttcttgtgatgcttggatttgttgttatggccctctcccgtgtgctatatataaataaggagctcgtagagcgtggagtaccgggctttctgtcttccgtgctattgtagttgatgtcgttgaactgcccttctgtcagaattcatgtaatcttggtacttcgtgtttatttgtattgtcagtgatttgccttgctgctttgctgttggaaaattgtcgtgtatttttgttgatagattatatatattgccttttcgttgcaagcctagctgttaatacgctcgtttcttgttttacaattattgcagctgatcgttctgttctttcttgccgaagaggctttctcatagatacagcaaggccataatacaattattttttctttgcaatttagcacggacagttgagtggaatctcccgttattgagttgataatcttcggtccagagaatgacaagaaaaagtatgcgagatcaacacaaggtccggcgcaaagccaaatctacagaatctaggattgcaactcgatgtcctggatgatcacacccatcaaatgggcaaatttacaaagcctcgaacatcagcggggcaggacaaaactggacaaaaacaatcacacccatcaggttgcgaccggttaggacattagtcgaggcaaagaatgaacaaaatttcctgctgaaagaatcatcgccctaagtatgtggttaagtgctaccgatctaccgtcctagtatcattcaagctaccagcgtcttctggcggtggctttatatacctccctaaagttttttgtcgagctctcttcttgattctctggatcttgtctttgctctgctgcttcctccgctccttctcctgctgcctcatgttccgctcccgctcgtacacgccttgccagaacacttcgccggttttcggccagagccacctccggtcaggatgatcctcgtcgaactcttctgccaggtcctcgtccatgctcttcagagtggcgagggagaaccattggattgacatctgacctctcctgccgttgagcagatgttgctcctgcatcgcaccagtctcggggtctacataaaccatcctccttgaactgtggaatgcccaaacgtttacgatcaactcaagaacacgggagtaacagtgttggtcctgtgcaaatcaacagagcaacgagacagaattagagaaggccataaagaaaactaatggaagtataatagtatccattcgaactctcactatgttttgaaattttcagatctatacatgacactacgtgtgagcatatttcattgaattcagctgaactgcgctgcaactgaaagaacattaaaatgaaatttgtttcatctaaataaagtaagagatggacgcaccctgtgaagactcaatatgcaatgccctgtttcatgatgtttgtcgtacatttgtgcatccagagcatctacaaacattctggaaaattgcagcatatcagtagtggcaaccaagtagctaaaactgtactacctccggtcacttttatttgtcgtttcagacaaaagttttggcttattttctttgtaaattccttgtctcaaacgtcaactaattatgaccggagggagtagattataagacaatcacattgggtggggtataaaagacgagcaatgcagctatataacaaatcaattgaagaaaaggctatttagatgcctaccatgatgctactatagcaagaattactttgaccacatgccaattgaaattgaaagagtttactttagaccgcccaatatctgcccaggtaatcacaggctacgctgtaacatttgaaagtattcatgttaacattcattgccaccacaccaattctgcgtactttaatgttatacgtttcagcatattgttaatctctaatttcagtctctacagcaagcttatcactgtgatacaaattctaattttacaagtttttaaaaggcaacagtagttggtggcagtgaatcctattacactttagtctttctaaatattgctaatttcatatttccatccctaaaactcaagtttatcaaggaaaggtccatgattacaaaatcatcacatatacatatcacagaaatggtaatttgcaattagaacaatgtaaaaagaagttaagtgctccctataataacaaaagtaacaataatgtgaagtgtgttcactgaaaaaactctttgtttcaaacaatattatcacatgtacgattcatttttctctagtagaaagataacaggcatttagctattttgagcaaatattagtagcagtgttggtgtacttgtgctttgaaatgtatacaccaacagttagctagtgacatcttccacttaatactgctatgttgactattgaattccaaaagagataatgtgcaccttgagaacattacaaattccaggaatgatctcgtaggcaaaacccagctttgcatcacagaccaagtgtctccatcattaggcattagtggcagggtatgcaaatcatcatcaagctgcacgccatacatcctttgaaaagctttcagaacagctgaccttcaagatagtaattgtgtagtggattagttcatccataacagcattcagttcagtttggcagcatcatcggaaattctatatgatgaagctaactgcttttggttggaatattgatattcataaacagaaaagtaatgaaaaaagtcttgcggtttagtaataatagtagaataaacttatgagttatgtccaatccaaacaaaatcattttaaactggagcatttgtaatactggaattgcagtctatgcagcatgtataaatggttaacctgcaattcccagcattgatcgcatcacagaaggaccagaaatcttggcttgctaggttcctttcatcttggtccatccgaacccaaaaatagaaggcatctccatgcttttgagtttgaatagcttccaaaagtgcagtttcagcctttttcgacaagtttgcctgttcagtataaattgttggcttaatcattatgcaagacctctctgctttgcattcttaaaaggatcaaagcatatgaataacatggttaaccaatgattcattcatcaagtaaattcatgatttaccaatcatacacgtcgattaaaattaagggggcttaaatgcaaataaaatttgatcttctacctttcttgctgtcactctccacgactgaaatcctatccaagaatttttatgaattcgatcaatcctgttggctagagcaaagaaagctccaaattcaccaagaatatctctgtagtacccattgttcagcagtggaagacgagaagaagcatcaatgtcatctgcgccaggccttcgaccttttgaagactaatcaaaaaaataaacttcattgatcaatgtaagtcattggaatatttggaaacagtcaattatatttggctagccatatatatgtttcatcaattacccttttatgatacatcattcttctcagactttaggataaagtttagatggattagatatacagaagcttgagagctaaatggatttataattctggaataatcccctcaaagattgagaaatcatgaggatctctccctcctgaagtggctcttcaagccacatgcgacagtttgcaagttatctccaagttaacatttagaaatactgttaggttttcatcaaaagttggaaattcccactccatat

SEQ ID NO: 9176 - DNA, 9988 bp, Oryza sativa
  unsure (1)..(9988): unsure at all n locations
aaaaaattctataaaaagttgttttaaaaatcatattaatctattttcactttttttaagctaatacttaattgcttatgtactaataagttgctatgttttacttgtatggaggattaatttccaacttgtagggcttgttcagattgatgatattttcatccatatcattatttggtaaaattgacaattatgtgggtacgtttaatttgttaccaaatattggctatgtgtatagaattttggcaatattattaagccaatcctatcaaaattttggcaatgatgccaatttgccaaaattttggcattgtgggcctgttcagattgtagccaaaataaacttttaccaaattttggcattgctaaaattttgggaagataacaatattgctaaaattttgacaggatttgttatgtattaccaaatttggcaataaactaaacgtagattttttttggcaacttaaaaaaatgtatggttgaaaatagcatcaatctgaacagcccctttgctaaggtttattttgacaccaatctgtacatacccgtagtatcaaacatagcctaaggaatatgctaaaattccatttggcatgcatgtctattggcattactgaaagaacactttaactatttcagttttgctcacccaatctccaaggaatatgcttaggatatctcttagtgtggattagagtcaggccaaagccgaaagctgtagcggccagaggagagacccaccccagaacaaccacaacccacgcacaaacaatgcagatgagccgtgtggcatctgcatttgtgtaaagtggcatgctactttatatatgctgagttatcgtttgaagaaatatgcaagaaaattataacccctttcattggcaactctgtaggccaaaaagctcctgatcttgtcgtgttggaaagtattttggatataatattttgatagtatgtatgccaaggtcttagttttgtcaaaagatagcaagatggcaacagagaagggaaaaaaaaactggctgatctgatctttggctgtaaatgtgcagatttccatgttagctttctgtacatgtactgtatatgttgctgttgatacacatggtgcctgtctatctgctgctgccctgtctactcctttctctgatcccggacaagaaatatactgcttactgtttcatatactttcagttacctttatccattggtgaattttctcatgagcgagagagccagagagtgatggctctgctactcatcaccatgtcggaagcaaggttcacaattccgttctggggttaaaatgcgagcccagcgactaccgagatgtcaaatttcgtgaattctgaatgaactccgccaaatttcattcaaaattcgatagaaaaaaaaacaagcagtttaagagagcttcgaaatttgtacgacgaaattctaatgaaattgggaacctgattggaaccggtgaaagagcaactgatatcataaggctatgtgcttatgttggttggatattgtgctgtcagcatcactaccactatttcttgtgccatcaactcgtatttccatcactctggcctgaatattgcatggttacattccatcgaacgctggttaggtactgctccctccgtcaaaaaaacaaatctagaactgcatatgatatattttagtacaataaatctgaacagagatatgtctagttatatctagattcgtagtactagtatttgtcacatccagtactaggttggttttttatgacacggaggaagtactacttactactacttaacgattactcctactgaaaatctcggtagctaggctcggattagcaagcaaaccagaacgcaatttgaccaatcaatctctacctcttttttttttcttttcatctccctcttttttttttcttttcatcgcaaaactccaaggcggagatcacaatttcacaagtggtttgcatcaaaagggaggccaatgtgttgcgatgcgaaggtggccgtccctgtcaaggcgatcttgtgttcgtgaggttggcagggctagtgatgtgtgttcgtcgcttctattccatcattttctccgaggatagaaagaaaggatggatggatatgtggagatcgtagatagatcaacagtgatattttctttccccgcggttatgtggtcgatcgtggtcgccctctgcaatattctccccgttctttcaggaagttcaggttcatgcatgatgcatgggagtatgatggcctttgggctcgtgatagggtagtaactcattggtaggatccagttggtggaattctgtagcaccaatagacacatatctgtctggaggatgaagaaaaagggcacatatctactgatctcgacgtgtgataaactttagcagatccctcctccaaccgatactctctccgtattaaaataaaatatatggtaatccagcattttattagataccacttaacattattcataatattatgtagtatttaatcgagtactaagttactatattttaagacaaatgtattatgttatcgtaaaaagaaatcagagaaaatagtgtatacgcttgctggaaaagacgtacttcttgtatggtcaatgacttgtatacgtgtttctaaaatacagtagactgtggactttgctattttaattagctggaaacgagaaaaatgcatgcatgcgaatatgcgatgcaattttgtggcgtcgcgtgcagtggaactggaacgagccaacgacgacgcgttcgcgagactagctagccaaagcacacttctctttgagctccttgaatgaatattttaagaaaccatatagttcagtgacttttctcatgcaaacgttgccacttgatagcacattcgttgaatcatgctgttctaatcctaggcaagtacggagcaaggacaagtgactcactcaataggggtcatttacttaatcaaaaggtgattagtgattctctgggaaatcagagtgaaacgatctcatctaagtggccgttccatacatgctttgtacgactaataaataacagatcagctgtacgctcttaaacatggcttaattcgcggagttgcgtggcagctttcacggagcatctatacccaatatctaatttgccatgcttggttgtgattgtgttgtttatacagaaaaaaaatgaattactattaaataagaagcagtgctccagatgaacttctcccctgatctggacagacattggacggacagcctttgttatacagtgtggtagcgcaccatttgcagatattttatggcatataagttggtggaacagcgtcccaaatcaaaggtggtgtgccaaagtctggaacagtttaacagctggccacatattccatttttctactttggtctcgattgtatcaatggttatgtggcccagtgttgactacaaacagagctagccatgaataaattattccattctccaaaagagtgagccgtcaagactctaacagacaggttgagttgggatcccatccctccggtacgaaaaacgaagcagtctattagcacgtgattaattaattatttgctaattttttttaaaaaaatggatcaatataatttttttaagcaactttcgtatataaactttttgcaaaaaacacaccgtttagcagtttgaaaagcgtgcgcgcggaaaatgagatgggggagttgggaactccaggtaacgaacagagccaaaatcgaaattccaatagcacaaaagcatgtggcaatagcctatgataaaaagaaaaatctagcgatagtgtatatagtcagcgacaggtcaccttttttttcccagagaaacatcagagaaaatagaaggcacaatacatcaaagaattgtctgtttgaactttgcataaagagcgctgataagaatcccttgaaactcgaagaactatacattttacagggaacaatcatacataatttctcaatcatgacttcgccttcgccttgtgcgtgatcctagttttaacgcctcctgtattgaaaaatcagcaacgtgagcattcatcaagcaaaagtgtttcgaatctaatgtcaagtatgaagcaataacatctaagaacgcattgcatccttcttttaaattttaatggaaacaggatagatcgccagcattagctaaacaaaaatcagcaatggcaccggaagaaaatgcacacgattgagtgtagaactcatagaatcactacaatagacctattccaatttctcaataaccaagcaaatgatatcatctagcgctcatgaaggatgagatacataccttcagcttcctcaaactcaacttctttaatcacttcagcagcagcatggtattcaaacctacagagagaagaacctgacaaattagactatcatagactggcaacaaaatgcagtaaatgtctaaaggcatctgaggtgctagatcagaagactgaacccaacgacactaaccaatgctgagaggttcagtaaaaagtagcaactaatcacgaataatgttatcacgacagttggcatttgctctcataaagtagatgctaataggaaaatagatatcaatagcagttctaacttccaagtgtttttgggatttaaaatctcatacgtttgcattcccagaaaaattagctacatgtgagatgttgttcagagtacatcctatggttaatagtatgggataccaaagcttcatcacaaagaccgtagccatatacctgttagaagaagccacttgaggctgatattcagaattgctcttaatagccttaattataatatccactatttccttctttctagtgctggccattaaacaatcatactcagttggcacgatgattgcaaagaagttatcactgagcttgcttatacatagcttatcgacagccgcgagcgctatcctcctcttcaatatatcagcatcaggatcaacaaggtagagagcaaaatctgtgatcacaaggatgcgccttttcatctttcctgattgagtgaacttcaataccttatctgcaaacagaactttgttgtcccctgcaatgtatcaaaggtcatgacctgctttagaaatctggtgatgctaaatacaaaaagaacatggtacagtgagaatatcatatgctgtgcatagtacaacatatttagcagcaggaaccaacaattgccgtgccgcaaacaatttcctctgcttggagatgattcttcacgctacaataggctcttaaacatcaatgattagaaactagtacagcattcacgcaaacgaatgatttaaaacgcctttagcagctaggttgcatcaaatcaggttgtcaaccaactattgagcagtattagccaattctatatgtcactcaagagagtaaaaatcagagagaaactgcacagcagctctaatctctgcatggttcagcacatcaaatcgcacaatcaaaatcactttgctacgggggcttaacttgtatatggagctatcgatcgaatcaacacctaatagctgattgacaattcacgacaaatttattatccaaactagcactgccacatcggaggggtaaaagaaaatcacacctccgccacggatcagatccaagcaactgaaccaccgcaacatgcacgatccgaacctaccaacccaagatcgcaccccgcaggccacagcacacgaatttccgaccaaagaaacgggaggggcggggggcaccttgcttggagaggatcttggtgaggcacgggtcgttggggacgccgatgtagtcgcccttgcagtcgcggtacaccgccgagcggcgccgcacccttgacgccatgaggagccccgccgcgggggccgccgacacgtcctcccccgcgccgccgttcgccgcggccgccgccggcgggggcggggcggcggcggcgggctcggggtccacctggatccgcctgagcggtcggaaccggtccatctctacggatcggagtcgtcggagggggaggaatgaggtggaagtcgcaagaaaggaggaaaacggagagagcggtcgcctggttgggccgtcaggttaacgcggttaggcctttgggcccaatttgcggtcgtggctttgggcctttaatggagtagcatttatataagctggcctgtttgtttcgttaagagttctttttttttttccttttttttttagagacagagcggttttctctacgttttgccgcccgtgcattgcaactggctcatgtgatatgagtgagtatactgggattggatctaaccgattgctctaagatcaaccgttttttctgattttccttttaaccaatcgtttgatttgtttttcctgattttcttgaggatggggtagttgtatgtgcaatgtgatgaaggaaagatacgactgcccttttatagtagtagggataatggagtgtatttcggtctctacttcaaagaggttacaaccaattagtatatagtttgtagttcaaccgactatgtattaccgatcacggtttgtttgatggataacaaagaaaattaattggaatttggaacacacagaaacacaccttctatagttggtgaaaaacctacatgttgtgtgtgacatcacacactactacgaaaaccatttttcgttgcggccattttggatttttgctggcggaatttgcagccgccacaaagcaaaggccagtgaagatcaagatcttcgctagcggttattgaccgccagcaaaaatccattttcgctggtggtcatcttaagccagccgccagcgaaaatgtagcaaaggccagtgaagatcaagatcttcgctaacggttattgaccgccaannnnnnnnnnnnnnnnnnnnnnnnnntcttaagccagccgccagcaaaaatacattttcgctggcgttggcttaagacagccgccagcgaaaatactcatgcagccgacccagtgattcattaatttcaaatttgcgagatcaacatgtagatgtcgctgctcatttccagaattcagaacatgaaatacaaaattatcatcagcacatatcaaacatcatttacacaatcaaacatgatttacacagatcaaaacatgtgcatcatctggaacaacatgcaaaaagaaaaaaaatcaaatctagccgacgacggagcaaggtcgacggtggcggatctggcctccccgcggcacggaggcggtggatccggcctccccgcggcccagcgacagcggatctggcctccctgcgagccgccgcccgctcccgagcgccgccgcgcccgagctcgcctcccgccgccgttgcccacccgcctaccgtcgccgccgcacgcccacctcgcgtcgtcgtcgtcacgcctaaaccgtcgccgccgactgtggggtgggaggagctggttggtgaggatggatggcgccggaggcggtggagaagagagggaggagagacgcgagggagagaagggagggaggggagctggagagaggggacgggtgggtggtgggccacgtggtctatattaatagatggtggtccatctatgcaagctgtccttctaccgccagcgaaaatctattttcgctggtgattgcttaagtgggccgccagaaaaaataattgcattttctctaccggtctgtataacacaaccgccagcgaaaattatccatctttgctggcggcgcacctaagtgaccgccagcgataatagacatatcttcgctggcggctggtataacgcgaccgccagcaaagatctattttcgctggcggtcggtgccccttaccccctcgttacaattttgctagcggttttggtatttttccgtcagcgaaaattatagaccaacgccatgaaaaatcgttttcctagtagtgacatagcaaccgcgtcaaagatgaagttatcatcagaggacaactgaactgcaaattgattgcccgcttgcccatatgcagctacggaaggtgtgaaatagcaaatgactactatcgacaagctaagagtcggtgtaggaaatccaacgacatccattgtacgaataaggttctccagaatgaattcgaaagtacctttttacatagagtttcattgattatattacaatgtagttaaccactcaatgtggttagagaagcttgaacaaggacaaatttagtatagctttagttccagcttcactcgataagatactagtaacagagaatgaactagataggtcaaactgaattcaaattattctataacttcactctaaattcaactcctagagttaaatttaaaagttaaaccttactaaacagactctaattaatggcctgccacttcatgtgtccatgagtatggtggaatcggcgtagttcatgtgtcctcaaaaaccactattgtgtggcagatcctcaaaaatccttttccatttggttgcctgtgatcgcaccagagcggttagagcaagtgtacagtccactactactagcttcaatttatctatagtcaatctaatagccaattcatataatagttgtttactatattattaatatatggttccaccagtcatacacactgtgtcttggagtccgtactacagctggctatagatctatagtccgctgcttttctcccttatcttttattacattaaaatatgtttatagccggctaatagtttgctattgtacctactctgctgaccgagctaagtcagaaaaaggaaatataaattgatccggggtgcgtcgtgcgcgacttttctgtgacctgagccgttgtgtttggtgctgcctgccaaccacacggaaagggcagttcttgcgcggttgggccggcaaccgaccggaccaggacgcgtcaactaccgcaacggataccaacgaacctagccggcctccccccctcccccacgtcgtccgggccgtgagccgccacgtggcgctccctcgctgcctctcattgtgctctcggcgcggtggcggcggcggcggcggcctaatcgtgccgtgagcaagaaaagtggcgccgtgacaagcaacgcaaaatgtcaccaaagagagaactaaatatatttgcttcactagataatctactccagttccatagtccgatagtttttttttctctcccattatttctgggaggagaagtggagaacgttgacatatttgatttttttttttgcgtggtggcatggattaaattaaataccttaaatcataccggtcaatggtacagagttcagagttggtcgtcagcgcgagaaacggtcagtgccgtgccacagagtcagtgtacagcatcgttttctacttgtatcagcggctgaaaggcggtaggagaggaggttacaccagcagaaagtacaaagccgttagttagagcacacacttaccccgttcgtgcgcggcattggagacgtgccaagcgaccgagcacctgacgatgacggctacgttatccaccatcacgtatacagtttgtgaaagcaaacagcgtagagcaacctgtcgcaagtctcaaaacagcctgaacctgactgaatacttaagtgttagtgtattgtgtatagtggttagagcccgttggatgcatgatcggacggctcacaccccatgcaatttctgcatgtgaaacctacctagaacgcctattcgggaaactcttctcatcacggtaaattcagcaagttcaggcaacaattgagcatttgggccagtgacagcacaccattcgcctgcgtgctagtattagccagtcaatgtacagcgatggccaaaaaaaagaaagaaacgggagagatttttttttctttttagcaactgctgtgtgctgcttaaaaatggggctgcgaaaaacctctcgcggttagcagcagcacgcacgattcaggaaggaaacggccgcgtttgctttgctgctccccataactccctgcagtttaagcccctccaaacg

SEQ ID NO: 9177 - DNA, 14906 bp, Oryza sativa
tactttctgcatttattaccttatatttttggtgtcatcatcaaaccacaatcaagttcgtgttcatacgccgatcaaagcactttggatgaaaatttcgcacgtttgacatcagtttcttccctttttttttatccttgtcaggaaaggaattcaatccgtgccatccaaagaagcagaggaagaaagaagcaatcaagaagagcgcgcgcacttgatccatcgtcctatcggcaggcaaggctgatcgccgatagggatggagcagctccggcaactcggcgaggcggtgggtagcatcaacgcgctcatggcgttcgaggacgacctccacatcaacccgcggcagtgccgcctcctcgccgacgcctgcgcgcgcgcgctcgccgccgtcacggggcaggttcgcgcccagctccgcttcgacgagcgcggcgccaagtggcgcgccatcgaggcgccgctccgcgagctccaccgcgccttccgcgacgccgaggcgtacgtcaggcagtgcctggacccccgcggcagctggtgggcgcgcgccgcggccatggcgcacggcaccgagtgcgtggagcagcacctccacaatgtcctgtggtgcgtcgccgtcgcgctcgaggccatcgacgccgccggcgagatcgccggctccgacccggacgagctcgccagggggcggctggtgctcgccaggaagtacgacagggacatgctcgatcccaagctgttcgagcacgcgttcggcaagctatatctggtctcccaagagctcgttgcaaggatggacatggcgtggaaggaggacagatgggtgatatcgcaaatgttcgacgaaatgaaaggccctgcggcgtcgaaacctctgagcaaaaacgagcaccgcctcgccgagctcctcgccgcggcgatggggaagctgcacccggcatctgtccttcttggcagcgactacagcgtccggaggcggctcggcggccggctcaaggaggtgcattggatgggggagagctttgcgatgaagcatttcatcggggacaccgatgccgccggcgccgaggtcgcgctcctgtgttcggtggcgcacccgaacgtcgcgcacgccgcgtactgcttccacgacgaggagaagaaagagtacttcgtggtcatggaccagctcatggccaaggacctcgggagctacgtcaaggaggtgagctgcccgcggcggcggatcccgttcccgctcgtcgtcgccgtcgacattatgctgcagatcgcgcgcgggatggagtatctgcacgcgaagaggataaaccacggcgagctgaacccttccaacgtgctcgtcaagccgcgccaacccgatggcggctacgtgcatgtcaaggtcgccggatatgggcagccagctggcatcacagccggcggcgcaaaagcttccgccaatggcaacgccaacggcaacgacaactcctgcatctggtacgcgccggaggtgctcaggtccgacggcgtcgcggacgccgcggcggcggggaggtgcaccgagaaggccgacgtgtacagcttcgccatgatctgcttcgagctgctgaccggcaaggtgccgttcgaggacaaccacctgcagggcgacaagacgagcaagaacatctgcgccggcgagcggccgctgttcccgttccaggcgcccaagtacctcaccgcgctgacgaagcggtgctggcacgccgacccggcgcagcggctggcgttcgcctccatctgccgcgtcctccggtacgtcaagcggttcctgatcctgaacccggagcagcagcagcagcagcagcagggccagaccgacgacgcgcccaagccggccgtcgactacctcgacatcgaggcgcagctgctgaagaagctcccggcgtggcagcgtggcggcgaggcgccgcgcgtcgccgacgtgccgttccagatgttcgcgtacagggtcatggagagggagaaggccgccggcgccgtgcacgtcgccaaggacagggcctcggattcgggcagcgacgggaactcgctgtacggcgacgagaacgggttcggtgcaatgtcgccggagcacaccttctccgccgtgtcgaacggcaccctgcggtcgcggccggccagcagcgacggcaggttgccgacggccaagaaggcggacggcaaggcgcccaggcaagcaggtatttatcctaccacattttttaaatctcattccatgaactgcaaatagaattcattggaacgtatgattttcagctgaaaatccataaaatttatacagttttcctgtagaacatcaaatggaatgcatgcattgtttggtaagatggcgtatgatatgatggatggccgtacccaaaaagtgattcggataatctgatttatggtacagccgttccgatgtttcttgcacaccagcatctacatatctgatttgccattttgccatcgttggagtagctatcaccgtaccagaaagcacttcactttgcaagaacctttagatcattcacaatttcacatcatttcgcatcgatatcatagctagcgcaatcaagcgagatgataaattgggctgatactttcgcttgcagggccacagccgaaggtgaaacccgtgaacacggcggcgaggactccgcactcggcaaggcgggcgctcggcgtgaagcccgacgatcacctccagaccaacggcgctcccaccgcccgccggaggacgcccgagatggcctcagaatagcagcgcaagctgctctcgtgttcgtgttcgtgatcgagtttaatgggtagaacgcgttcgatggagacggttctttcctctttccttccgtagcacagcgtctttttgccaggggaacccgaacctgcaggggcatatcaatggaggttttgcacgctactcatttgcgtggaacgaaatcccacgtgttaggaatccttgtggattgaaaatgaacgggtttttttcatgctagtaagatcagcttcgatgcgttgtaccgcagttttttttttctgtctttcttatgcatggattgcaatcagtgttttgttagcaaaggtataaattgtggtcttccaacatccattcctttgtcttttggggaaaactcaattcatcccttaagggatattccttcatttttgcatgttacttaaaaagttatcaaaaaattagaaaaaaaaagtacgatatatcaatatgtgatatgtcactttacaaacatacaaattcgaatttaacttatacaagtagaaacaaaaataacaaatttgactggtcaaattttttatttttgtttcgaattgtataagtcgaattttaactcgcatgtttgtgaaaaaatatatcatatattgatatatcttgatattttttaaaatatttttaataactttgaacgacatgctgttgacagaaaacacgtggcctgggagatctgcttaactccagtgcagatccaaagctcgccttcggatgtatgagcatgccggttgatttgatcctgtaatcaacaagaaatagaagcaaaggaaccgtgattaaatctataaatgatagccgatcggctaggtgccgatgacatatcatttatttttgagccgatgtcatatgtgaatcgatcggcggttatagatagataataaagaactaaacctactcgatcggctgtagatattaccaatatatagttcttatatcgatatatatttaaatcaagtgattgggatagatcggtcgccatgccgagacagtataaatcacttagatcgaaatatatattaataacgggactatatatgtttatagcatagccgatcagatagacctagcatgtatcggctaatactccgatactactctatatcaggatattaaaacaagtataatatatcaagcaaaatcttaatatacttaaatatagcaatatcttgacgtaaagggaagatttaacatgttaatgaggcatataaaacaaatatagctaaatcagataagatcggctgaaactccgatgctaccctaatcgacaaccagaaggcaggctagagatctatattctaagcacgacttaatagatcaaactcaactgatgcagcattaagtatgaaaagaaggacaatatctagacaatcaaaccgatggaagtttcatagagtggtagatatcttatataatctagatcaacgtcaaaatctaacctaatcggctgccctctactaacggatgttagccgattgtaggttagatagtgatattgccagagattatgtaagatatatgataactcgacgaattacataaacaagattagagtatcataaagatggaagcactaatcccgagcatacaagccgtcataacaagttttacctcttgttgaagatcgaaaccgatgcagctcaacccgaaagcaagaactcgtcaaaataaaactaaagcaaaagggtggtgatgcgccgaaattgtattgaacgtgtgtgttatcaattacataggactcggagtctatttatacccgagaattacaagatatgtccataccggatacgactattatctctaagaaactctaagataccataagtctttgtggcagacttttgcccatatttatttataaggaatttacataaaatatcctaattaatagatacaattgccttcccaggactctatccgtgcgtggtaatcatcttgaagcacattaacctgaacccgatgtcgtacacaagtcgtattgtcggaatcggctgaattatttaacccaatctgacccagacttagccgatcctaatcgtagccgattcggactcccgccgattcttactctgtttatacgacaatccttatctttgattccgcttcgatcccattttcctctccgatgccgatattaccaaatttggttgttaacacatgcataaaacgaaagatgtccctcgatggaaaaaaaaatccatttcctgtctttggaaatagactactgaatttttcgcgtactcttagattctggcacatagcttttcttgctagtaagagaaggttccatgtatcgtactgttattttgtcatgcaaaagcatgtgttgcaaatttgcaatgaatgctctcctcagcgggggttaaattgtggccttccaacattcgctgtcctgtccttttaaaacaggctagtggattttttattgtataaagctcgatttataaatagaatgagatttaataaatagtgtacaattattctatataccacttcatcgattaatctatattgttatactttggaccatcaagatcgtactatatgtatcttctttttgcaataattgtggtccttcgtagaattcaaaatgaacataataattttttccctctatattaaattaagagtatatgaaagtttgaccatcttttattaacaaagttttgttttaaaccattttttttctactttttaaattttggactaggtaattttgcctttgtcctaattttgaccctcctaaaccactttttaacacatcaacgatcttaagtcgaatctggcacatcagcaaacttcctccctatatgggagacttatctttgctaagaaccacacattggctgtctaataagctaaagaaaaaaaaacaaattttaaattttcaatcttagttttgatgttgattttaagatattttcaacgtaatttctttttcagcattgatttttaaatcactacgaacacataaaagttttataattaaattagttttgacctaaaagtaaggctaaacattgctagaaaatagagaattaaggtggtccaaagtacaataagcataaaagttaactagttgaaagtaataaagtgaaactttgataataagaagcggctcaacggcaattcatacttgtgctaatactataagagaccaaacattgaactttctcaaatgcgagtaaaaatgatatgttgtaatgatatgctgatttattttcaagattagtcccatagtagtgtggactaaaatagtggacccatcggttgaagtgaaaataaatgactagatatgctatgcttttgtttgtcagaatttttaagatttttctaatttacgagagttgacatgtggcggctatgcttttgtttctcagaatttttaagatttttctaatttacgagagttgacatgtggcggcttagaaacacaatagatttggttagatgcgtatatgtccgcttgtgtggaggtcctttacgcatcaaatgtggtatatactacgagtaatagcgagctgcgaacatgttgtataaagtctctggaaattgaggtcctttaggcctcaaatgcggtataaattggagagaggaatggtcaatatagttcctgaaaataaatgtctatttagttggatgcaagtgcaacatatatattatatttgttctgaaagaaattgtatgtattatattataaacccggcttaaacaggtaaagaatagaaattgagacgtgtctccaccaactttccagtcctctcttgtacaaaacgcgtagtaagaacgagcacactagtagtataaattttgttagacgaacaataacagtgagcacaagaacagaaggtaaattattaggtctctttggctgtgtatatctatagagatcggattaatgaaaaaactattatctaaaaaagcattattagatctccacttcaaagagagcttttgaatatcaatgctagcccaacaacgcctgttaccaggtggatgtagagtggaggacgcgattttcctccaccgcgagcacgcgattttccttcgccgctggtgagatcacagtagcgcagcacctgtgccgtgacgatgccggagacagcgaaggcggcacagttggtgtaagcctcgcgccgacgcagcctcgtcgcaatcgtctcgagggtctcgcccgtcccggcggtggcgcatcggcaccgcacatcaccaccaccgcagtagccgcgctagcccgccgccgccgccgccgtcggtggccgggaaagcagcgagcggctgcaccagcgagacgcggcccgcgcgacggcctgcatcttctcgcttgattcggtcgatcgctttcttctccgggtgtgatgaagaggggactacgggagacgtgaatacgtgatcgatctgctgctattgtgcgtggttggtctcggctttatatggaaactaccggctgtgagcctgtgagtccgacgcgagtccgggtccgaatactagtcccataccggttttgttgaacacaccagcccgaaggctaaactagttatcacttatcagcgattcagcataacaccaaccagaacataaatacagagccaattatacagcaacatcagcaccgcacaaagatgcttaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggccttatacagggttggtatacttttgcatgaagaagtcaagacacgacacactcccctaaatgtgccgcgtgtcattgatccactttcatgtcacaccacacccatccatcatctgtgcacgcgttagtttctgcagcacatgatgaaggatgagagtttcaactcgatcaacgaatttccaacaccaggaggaagaaggaggattgtaaaacggaatgagaagcgttgaacccctttacggggccgcacctttgttgatataggcagaaagagcctctaccgtggcgtgtacaaaggataggattaatctcaacaacctgagacaatcctggatatagagatagatacaagaaagtacatgcggtaacagaactaatctatctctataacaaactaactaacattatctaacatcctccctcaatcacaactttccctaagttgagattgtacttgaaattttccagctgcttcacaggtaaagctttagtaaacccatcagctacttgatcattggttgacacataatcaacctgcaaaagtttcctagcaactctctctctgacaaaatgataatcaacttctatgtgcttagtccttgcatggaacacaggattaaaagatagatattttgctcccatattatcacaccataactgtgccatagctggactaacaatatttaattcctgcaacaaagtctgcacccacataatttcagctgtagcattagctaaagccttgtattctgcctctgtacttgaccttgaaacagtggcttgtttctttgcattccaggaaacaagattgtcacccaaataaacagcaaaaccaccagttgaccttctatcatctaagcatccagcccaatcagcatcagagtatccacttactatcatagaagaagacttgcatatcctaagaccaagtccagtgcattgtttaatataccttaaaattcttttaactgctgcccaatgttctgtagtgggattatgtaagaactgacacactttgtttactgagaaagcaatatctggtctagtcagagttaaatattgtaaagccccaactatgcttctatattgagtagcatcattgggtcctaaaatagtacccttaccagcaattaacttttcactagcagataacggtgtagcaacagatttgcaatcactcatgttaactcttttcagtaaatcagaagcatatttttcttgagacataagtattccacccgggatttttgttacctctataccaaggaagtaatgtagatctcccaagtctttcaaagcaaactccttctgaagatcctggagaagagctgaaactgcttccttccttgaacttacaacaataatgtcatcaacataaataagcagaaagatagtcaagctacatttattataaaagaatagtgatgtatctgccttagaccccttgaagccaagttcatgaagcttgccacttagcctagagtaccatgccctaggcgcttgctttaatccatacaaagctttatctagcttacacacataatcaggagtggaagggttctcataccctggtggttgtttcatataaacctcttcttctagaacaccatgaagaaaagcattctgaacatctaactgtcttaggcaccatcccctagacacagcaatggacagaataattctaatagttgctgccttgacaacaggactgaaagtatcttcataatctatcccatatctttgtttaaatccttttgcaacaaggcgagccttatatctgtctagactaccatcttgttttctctttattttatagacccacttgcaatcaataacatttctaccttgttgcggtgggactaaatgccatgtgttaatttttaatcaaagccatatattcagcatccattgcacatttccaattattattttgtaaagcatcttgtaaattttcaggctcacctgtagaggttaacataccccattttactgtaccgtcagtgtagactttttcttttcggatgccactttgcagccgagtgcgcgggcgctgtgcctcctgtcctgtcactgtcgtggctgggtgtggatcccatctgtggcgactgaaggagttcctccctgacttgtactcccccgtggcgcagaggatcccgaggctgcagcgtccggatgcggagccgagttgacaggtgcagatgcaggggacgccgtggcgctgtccgattcgccgaacggagaagctggttcattaatcggcggcgatcccgaggactctgctggcgcgttagctgagaccgtgtctggtgcaccgtcggtctccgtttctggttcattatcatatgtagaatcttgctgcatattctcattagacacattagcattttcaggagtattaatcacagaagaaatttgctgcaaacccctaggtaaagaagcagctagttcagggactagagctatttcggcccttaactttgccccagcattgggatgaagtttggtaaaaggaaattgtgtttcatcaaaaacaacatctctgaaatgtaaacacgtccagtagatggatcaaggcacttaaaacctttatgaagtgtgctgtagccaaggaaagtgcaagtagtggagcggaactggagtttatgcttgttatatggtcttaagttcggccaacatgcacatccaaacacacgaagagcgttgtaatctggtttgtgacctaacaatcgctctaaaggtgacacatcatggagaactctgctaggtgtgcgatttatcagataaacagcggaaaggaacgcctcaccccagaatttcaaaggcatagaggaataagcaagaagagctaaacctacctcaacaatgtgacgatgttttctttctgcggacccattctgttgatgagtgtgaggacacgatacatgatgagtgatgccaactttattaaagaaagagtggagtttctgatattcaccaccccaatctgtttgcatagcaactattttcctattgaacagacgctccacaagactttgaaactcatgaaacttatcaaaaacttcggatttatatttgagcaaatatatccaagtaaatttgctatagtcatcaataaaactaacataatacttattattgccaacggattgaggagcagggccccaaacatctgagaaaacaagttccaaaggatacttagattcactagtagacttaggaaaaggtaattgatgactcttagccttttgacaggcatcacaaactgaaacttgttcagacacatctaaacatggtaaattttgactcttaataaccttctctacaacagtgtaggaaggatgaccaagacgactatgccatcgctcgaaggattgcttggtgactccataaacttgcttgacttgatggtggtgcgaggatggagatggaagagcataaagccctttgtggcatcgacccctaagcagagttctcctcgtggccagatcctttataaagaaaaatttacgatataattctatgaaggcaagattatcagaagtaagtttatgagcagaaactagatttttgtttgccttaggaacatataaaacatcttttagatgtaaatttctactaggggttttaacaacagaatttccaatgtgactaatctccatacctgcaccacttgccgtgtgaacttgatcattgccatggtacttgtcacgaacagttagcttgtcaagctcgccggtgacatgatctgtggcgccggtatcaagataccagttggtatcaacgccatacgacacagccgtccctgcaaatctctcatctgggacaaaattttcatcatatcgataccagcaatcacgtactgtgtgtccccttttgtagcaaagttgacacttgggtcgattgtcagttcctcctcctgcatttgctcggccaccgctagggttgcctcttcctcttccgcggttggcgccattgcttggagctcctcggccgcggttgctgtcgccaccactcctgctgccgccgcgttgtggttgtccacggctgcggtttgcagagttcacagaagattgatctccactccggcgatgtgcgagcctttgctcaaagctgattagctgagcataggtctctccaatggtgactggatccggcctcccgacgatggtcgagatcaccggttcgaactcatcatcaagaccggcaaagatgtagccgatcaactcatcatcatcaacaggtttgccaacagccatcagatcatcagccaaggcacgcatcttgccgacgtacgtggtgatgttcatgtcacctttctgcagtgtggagagggagagtcgcgtgttgattgttcgtgctcgggtcattgacccgaacatgccctggatcatactccatgccgacgctactgttctacaggttgcaacttggacaagcagatctttagtcatggaggaaagtaaatatgcgagtacctgttgatcagttgcaacccattcttcatattctggattgctgaccacaacttctttttctccttctttccggcgaaggatgggagccagcggctgatcatctcctgtgagatgcccttccaaacgggcacctcggattgtcgccagaatctgcgccttccatacggcgtgatttgattttcctagcttctctgatatgggctggccaactagggggttgccggtattgttcttcgacgaactcgccatggcgtcgcgctcaagagattggattggatcggtatggctctgataccatgtaaaacggaatgagaagcgttgaacccctgtacggggccgcacctttgttgatataggcagaaagagcctctaccgtggcgtgtacaaaggataggattaatctcaacaacctgagacaatcctggatatagagatagatacaagaaagtacatgcggtaacagaactaatctatctctataacaaactaactaacattatctaacaaggataacacgtggtgcacaatgctagctcggatggtgatgtgcaccgttggactagatattgttgctccatgatcaacaaccatttagaagagaataagatacattacaagctgcacagattgcaacaaaccgactaaacatatagaaacaaactgactaaacatatagaaatgccagcagaaaaaaagaaaaaaaaaactgacgcgaacggcgaacatcaaagttttaccggccggcccggagagacaaccggttggattgctccagtggtagctgcgccaacacaggcacagtcatgcgccttcctctgcctgatcgcccatgacgccgctgccctgaacagcgttcgcagcgtcaccttcctgccggtcccggtcctgcctcggcggtcgtccctgagcaccacgacctgctgcccgttcctctccgtaggcggcggcggcggcgctccggcggcgagcccctcctgccgtggctcgccgtgcaacgacggcaggtcggtgccgatgtgcctgtccaggattcggcacagcgaggccagctcgtaggagtcgtacagcgagctccccatgtcccataccaccttgccatctcctcctctctctacgacgccttcttgcttccgagacatcttgcttgtgattacgagccacgaaacaagttcgagtcagaattaagatgcaatgcaatggaagaagcggagcagggaggagagttcagaaaacgactgggcatctgatttatgatatctcgttttgtttatattttatcccccatggtgatgcgcatgacttttgctgatttggtcgggttaggagagaaacgataggagataagctgtctagtgtcgactaattaaaaaggagatgcgtaagatatattcctttgcttttgttaaactgtttctgagctagcgtttgggacggtcagctataaagaggcaccaccacaaccagctagctgctcaccgaacacaaaggacaagtcgacttttataaatcccttggatcgtttccatttgaaaggatcgtgtaaatgactaatgaggagtcacactcgtgtagagacgaacatatgtgacgcagctcgggccgttcaccgagtacgaaggcagcagagacacaggatgatgatattacgctggtaatataacgcgaatgcatgaaccgcatggttcgcaagatgccagccagaatgcaactataaagcggtcgatcgggcatcagcgttgccgtatgttctgaactcgtttttcttttttgtccccacgttgtgtaccgtaccgtgtcagctcttcaatttgtttttggatgggtgaacgcagagcacgttcatttcttaccaacagtggcggatccatagtgttaagcattgatgtcagctttgctaatacactatagaaacaagaattactctcttatatatgtattgacaccattatatttgagtagtgacctcaatgactccattttctggatctgcacctgctttattttttaagattagcaaatattgtatttttagtaaaaaaacatattatatctaaactatgtaaacagtaaaacacaatgtccgttcaagatacatcgaagctcttgtgaaaaaaaaatgcattcagagcaaccaagcatatgcacctttgttttttctgctgaataagttcatctgaggtcccttaacttgtcaacgaattcgattctcgtccttcaaccggaaaaccagatacaacgggtccctcaactatcaaaaccagtgcagatgagatccctcggcggttttgagggtggttttagctgacgtggcgcctacgtggcaaatttgacttggtcttcatctgatgtggtattgacgtggcacatacgtggcaatttgatccggaaaaataataaacttcgtgggacccacatgtcagtctcacacataaatcaagaaaagaatggtggggcccatgtgggcccacatgtcagctaaaaaataaagatggtggggaccacgtgggccccacaagtccctttcggctctcgtttctcttcctcttcgctctccctcgtcctcgtggggagcggcggcaggagcatgcc

SEQ ID NO: 9178 - DNA, 6773 bp, Oryza sativa
ttctagaacagtggatcccccgtcccacgaatttattattttccggatcgaattgccacgtatgcgccacgtcaatgccacatcatatgaagaccaagtcaaatttgccaagtatgcgccacgtcagccaaaaccgccctcaaaactgccgagggacctcatcttcactggttttgatagttgagggacccgttgtatctggttttctggttgaaggacgaaaatcggattcgttggcaagttaagggacctcagatgaacttatttctttttctgcaaacaaatcacatatgctcaagctgggccctgggatgcttcgtagaaaaatgtattgggccttgggccattgcctttgtaggagggtggctttgggagtttggactatacgtgcgccgcgtcgttaccgggctcgccgtcgccgacactcccaccaacaacaccaaagtccaaagacacccgcttccctccaaccacccgccgcaaccggtcagacgcaagcaacgcaacgccacgcacgcacccgcctcaccctcatgcgccggcacgcgtaccgccacgcccacaccgagatatagcagaaagccgcaccccgcaccctgcgccctcaccgcacgcacgcacgcaaaagccttcgaccctgccgtgcgcctgtgccgtgcactcatcagctggcgaggaaatagaaaagagtatatgaaaaaccaccgtatgtttttttaagcgaaaaagtttttaacgttaagtataattaaaatgtaattatattgtacaactatcttgtagctataatgtaattacgatataacttatgtaaaatttgtattcaacctttatttagttggttagcaacgagattttatacgtgatatgtatgaaaatttctttttaactattttttatgcataaatctcgaggtaatccgatgactgtaaatttgaaagttctgcgggtagcaattctgaaaaaaggacagacagtgtggcacacaccaacaaaacggtgctaggtacgggggaaaaaagtttttaaaaaccaccaccgcggaggcaaaaacaagacggtggcgagcatggcacatggccgcgcgcaggcaagcgcacagccgcgccgcgtggccgcgagtgcggtgaacagggccgcgcaatcacgcagtgccaccgtctgtggccgtctgtctatctctctctctccagctcctccacgggcccccacccgcgcgcgcgcggccactgtgccgcacttcacccccccgggcccgtctcccctattcggcccatgagacggcgccatgcctccccctgccctggccgccgggccagtccaactcatgatcacggggagtcaggcggtgggcccccacgttcgctcggaccacagaagccggtcccctgtaccacactgtgggttctccggttcgcaactatatcgtctttattggggattccgtggtaccggcggtccagaccggttcgtcatcatggaacgagttttggctgggctagctacctgtataggcttggacagctgagctggtgctgattggaagcttcctttcaaaggcaaaagtacaaaatcgtttcttactcgaaagggattaaaccgttttcgttgtaattaccgttttcaaaagctgcaatgcagttgtgtgtaaaacaaggttaatctcgagctcagtaataggaaatgcctcgactagtttcctaccaacgccgttcgaaaaaaaaagagagactaatttcctaccaaccagaccctattaagcaactactacgagcatttcaagttacgacatgtgactttgtggaattgaaaattcaaattcgtacacgaagaacacattgttgactgttgacttggaatagttttagttggaaatagcacatactggattacatatatacatactgacatgccgggtaagcatgttccaatgcttgacaagcacagattcgaaggccaaaaaccacatgtgtggcatcattttcattgcctacgattaggtcgcgttgggacctcacatacagtttgtttcttccgccttgatctcggatttaggccgctaagcttgttgcttagtgagaatgcaaaagcacacggctccagtcgatgacaatttaattgacacgggttttgcatcactaaacatgtcctttgcagagcagtttaagcaagacaaaatcacacagcttccatccgtcggtgccagtgccaagacaggcattgactctgcactcttttgtgcagggaccatggagaaaaaagaagtaaccatttcctcaattctcagtgcagagctttccttggtgtccctgtttctcctcctcatccgacctttcggctggatgtataaagcattgctgaaagctactaatgcttcaggagcagagcagctctctctatcgtcttgttcctacgcgtcatagtattgaatctatttctcttgtattgtcgccataatccattaattgtagttagtacgatatctattcttctctattacaaaagaccacacgcaaaatttatactccaaaagaacctttcaccaatttcacagaaaaacttgtggtgcttacacaagtactaataaagctgtttgggtgtcgagaaattcaacaaagtaggctgctttttacacccatctttcctactgttgttacgctagcttgttctccctttcactctctcttcagtatcctgtcgattctttgtgatggctacagttcgattcgtatcggcgctagcaacaaaattgcggcactggcacacatcgatcgatacggacgatggaaacggagacgcggctgttgtgtaatggcatcttaacaaaggacggcgaaggaaacacggaaacatttaggtccatataaatgccttgtttatatcagctgatgagaggaggaggatgacagcttgaaaagaaaactgtgtgttctagaagcaagcaagggtaggagtacataattgtgatttatgaaaggccctacgggaaatttaaagctgcagacatgtgctcagggaattaaacctgttagttctctgatactaaagagcttaacaagtactaaaattactaattgtctagtggccattggaacgacattgccctgcatgtgcagcatccttagagttcaagccgtttaatccgctaagattctactgaatcataccagtaatcatgtccgccattgttgcggctttgcaagtaggcctacttaattggaaggcctgatgagagacacaaacagttggctattttgcttacacgaaatctgttgtcaaaatgttagtagtagtaagctcccagctaaaggcaaatgccattcttcaggtcgccttcacaaataaccaactatcccacgtacaagcatcaccggccttattttattgtttctcccagtgagatgtttggcacaagaatgaaagaattgatgctggtactaccaaactaagaaagtagttgagattgtgaccattatcttagcttcagcctgttcaagtgttcatacgatggataagtgattgattaactactaatttaattatcactgtgggttatgcaggactgatgctaaaatgctaaataatggctctcccaagacgaaatggaaaagaaaagaaaagaaaagaagagagatacggcgaattccatttcaccagctgtaccccacctttgccgctcgcttccacgtgggccctaccttttgacccccccacgtcagcggcgcagccagatcattccaaaagcggaccacatccccacgaaaccccaccgcgaccgacccccccggaaaatatactaattacaaacaggtccctcgtgggctcgtgggtatatataaggctctttcagttggctccctcgtcgtctccgttaccacgcgcacactgccactgcgagtgccgttcccctcctcctcctcctctctcccatggcggaatcctcgagccgccccacgaaaccctaaatggcgagccggcggcgccgccacgcccctgtgccgtagcctcgccgcagcgagctggtcggaaggtaatccccgcttcgcctcccatccccccgcggaaccggcggatcttacctcatttggcatcttctctggatccactgctgatctgttcctccaccgtcccaaccgcctcacagatttctctcaatccgtgtagaacacagcgtcacctctcgatccgccaagtggtgggggagtaggaagcgtgtcttctccgggaggcgcgcgccatggggagcgatctgaaggagatgaagtacaggcggaggattgggctcgacgagcgggcgcaatgcagcgagcagagggcgctcgactggcacgcgctgaagcaggacccagtggagttgctccgcaagctggacgagctgagggagcagatcacgaggacctgccagatcgtcgagccgccgcgggagcaccgtcgggcgggccgacgagcgctctcgctgctccctgagaaccctgagccgccaccaatgccagggtatcaccgctcacgctatggtggtgggcggtatgggcacggcttgccgccgagcccctacgagccgctgcgccctgagattggggagaggtactccagacagtcaagtgggcggtatcggcagtatcaagggaggcaatgggatggctgtggagttggacatgggaattacaatccttcttatacatgttcctgtccgcattgtctacatggacagagaactgcaccacaagaagagcacattccaatggcgagatactttgctgggcagcatgagtgctaccggtttgaaaggtcgccatctgtctcatcggactatgaccggaggtccgtagcatcatcattgtactcgcatcggtcggtttcaaagaagagagcagagtatttccggaagaaggcagagcatctttgccgtcctgtttatggcgccgccccttttgttgtgtgcagttcttgttatcagctgttgcaggttccaatggaaaagtgtatggggaggaatcggctgcagtgtgggtcttgctctcagattgtcagtttgaagcgtgaggagaaagttatccccttctcaccatcagcatccttttgtgtgcccaaaattgagcaaggttcaaatgatcaaactaggcgagattttgagcaccagctcaatgagtttgccaattctgccttttataatttgaatgagcatagcagcatgcaaatcaacatagactttggtgatgatcattcagtttcttcttccattagtcatgacaggactgagaaaggatgtggatcaagcaggagcattcagttaaaaacagatgggctcttgttgtctccaagcagatctggagatattgagagcccgaaggatatattatgcgaaagagatgctgaatgtcaggtagaaccttcagatgctcgagtcagcccatgttccccagttttagaggacaaacttgttgatccattgtgcagccaggaaaaggataataatagtgaggacctaggcatggctaatatatctgatgtaaattgcaaaggagaacacaaagttaatgatgatgatgatgggagtcttagtatgggaagtgaacagaagagaaaggaatgcgatgaagattcccttgtagatgaaagcatgtgcaaaacccatgaacagaagagcaaggacgatcactctagccctgaagatgttagcaaaactcatgaatttgatagtacaaaagataatattagcagtgctgtagatggaaatgaaaagcatgagtttgaaagcaaaaaagatgataccaatagtcttgaaggtgaaagtttgaacaaggaacatgagcaaaagagcaaagaagacgaaaatagtggccttgaaggtgagaatgttaagaaggggtttgacaaaaacaacaaagaaagtgaaaatagtgcccttgaagatgccaatgccccccttgaagatactagaaatgcctctgatgcggcaagcttaagcgagatatctgaagaaaagaaaacagaggaagaaaatggaagtttggaccagccttttgttgaagatggcaatgcctttgcagagagtgggggatcatcatttaatgagcgtacaaattctggtttttcccgtggttcttctgagactgcattagaagaagatcagccctcaactggaaagagtggggattcgtcattttttgctggtttcctgaagaagggtttcaaggacctttctttatttaatcagtccatggacagcgttaaggtttcaattaatggccatcctatctctgaaagagctcttaagaaggcagagaaaaaagctggtcctgttgagcctggctcgtattggtgagtgattgctatagtaacaaattgtttggcagtttgctgtatttgttttagtttcactgaatggattggcttgtcttggtcataaaactataaaagttaattttgatagagccactcatctgcagcataccacaatcacttatctaaattactagtttactacaagaaaacctacattattgatgaaaatactgttgagcttcttaactttgaacttacattagtagaactgtttttcccgtagccgcgcaatagacttttataactgcaacattttgaaaattattgtgaatttttcacccaatttggggctttgttttggcaattgataagtattacttcctccgtttcatattataagactttctagcattgcccacaatccacattcatatatatgttgatgagtctagacatatatgtgtgcctagattcattaacatcaatat

SEQ ID NO: 9179 - DNA, 4333 bp, Oryza sativa
  unsure (1)..(4333): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattgccctgaactgcttcatcctgctgataactgtaatgtcaagtggcttgtctggggcttctccatcctctctaatccatgggtggtctgtatatttaaagtattaggtgcattaactatatttgcaaacagtaaaaatgataactcggtttatatagaaacaagagcagaaattatctattaaaaagacccgaatactctttaaaaaaaaatgggacagtaaaagtgagcgtcttcgctctgagatactacagtaactactagctacaggtcaaggcttttgcatgaaaaagtacaataggaagaaaccagaagaattgtttgatctcaatttgctactgaactactagacaagtgtgcatttttctgttgataagaatgccattaaagagctatggtggacttactcaaaatttcagcagaagtaaggcgctcttttgggtcttgccgcaacatcttcttaaccaaatcttttgcaccattggatatcgaaggccaaggttcagacgagaaatcaatgtgaccacgtaatacggcatcaaatataccatcttcactctctgaaaaaatgaaggtagaacatctatgttagcaacagaagcaaaaaaagttgactgaaataagaagcggcaaacgtcacctcacctgcccaaaaaggtggaacaccagaaagaaggatgtaaagaataacgccagcactccatatgtcagcctctgctccatagtttcgtttcagcacctcaggtgcaacataatacgcacttccaacaaggtccttaaaatgctcccctgcaacatccacaataggcattttcatttaccatctcaaggaaaatccttttcgttccacttagtcctattgagtattttagtgataggttctataggaaccagacgatcctatttggtcaaatacctaattgaaaaaaaaaatcttattttccttccactaaggtatgaggcttcttattccacaagaaaagaacgaaaacacctttccattctttcatatactgggggtttttacttggaaagacattgttccatactaaagaattcgggtccataaccacgagttccagtgcaatagatcttgtagcacttagcaacgaggccctacgggacatatagcactcagtttgcacatgccaagtgtaagaaaaataaagccaagttcagaatgaagaatcccccaccatcattgtaaaagaaaaacactaaaacaacaaaatcctccaccgtcaccaacatttctgcataatgaagagtcaagcttcacccactaagttcagatggcatttctgatattgctgagtgcatttttgaagatcttgcatgctatgccgccagcatttagctaccagtggggaaaatatccagtgcctaaagtgcaaatcatgcaaatgtacaatgccatctcggtaaacgcaaacacagagattgcccaagctatagtggagtaaggtggatggatccaatgctaactagaacactgcatctggaacatctataagtataaacataatggcacttgcagcgttgcatctagcccctaattctagtaacggtgaaactttcagacctgtcaaacccaacaactcgatctaagtaaacccaaaatcctcatgaagtcaaacactggaacaatgaaatatctcgcgatccattcctctgtaatgagatagtgaagcctcgagcacgcaccaggcttgaagaaaacggaaagaccgaagtcagtggccttgagcggcgagtcctcgcttttactgaggaacaaaaagttctccggcttgagatcccggtggaagacccccatggagtggcagctgtgcacgacggcgacgatctcgcggcagagcgcggcggcggcgcgctcggagtagtgccccctggcgatgatgcggtcgaagagctccccgccctcgcagagctccatgatgaggttgaccgagtggcggtcctcgtaggcgccccggagctcgacgatgttgcggtggcccgtgaggtggtgcatgatctgcacctcccggcgcacgtcctcgatgtcgtcgcggtgggcgagcttccgcgtggcgatggacttgcaggcgaagcgcttccccgtggccttgtgggtgacgaggtaggtgaccccgaactggccccgcccgagctcgcgcccgaaggtgtaggtcgcgcggacgtcctccatcggccgccccagcaccctccccatcgccgcgtccggcgccgccgccggcggcggggtcggctgctgcggcctcggccactgctgctgctgctgctgcggctgaggcttcggcttgggctggggcggcggctgctcgggagcggcgcggtggtggcgcgacgtgcggttgcccatggctactggaggctgggtcagtcggggtggggaacgcaggcgatgtggtggagcgttgggtttgaacaggaagcagaagcgcacgagtagtagacgcgctccgcggagacgaccgaggggcgaccgcgacccgccgctgcggttatcgcgtgacgaggcgcgcgttgcgacttgcgagttgtgacagtggggatcgggtgcggacggagtgcgacggcgacgccggcgggggatcgcgtgtggcgttcggatctggcttgggggtgggggtggggtggaaacgcgtgggtggtcccggcctccagggtatggtggggtcgtggagtcagtggggagttggtggtggggttgcggagtcagtggggagttggtgggtgggtgcggtcgcggttgtcgatggagattcgctgttcctctgctcgcgggccgcggcgggtggtgacgactagcgactcggcgtggatattttcttggacagcgaatccgtgtgccacggacaagtgtattgtggtgtggtccggttggacgctgccgccagcgacggctaagggtaaaatctcccttaccatttacaaaactagacattacgacgcgatgcgcgctctatcggggttttatagtcatgctaagattatcttttgtggtagcagcggagttgacataccaaccaccttcagttaaaagaaaaacaggtaaaaaccaatgaaacgataacataatacatatacagcatagcatatgcccaaacatccttagatttctatcatcacttgtctttttttttaagaacaatcatcacttgttatgcatgtgctgttgtttcttgatcaactctatgtcttctgtcggctggctgcctcagtagctttccatcgatggagagggagtcgaggccccaagcctagggaggcaagaaaggggagcttcatgacctcaaaagggagatcttgcaggtctctttggagatgaatctaaaaaataaaacctgcactccatatgttgtatcattataaaatctcccagacatcattcgtaatccaatgaccaaatacataaaaactgatacatctttcttatgccacataactataacttgtaagagatcggccagaaagatgtgccacaccttgcaagtagggcaaactctgtaaagaacatcgactttacctctacaaacctacaacaacacaatataaaatgcatagtaatttttttggaaaatgaaaaatcctcaagctaaacatacctacaaataggttgagtgtataaagtaagaactaccatgttatttttgtaaggattgtaacaaagaataacaactattattattccgatagtgaataaaatctttcagagtttccttctctaaaggagaaaacaaagggtatacccttgaattgtctagtttgcaatcagaatcagatccttcagtatcatgggagtgaactgaaagaatagaaatgtgtgtttagaaataatggatgttggcactgccatcattttcagaaagaagataactactatctaactctggttaccttacaaaagcgcaatccaattattccttgaatcctaaacctacagcatgacactactattaatttgtagtagcaatcaatagtactttcttcactggaaattatgcatagtcatatatggattatggatatttattcaactaaaaacattatacataaaacattctagaacctgggtccacattaaactgaattgttgtaacgaaaaagggaacataattggagagctgcacgttgagccaagaacacaataaacaaatgactattacatgttacaatagctaaaataactgaatttagaatctctgaagcaaagctctgctttggactttttgtt

SEQ ID NO: 9180 - DNA, 7566 bp, Oryza sativa
gtttataccaatgagcagttaaagtgttgtagagtggcatgtaattccagaaactgtgcgattagattcaattgttaggcttgggacccatgtctttgggacggggccatttcaaatttaaactgcaccacggtgcatgcgtatacaaaccactgtgcaaaaatggagtacaagtatttgtgcatgatgcatgatttaaaataatgttaaaaaacaaatgctcaatgacccaattggtagagccaaggtgcacatatatacattttccatacgcccttttcacagaagttaaaaaatgataatgtggaagtgaaatacatttccatgaacagtatatattatgctgataccaaatgaactctcagatacatttatatcacaaaaaaaatcattttaacatagtagtgcatacaaacattcagaaatgtaataaaaaatatgatctcccaaagtacattcaaattgcagagtattgcgtagtaatgatttcttcaacaaaaaaaatggtgtacttcgtttcaaaatatgctcttaatgtatcttttgtttcagagttctcccgctttttgaaaattgttgtaccatgagtactagttgcttgggtttaaatttagatttaaattgcaacacttatgaattgctcaaaaggcaaatatatgtacgacattgccagaaaacacagaatacatttatctttacagcatcatatatagatgcattgtgttctatgtacattttgcacaaggaaaaaatgttcttaataataacttaaaatttgaatgcacagtaatatacacgtgcaaattttgaatgcacagtagtatacacgtgcattcaaaatgtaatgcattatttctcaccataaaaaaatgctactaccaaaaacttatatatctgcattaaaacttaatgcagtattttcttacagaagaaaaaaatcctttgagaaaacatttgaattgcataacatttatagacagatgcattcgaattgtgttattaaaataatagattttctcgatttttatagacatacagaggcaagggcggagccaccgcctggctagcccaggtggccgcgcatgctcaccgacaaaaactccactaaatttatatgttattgaatgaattgatgatgaaatttatacaacaattactagaagtgaagtttgcttagggttaaaaatctttctagctccgccactgtgaggagagataaaatgggaataagccgtttcattactttggttcataggaatttggaatttttgcgcatatattcgacttccaacttatgtccatgaattcaatgtcttgctgctttaaattaatatatgaataaaagggtaaagtttcatcatttgaggcattaaataaataaagaaattaggtgtacgtatcagactccctacattccatattgattattatataacttttttcacctagaccaacaaaaagtattaactttcctatatttcattttaatgtaagtatgtgatagggaaaaatcaagaaacacgcacactttaactccttctgagccccatatataagaaatgatagctttactacctcaaattcctacattcatgcgcaaactcaattttgatgcttaaatgcaataatattacatgtctaacgaagggggtgatgatcaatttgaaaattttaatttgtgttaaacgttgatcaatatgaaacagatggattattttatactggttggtccattatgcggcaaagccacgtctattttctagtatattactaaattaaagaaatcttttctttagaaaaaaacattagtttgggctatagcctccatctatgactaacaacaatttttcctttccaaataaacagattcctcataaacttaacatttttgtgctggaccaaattgctagactatcatcagcaagctagcaattaaaggccttgttgaccatgcagaaaaggaatgatcgattctctgagctcatgaccaaaaataaaacatgcatgcatacaaaataaatggtaagtgtcaatcttaagtgtaatgaacaccctgcacatctggtacttagagtaaattcaaaattcagttggatgattggtgtactcagaaaatcttaggcggctgaaaaatataagtccatattaactattttgcatatgttttagtcccctatctttacaatattttttgatggtgaggagtttacaggtttatcgacacagttcggtatgaaatctgaaactgtggcacaaatttatcaatagacatggtaccttgtcactgacctcatcattcagagattgagtacaccgtgtattgtttcctttaaaaaaaatctgaaattgatcaaaggaaaatgtaaacattacactgcaaagctagataaaggctttcagccaactattaaaatgcagtaccccaagcatgcataacagcagatgctagatcattctagagcaagggaaaccaacctatattattctacttgtagaagattagcaataagctaatacaactttttttcctaatggatatagtccaattaagaatagagaaacagatcgatggaatataaggagcaagcaaaagatttggacaaacctgattcaaagcaggagatggtagaggaggcagcaggggggtgatgagggtggccaggagatgctggtggtaaaatcccttggcttgccatcgtgtccaacatcagagctgctccggatcaagcgctgcaccaccatatggagccctcctctggattatgggaggcggcaccagatgaagcagcgaggggaggacggaggatgcagcggcggcggtaggcgatgcgaggcggctcgtgattgtctaaagcaggcgagagaaaggcgcgagggggacccccaccttggagaacaccgtgccgacgccatcttctcgcaagctcgaggcgtccgcctcctgggccaatcagtctacaccaccacggtggctgtcatccgcttcagctccaccatcgtcgtgggctcctccccctccccccgagctcgccaaatccggctactgcaaggcagccgtcaccagatctgaaggcagaatgggcttggattgtggagacaggtaaatcgacgacgaggtgatgcagaggacgaagacctaacccgattgaaagccagatagactgactcgtcgccgacggacggagacggcctctcaccatcgagcttgagctcagaggaaccaacggcaaggagagagagagagaggtaatggaggacgggcagcagggcgcggcagtgtcgggcgcttacatcattggcatcgcatgattaaacatcagcacgcgcacttccctccgttttcgatgccgacaggggcgaggattggtgctggagaatgaagcggcggcgcggggcgtcaatggggcggagaggggaaggaaagcaatgattctagggttttgggggaaggggtataggtatatattgtttttcaaaaaagccctttgatgctcgtttttcagagcgcggtcctatttttagatttctctcttcttcatgtaagattttcttggttatggagggcttatacgtaaaagaccacaacgtcgcaccgtatttcttgggttctaaacacattaacaatgcaacggagggttttttttttgaaaaattgccaccacactcttgacgatgatcgatcttagccgtcgctgcgacgaatcgaacggctgggagctgcacggcgcggacgcacgagagggcgcggattccgcccgcctcccagcgctcgcgggcgacgtggatgcctctgcgtacgaacacgccgctccgaatcgctctcagctcgccaattcccagtaggttttaatataaccgatttcatccgaaacattatctgtgttatactcctttatactgtcttcatttttttatataaactatatttttttatataagacagttaacatttttgacatatgttcggtcattcgttttattaaaaaaaatcggacaagtttcacaaatcttcaataattgaacagtttcttgtttttcaccttccaattacatgtgtttagtaatttccactaacacaagtttaatcccatccttgaaacttttgagcatgtcaaatgtttgacagtagtttttctcttgggaaaaaaaatctaaagcaccaaagctccccagagcttagttaaccttgatgcttcatgagtaatttggattcctctttcttttgttcatggaagaattgaattgaactaaaacaagaaaataatcattttgaaggtttttttggtgagccatattgtctataaaaaaaccttttatatatttttttggccatctcaaatagtcccatccatcccattttgatcattccataaacaaagagcaacgaaaggacaccaaacattcatcattttgaaattgatttaaggcggttctctattgtttcgttccaataaaaaataacttacactttaaatgttgtgtcacgccctgaactagccccgagcgagactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaagcggaagccaagacttggaccaaacatcacaggcgcgacttgggaactaggccgaaaccctaaaactcatcgtagccggcttgctcctggaagaactcctcgtcagcgggatccgcttcatcttctccagcaactgggggggattatttatatagagcaagggtgagtacgggagtactcagcaagccatgagaaataagtgtttaatgcaggcttcaaggaaaggctgttgtttttgcaattgattttatttgaactcttttctgaaatcaactaagtgagtgcttctcaaacgacacggatgagacagtgcgtctcgtccggtcggagtatgtgcaatgtatcagtcttttgaattgttcaagattggcacccggccaacaactttcaaacggccacccgggcctacaactttcaaacggccacccgagcctagctgatcccatcagctgcagattttccaaacatcgatcccctttccacaacagcaatttcacaagcagtagtaaaacaaaactacgctaggaatcacctcacatccgcccatgaccgtgggtacggctattcgaatagtttgttaacctctgcagaggggggtacactttacccacacgacattactaacctggatcacccagcccgtggggatcagccacgtcgggagacctccaagctttcatgacaaggcattttcgaaagccgacacaggtttaccatatgccgacgagaggggtcccagaccaacaacaggttaggtcccagaccatactgtgccaggaagcccgggggtcctccccgacaccaccccggtgaatccacatgtctctcggcatcaaggctcccctgataagctagttactcagccaggggtgtcccattccacccatgtggtcgtacttgtcttatgttcggatgaaattccaaggaaacgatccttaagtgcaagagcgggaaaccgtacacccggtacgttccccggtccgcggttttggaaattcatttagttcgcaagcaccgacccaggtgtcgggttttccaagtcttttgtaaaacccaagttttacccaatatgtttttcagattttaagtttgaaggcgaccgtcgatactcgtgcagagtgcacgattaccgaggcacgactatgtggttacaagggaacatgatatagcaattaacagaggaaggatcaatgcaacaaaataggtaggtccgccaatctgccttgcagacgggacaagcagattaagtgtgatcctatcaatgcataatatttttcaagcaacataattaagttcaattataggctcaagatgttcaaaggtggcttgccttgctcgagatcttgagcttgatcctcgaaatcctcgcactgcgggtcttcgggctccgaaactacacgcgaaacgggacaactcaacaaacggcgaaaataaggccctattaatgacctctcagcgtgccattagatagatctcgagattcgaggaattttggaagttgaacagagtcaaacggacttacggttgggaagatattgaatttctaagattattagatttttggtctaaaggaaaaaggatttaattaaacccttttggaaaagaaaaggaagatggaggggaagtagacttccctcgggcggctagggcgcggcccgagagaaaaggggcggctcggccgagctaaatgggccggccggcccaagaggacacggcccaatagggcgcggggaggggagagagagggcgccggtggaccgagtccatctcgcgtggtcccgggtgggacccgcttgccagcggctcggctcaccgtgcggagggagcacgtggcgcggcgctagggtgtggagcggggcgcggtgcatgcgcgtggttcgcggtggacgcggatgcggcgggcccacgcgcagcctcacggctcgcggtggaccgcgcccgcgagcggggccggagggagcggctgaccggggtcggctcgacccggtcttggccgagctggcgcctacgtggcagcaacgcgggccggcgggaggttgaagaagacgccggccggaacggacggcggacggcggtggcgagcggcggagcgaaacacggcgatctaggcgaaagagagcacaccgggaagttgcgcgggacgaggggagtcgagccaacggctcggattcgctggagggagctcgacggcggcggattgcggcggcggccaccagcggagagaaaaggggaaaacggcgacgaggtcacgaggggccgattcccggcggcgagagcatctacgcggctacgggaatccgtcccttgcgccggattaggaggaaacgcatcgaggaaggccggcgacgagaggcgtttccgagctcgggcggcgacagcggcgagcacacggcgagcgacggcaaaggtcggggcggcgctggctagctacgaagaggctactcgtgctactacccgagtctaaggggaggagatggaacgaggagggagaacggagggatgcactaccgtgcgggcgggcgcagtgacgagagccgacggcgcgaaacgtgatcgtttcggcctcgggccaaggaagaggaagaagagggcgcgcccggagtccccttccgcgtcctcgctcgtgtcggctcctccgacacgcgcgacgacaaacggtgacggcgaacagagcacgggaggcggcgacaatggagtggaggcgatgggacaacgagaggagaagagagggagggcgcctgggctttataggatggcaatgtcggtttgggagaggggaaccgactttggacggtcaagccagcgagctggcgctccggctagcggccaaatcggcgacagggcggagggaggatgacgccggcgggaggaaaaaagggaa

SEQ ID NO: 9181 - DNA, 2072 bp, Oryza sativa
gctcgccaggcatggaggcagggagaagggagcgaggggagggaggaggcgctcggcgcggctcacgcgcacgcccgcgcgagcggagagagagagggagatagagagaggagatgggagatgggccgagagggattcggcccatcgaacccgagggaggcgaaatagacttttgcggagggattgatttggaaggatttggattcgggattgaattcgacgatagatcggggatttgagatctgagatggcacggacactagatcacaagcaaagaaacagctttcgcaaatagggtttttaagagatagttttcccgctaggcgccatgacggaacgggcgctacatgttgcatgagttgaaccaattcaagttaatattgattggctacacgcatatagttgcacgcatgcatggtattccacgatgcacatttataaataaacataaggtattttgttaaaataataatttttttgagaatatctctaaaatcttatgtgatgaataaattgtgatggatgaagtactagtttacaaaaagtttccacatataagagcaacacatggagtatgttgctagagttgtgggtgtccaatgccacgtaataaaagtccaaaaaagggtcaaattttggcaacaaaatggattagggccaatgtaaaaagggaccttattcgaaatgtttgtaatacaaaataaataaaggcttgaaatgagtttttttttctcttcgtactagccacggtggcatgccaggtccttccccgttggcccacgaggccacgagggcgcggaggcggaatccgcaccagcagttgctccttctccacccaaacccaaactcccgaccccaagcaggattagataagcaaaacagccacctaagcccacgccgcgaagtcgccgccaccgccatgatctccgcgacggccaccgccgccttcctcgccgcggcgccggcctcctcctcctcctgcaccacccaccgccggcgcagcggccttcccgccatctccgcgtccctcgcaaccgcctcctccactggtaaaaccaaccgccctgctgttactactctctctctcctccagttttcctccattttcgccctaatctgacctgcatctgggcctcccgcatgtccagaggagccgctgctggtgcgggcggcgaggggcgaggacgggctgccgcggccgccggcgtggatgatgcggcaggccgggcggtacatggcggagtaccaggcgctcgccaagcgccacccctcgttccgggagcggtccgagacgaccgaactcatcgtcgagatcacgctgcaaccgtggcgcgccttcgcgcccgacggcgtcatcctgttctcggacatactcacgccgctgccggccattggggtgccattcgatatctccgactccaaggggcctgtgatccagtctcccgtgaggtccgaggagcaggtgagggagctcacccccattgacttcgagaagctccggttcgtcggtgagtcgctcaagattctacgcactgaggtaatgcgcagccatttttgtggtatggaaaaccccctttctgttaaaatttgttgtatgaaactcggtttgggggctcatgatgaattggtacaatgtaaatctagttatatgagctggcagttattgtgaaagtaaaacgacaagctgtgttggcctttacaggattcaagtaaaatttggttcagcattatttttatgaaaatgctaataggggatagaggtttttttacattctagttctatgctggcgtagttagctgattcacgaaagctacttcgttaggctagtggcgttgtattgtcgccactaaactcacctacttatataaatacaattttgttaatgttggtgcaagtggtgctgaaatatagtatgcgtatttgctggcagcgtgtcatgtttatagactaaggtgatttggaatcaatagtgcataattattatcaagcccgctgtgtagcatctgcaaaacaaaacggtagtggaattacccggtgttcattagtagagtcgagtaattcttctgccgtt

SEQ ID NO: 9182 - DNA, 1874 bp, Oryza sativa
tccttaatctcttatgactaatttcatgatgggttgctgctctaaggttaatcaggttggatctacaatgtatagtactgcatcaatgagcataccccctaaaatttctgaagttctttaaaatgttgagaaatatgcctctatgtatttaaacaaatactttatcaattgattggattccacacaacttctggcagcgcattcgagcttggtatggttatggttgcaagttactacataacctgtgaagaaacacataaataaacaaggagtgcataaagaaccaatccgttgtaagcaatcagaaacaaatgtaaaatgctaatgctagcttcacgttgtcatatacatgcatttgaatgcaatgtttcactatagtttagctgatctgcaagactgcatattgacttagtttcccattgatcttggcatcttgccctccaaaacattccagtttgtaaagtttgtgtgagtttgaattttgttgttcattctgttctttgaatttcatggaaccatttcattggcagattgtgaataagattaagattgaatgccccaatgtaccacttgttctctatataaatggaaatggaggcttgcttgagcgaatgacggacacaggagtcgatgttattggtcttgactggacagtggatatggcagatggaaggagacgccttggtaacaaaattagtgtacaggggaatgttgacccagcatttctattttctccattaccagtactgaccgatgaaattcataggttagttaaaacttcattgtgcattttcattttctgttcatttaagtttctaatacttacatttgagaatgcttcatcagtgaggtctccaaattgtccacactgtgtttttgtatcatgtgattatggcactcatatcattcatcttctagtgctgccatctttgattaacttggttcatatatgtacagtttgcgcaagtgaattcgtttatgatctgtgttttgtggtttacgaatgattttttttttgcagcatttacccttgaatgtcttaaactcttgattatagaacaagtaatagatgaacaccatgcatttttattattactagtcagcttgcgcacggaacgcacagccaagaaaataaagcaaaacgaaaatacactagagggggaggtgtaggatgtggatatgggcaccaggaggggtgaggaggtgttgaggttggtttcgctcagtgtgtgggtggcatcactgggtgtcaggtgggtggtgtcaaggtgtgctggatagtatgacttaatcaagaaagagaattaatgtacaaattaaatatttaggatggatttggtggtaaggatccaaccacagatctcagatatatgattaaatagcagccatatagttccaaccatatagttacagatctcagttatgattaaatattttggatggattaggtgtaccaaccatatagttatttcacaatttcaaatctcatgcttttttatactgtggtataaatgtgaaacatgtataaatacagctatgctcactgttaagcccttgatatttgtttgtggtctagtaggagttgtatctgttgatggactgaaccttctactcattcattacattccaaatacatttctggaaccagcactggaggctgctaatggttcttcacccaatcttctgctctgcagggttgtcaaatcagctggtccaaaaggtcatatactaaacttgggccatggtgttcttgtaaaaacaccagaagaagctgtagctcatttctttgatgtcacgaggagcttgagatatgacacacttttccaaggttgtgttactgaagttttggagcctgttgcttaacaatggccaat

SEQ ID NO: 9183 - DNA, 5742 bp, Oryza sativa
acatccatgtgcaatatcacaagcaatgcaggacagtaatcgattaacttggttgtgatgctgccattgaagtcttgcctttgtcctagttaatcaaactcatgaggcctttgtttggtctggagcactgctgcttctgaaaagaactccagagagacctcgagaattagcttggcgctctatctcgccaagtttctgcttcacaatctctatctcccgagccaactgatcctccttttgcctcaacgcctacaaaataaatgtttttttttcaaactcataaaatgatagaaataatcgacaaaaaatagcaacacaagtcaataacatcaccaacagcaagactgaagatatacggtcacataatggcaaagcacattaacaactggagtcaaaggccagatgatttatgaatacatgctactgcaatgcattgtctaaccagagccactcatgcgcattgaagataatgttgacatcaaatgttctctggtcaacacctattgatagtgagtttttgttgcagagacttcagtttcatatggtacatataggaatttcatttccacttgggatttatgggataccatagcaatacattactcttggacttgattctgtttcattcatctctggttctcacaaagccacaacctaaggcatatttccagtgtttcagactgctatctgttctcttgtccttttcagagagaagagtactacctcttctgcatacaccaaacagatctgtctggtaactgtcacttgcttggacaggaaaaagacaatccacaaagctggtccatattgaatgatataaagcataacaatgaaaataaacagcaaagaacaagtcaacgacgtgatattgctgaaacatcaaattctagactatttatgcaaaatgtaaattggtcaaaaaatatgcaatgcaacaaaaactataaatggccaattttagaggaaaaaaaagaacagttggcctgctgccatattattgctcacagatctgatacctattgaatgttcagaaaaggccatgataacactacaatagccctggtttagaattaaggtgtagtgcctgatactaactgcaggcaaagtctgcagcactctgtatggttgcagcttgctatggccttttacaacccattagggctactgtactgcaaggtgtgtagcatagctttggtataaatgtatttttggttttcatagcaacagtttggtgaaaatgcagtacaggtttacatatgattatttgttgcaaatagttgctatcctccataattgaatcattactacaagacttcagacaagacagtctacttacatttgactgatttataacttcagacaataaaggtaagcactttgtgtctcttatatcgctgtcatccaatattagagcacttcgctgctacagtccttctacacattatttagaatgtaataactcctatactggagtgtactccaagaatacaactgtatccaagatatagcccaagcattgccttgtttgttatcacttgcaagacttcactgaaatattagagctatcctgacgattctcagcaatgtaaacaatagctattcatccccaattattcccaggccattgaactgattaatttttttagtaacatttggtagaataatcctaagattgaatagctgcatcagacaatttgttgtttggatataccaatgagctatgtgatttttttgggggggctcctatttatagattatagatacataaatgaatatagtcactgaaatgaaatatgtggacgttaacaaaaagaaaaccattaccctgcgaagacacaactcatctcaagttacaaaactattgacattccagagcttatacctcaacttcgtttctacgagcctcctcttttcgggcctcggaccttgcgcttctttgcacctcaaagattacagcagccccagcaacctactacacaagggttgctgaagtttagtgaatggcaaaaataaaacaacagcaaactatatagaaggcatgcaggaaggcaacatttgtcataatttgacatgggatcataggtgatggttaaccaataaaatcagcaaactttacaaaaaagacatgcattgaagtaacatgtggctagattttctaaatgttcttatgcattctttatttctacaaaaaaacagacttgtctcgaggatatttccagttttttataaatggaaatcacataaaagtacggtttgcctgacactaagataatcatcacctgaaaattaaagaatttaagcaaaaatcgaaagccgaaattacaacagcaaagaataagaagaaaacatgattgtgaataccgagaaaacaaagagctccccaataagatcagcagcagcttgaacagctttctcctcgttcaaaggccgaatctcaaccttagttgaatggccatatattcttctctggatatttgtggagacccgatgatttgtctacaaaaccagttcgtggccaaaatgttatttgaagtagttaaagaaagaagtaacagctgaggaggatgcagggacgacaaattgtgagcagaattgttcgatcactagcatatttactaaaagtgcacttttcagattcagacttctcattaataagtacagttacccttctcatttggaagcaatgcataattttctgataacgaatcccattctgcgtatctcaatcaacaaagtcaagaaatggccgcaagaaaatgtacaagctagccaaaataacctgatattgcggagcagctcaaaaacaagaacaagtatatcacaaagaattcagcaatcaaagaacattcaccctagccaaagatttgacacacaacggcgaaacccttcattcctcggagggtagtaaaactgcgctacgcgatcacaaggccggggaaaccccaaaccctcggcggccaaaatcctctccacatcctattctgcatttctaccgctaaattttcacaaggcctgacgatttccaagcgcacaacgaagaacaaaatggggggaaggggagacgagaggagggggagatgggcgggggcccgcgtcacctgggcgaggttgatgatgagctggcggaactgagggtggcggctggcctccgtcttgaggcggatggcgatcggcttcgacatcgtcttcagcgccagcgtccccagcttcgccagcggaaggatcatcctccccctccctccctcccccggcggcgtcgacgaggagctcgtgtaccggacggatggatcctccttttcccgctccgcttcccgtcacgcggccgcggaggagcttgggagatgaggcggcggcggcggcggaggtcttggcgagttcacggcgagacgatgccggcgttgagatcggaagtaggggatattaggaaatttccagcacgagcttcactactggagaaggcctttttttttcattttttcttttttcacttcacaccctccggtttgacagaattctcatcaactccaaaaccatctgactacttcccgataaacctaaaactgtacatgaaaacatgacccatcattattcaccagcaataattactctctccagtttcacaatttttgatgttttggataatcgcacggtcttcgaaagatatactacatttgattatgtttttctattataatatatgtaatcaattaattatttttgtttttattatagtactttataatataacattgatttactgttttaaactaaatagttttaaagttataaatagtcaaagttatacaactttgacctcaacatttttaaaaacatcaagaattatggaaccggagggatgcttattaaaactcatgtagtaacatcatttacaatttgttgaattctacaaattttcattcaacatattcaattaccaccctcacatcatttctataatatttcaacatatctataattttataatacttaatatatattcatccatataatacgcatcaaagcacggggtaccatttagtttgtttcttgattagtactaataaaccttgactttttagtatttttttcctatcttttatttcttgcaatgcaaatattggcaaacgtcctaatagttcatctataacgtcctatagagtctattaaatttatttatctctaaatatggatttttcaaaccacctttaattgttgttaataactaataacctttgtactcctagtttgattgttgacaaaaaaatatatgtatttaaagattacttaataattcctgctgcaaagcatggagaatctaatagtatcttatatacacaatatgccttgagccacatcatcttttttgagtttaatctctaccatccttcaggtcgtgagttacatttctttcatttattgatggtcattactcctatgtgttgaaagtgtataacattgattgagcgagagggattgagcgagagagaattgcacaaaagaatgtagggaatgaatgagcgggatcctttattgatcaatgcggtacaaaatatagatgggtaaggggtggcaaccggagacgcgatggttgggaaccattgcgtccgttgccaaggagcgcctagggaagacgcggttgccttcggttgcgatccatccttttatatggatgagatcacctgttgtttcataacactcccccttgagctttgatcattgttctttcattgttccagatatctataaagataatcttagaaataattatagttaaatacatcacgtaaaactcctcgaaaacccagtgggaaaaataaggagagaaccgtgatatatattattgactattttagatctatgagtaaagctcatagtatgatccaaaatagtataatgtctacagttatcatttagtaaaaaccccagtgaggaaaagccaaatgataagacatataagcttatgttgatattacctcgttaaaaactttggatgagaaaacctaaagggtaaaactcatacaaaggaaaaagagtataatatgacgaaaataggttatttgccaaaggaagatactccccctgaatcctgcaaatttttaagtcgtctcataccaattccttcgacacatttaaagaatgtggagtatggcagagattttaggaataaatcagcaagattatcacatgacttagtttgcaagatgtttatctctccatgttgctaaagctcatgaggataaaataatttaggagcaatatgcttagtgatgttgctcttaatataaccagtttccatatgaacaatacaagcggcattatcttcatagataatggtaggtgattccaatgaaccaataccacaagatgttaatatgtggttaaccattctgtgaagccatacacattcacgtgatgcctcatataatgcaattatttcagaatgatttgtggaagtggctactagagtctgtttagaagacttccatgaaatagcagttccaccttgtaaaaatacgaatcctgtttgtgatctggcgttgtggggatcagatagatagccagcatcagtatacccaattaaagtcgaatcctggttcttttaaaagaaaagtccaagatctcttgtgccattaagatatcgaaagacattcttaactccagtccaatggcatttggtaggagcagcgctgtatcttgctaatagatttaccgagaaagcaatatctggtctcgtactatttg

SEQ ID NO: 9184 - DNA, 16779 bp, Oryza sativa
  unsure (1)..(16779): unsure at all n locations
ccaggaaatgttcatcatcaaagatagagtcagcaaaccgggcagtaaatagatcacatgttaagggttctaaatactttatgattgatggagatttgaatcccacatagatccccacttttctgtgtgggcctatagcggtacgctgcggtggtgagatcggtatgtatacaacacaaccaaacttacgcaaatgggaaatacttagaggatttccacgtactaactgcattggggaagtttcatgatatgcagttggtcgtagttggacaaggtcaacaacgtgcagaactgcatgaccccaacacgacgaaggtaatttgcaattcattaataatggtcgagcaataagcttaattcttttgatcaacgattcagccaaaccattttgtgtgtggacatatggaacagagtgctgaacctgaattcccaatgtcatacaataatcatcgaaagcttgagatgtaaattcggcagcattgtccatacggattgattgaatcctatgttcacggtaatttgccttcagccttataatttgagacattaatttggcaaaagcatggttccgtgtctgaaaggaccttaatgtcgcctaaaggggggtgaataagcgttcctaaaaattatcacaactttattacatattaggatgatgagaactttcggttcaaataggaacttccgatatgagattggaagttccggtctcnnaaccgaaaagttcgggcggatannatggaataaagcactagctatgnaacttgtagctcaaataaacaaaatgaatatgaaaaaaggggtgacaaataaggtatctaaacaagatataaggtcaccaactaaatcaattaagcatgcaagtagatcgggtaaaaacaagctcaagcacaatatgagagaatgcacaaatgggcaaaccaagagaggagacgcgtgatttgtttgccgaagttcggattcacggatcctacgtctccattgaggagccacaagggccgggcctatttcaatcctttcctcacgaggttgcacaaatgcactcctcggtttcactcttgatttcttcccttgcggaggcgaaatcgaagccttcacaaactttccgtggcacaccacaaccttgggtgctcaccggcgacacctagccgtctaggagaccttagtccccaagagtaacaaacacaatcgaagatttgcttgctatgaactcgagtgcccaaagtatggagtgaagctcactagctctcaatttctcaatcactcaatccaactctttccccttctcaaatccctctcacaaagaggcaccacaaaggatggagtgaagctcactagttctcaactcctcactctctcaatccaactctctccccttctcaaatccccctcacaaagaggcaccacaaaggtagggaaatggggatggctatttggctttggatgtgtctaatactccccaagagcagcagccactcaaaggaggggtggaggagtttatatacccgagcctctcaaaaactagccgttggaggccaagactgtaattttcggagtttccgaaaagcattttcggacaagtccgaaaacttacagaaacaaatctcagattcgcagccattttcagaatatccgaaaattttcggattcatccgaaaacttttcggagtttccgataatttttcggactttccgaaaagcacagagtaaaacaactataacttttcgctcgggagtccattttttataatcttagactctatggaaagctcactcagaggactacccaactcaaccaaaaacaaggtctaaaaccactcaaaggataggttaaagcttgggtttctctcaaggtagcactatgataggtcactttgagcaccgagacatacacaaacacctcgacgttgcatccctcttaatagtacggcattcctaaactcaaatgtaaataagaagataattataccattaggaatgcctttttttcatctttctttcattgtcttgagggatgccaatgccgatactgtttcaccatatattcttcaaatgattgatgcggttacttgtagcttcaaatggtctcgcacggtccatcatgacaaagccgtcactcacccttcacgaccggatttggttcttcggcgccaagccccttgtttgcccttcaccgccgcatggtccatcgcgaccgagcatcgcttgcccttcaccgtcttgccataatagccacttcgtatcacacatcttcaatatcttcactttgtcattcttggtattgttaggtgtaatgatatcacttgagcatcaacacctttgtaatccttgggacctatttctttcattcaactcaataaaattattagtctcaatgatccggttgtcaacctccacatgttgaccaaccgatcacatgtataaaaggatatgaataaataatgagtattaatcaacaccaaaagtgtcatatactcaaatatatattcaaatgtaaagatcccaattaaatgaaggtgaataacttggatcgattacatgcataactaaagtataggatttgctccccctaaatatatgcatacaaaatatttgtgtgaagcaagagtatgcataacaagatattaaacattgagagcttatcctatacaagaatagaaggcatttatcaaatatagccaataaaataaaaacataccttcaccatctccatgttctcaatgtaaagagactaaacaagatatggctcaaacaaaacattagtctcacatgcttatgtaatcacatgaaaatattatatatgaatatatcaatatgtgcatggatagaaagagtgatacatatagcttgatctccatgcatttcatccttgtgatttaggtacaccatcaatgaacgtttctctcttaactcatatgaagtccagaaatcacctctcacatattccactttcatatccatatgagactagtagacaaagaaatgcttataacaatgttagtctcatgtaattggatttgtcattaatcatcaaaaccaaattaatggcacttgaactttcagtgtcgatagaagacacatgtgagactatctagtagatgcgtcaatcaaaaccataatgtacctgaacggtccagatcttggcacaatagggccacagatatctccttgaatgcgttcaaggaatttaagtggttcggctctaattttgagataagatggtctcaaaatcagtttcccagtagcacatgcagtgcatacgaaatcagaggatttgggaaatttgtcagtgatcaaatgatgaccaatagagttgccaataatttttctcatcatcccgataccggggtgcccaagtcgatcatgccacgtgtggaatgcatcaacattttgaaaaattactttgtacgcaacatgtgcaatgggcttaatgtatgcatagtacaatcccgatgtgagtgatggaattttctcgcaaatgcgtttgccatatccgttttgtttggttaagagaagaaattcttctcgattatccatatgggtttcaatgtgaaacccattttgacggatatctctataacttagtagggtacgggttgaatcaggatacaataaagcatcctcgattgtaatttgtgtacccattgggagtgtaataattgctcgtcctgagccaactatcacagtatcgtgcccagcaatagtcaaaactttgccttctctatttttgagagtttgaaagtatttgatctccctaagtatagagtttgtggtaccactgtccacaagacataattcctctccaatcggagtgatatccttagacatctataatgaaagaagaattgcttgattaagaattctttatccaatatatatacatacatacaataattaaaacatcaaatacatagtatgacatttacattatgctaatagtacatactctaatgactagcaagccatataatcttacaatataagggagttcgtacttatctacttattacaaccaatattgtttggcaaacttataggatatcaatatactgtttcaagcacactaagataagagcagcttcatctccaagtgggacgcactgagatcattgcaaatctccaagtggatccgttgagcagtattcgatgaacatatcgtccatcgcagagagtggagcgacatcttctgggagaacattgaggttgctctctggttcaataggagcctggtgagaacttgcaacctcagggcgctctttatgtgtaagattgaagtgggcttcaaatcttgggttttcagaagactttttgtccttgagggatttttcgtacaagagaacaagatgtttcgggatgcggcagtctttagcgacatgagtgtcagatccacacatgttgcaatgcttgttgccattgctacgaggttgtggtgccttatccttcccttttcctttctttcgacccttgaatttgcgcctgttgttgttgcgtttgcgctttccagtcagattcttaggattattcgaagaatttcccttgaattctttcttattctcagcattattctatacattgaagtgcacctcaggcagtggagcagagcccggtgggcgctgttgggcattctttaaagaaagctcatggtgtctttctgcctgagtcaatgtatgtataagcagagaatgtttctggaaattgttagtgcgatactgttgagtcagtatcctatcctccggaagcatagttgatagagttttctctatcttctttgcctccgttggctcttgttcgcaaaacttcaacttggaacaaatgttatgaacagtatggttgtatcctgccatagttttaaagtcctgtaggcgtaaatgaacccactcataattagcctcaggccaaatgagttccttttgctgatcataatgctcttttagagctttccaaaggttgagagggctcgtctctaacatgtattcatgtttgagatccttgtgaatgtagagtctcaaaagaaaaagggctgtattgagcttcctgggctcaatttccgggtccccatcattaggttcctcaattgtatttaaaatcccccgagaggcaaaattgattttgatattagaagcccggatgggatagttagtcccatcgagggcgagttcgtcgaacttttttggtgccatgtccctacaatcatggttaacattatcaatttatagaggtaaattaataaaaacatgatattaaggttgtaatctcaatgcgaaatgtaatacttcatattttgtaatgttttgaaaaaatgcaggtaatagacctgacaatttagttagaattcgaaattaggtggcacaatgtggataatctccaagtaattaaacagtggagtagatctcttaatagtgggcaagttatacttgctgcctaatacacggtctccaggcaaatatattctagtgaatataccgcagccaatgtttaggactccactaccttgtgctcaaccaaatttcaaataatctcatttttcaaaacatattctcggaaaataacacatgtgggtaatcatcgtgagatgtagacctctgtgagatgggcgagttgttcgcttcctaggttatgaccagtgcggccaatttgtaggactccatcgggtaatcatctcaaattgtagaccacttgatgatgggcgagatactcgctgcccaagttatggtcaatataaccaaagtataggactccatcgatatgtgattaatttccaagtcaaagtgtgaagtggaacatgcattaaatcctccattaatcatgttgtacataattaagagaatttgccaaatcaaagtacaaaatttatagaattttgtagattaataaagcgagaaagtagagcgtgtcttgaaataatatgcaaaaggcatgttattaagacaacaataaatttagtgaaacatggtatttaaataaacacctatgttaataaacacataacatcagtggtctataggaccattacataattgtttgtacaactgatgaactgcttcgactaaattccataaaacatagggactaaaatgtaattgctgctgcaaataaaattaaaaattaaaattaaatggtaaattgggtggtgggacaaaatctaaaggattcggcccaccaccgtgtggcactaggccggcaggcaagggggggtggtgggtcggcccatccggcccgcagcaaaaaggcaggggggagccgtcggggggattagggttaaccctaaccgcccccacgatttcgtcgccgccgcccttttcgccgcccaccgccgccagttcgccgctatcgacgccgccgttgggcgccaccgacgccgccgagggagcgccgagggggggcaccgcccttcctccgccgccgccgcaccatctgccgccgccatctccccgttgtggcgccgacgcgtgatgcgccgccgctgctgcctccatattcgccgccatccaccaccgcctgcatccacaatccgccacccaccgctgtcgccatccacaatccaccacccaccgctgttgccatccaccactgctgccacggccgcccctccgtccgccggcggtttgccggcctgattaggccgacggctcccgatcctcatcggaatcggaggccggccgagcccggatgtcacgaccggaaatatcccaacgggagttcctttcgtgcgtgtattattccttgtcccaggaggcaaggtacaccaaaagttgatacatttcagagtttatcaagcggaagcgtaaatagttactttattacatgggcggcgaaggcccagcacacacaaagacaaacgggaaacagcggaagactagggcgacgaccacaggcgcttgacggcaggcacgagctaaacaccaaagccttcatcatccaggggctcctcttctgggtttgggaaaaattgagcaagactgagtacaaccaccgtactcaacaagacacacccacgagtgtagaataaatgcaagggagtacaagggagccataatataggggttagggtttgcagtaaacagcattaaaagacacttagttgctcaaagctattttgtaaatatgatcctagagctatacaatattattaatcaaggccgtaaacccacatgaacctgccttaacccaaggcctacgatgattcagaccgaactggcaacccgaccttgggtcccagctcgtcccaagccaacccaggccaaccattccacattttagttgttaagtaggttttaagaattaaaacactaacttgggtacattgctcggcttgcccataaccgaggacgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctctgggacaggtaggcaggactgagcccctagcagcaggacaccagccctgtgccatgacatctcgactaccgggccgcatctcgtgtagccttcatttgccctagagatatccattgacccccgacttcgtccatctccatccgtgtacttttgtttataaccagactgagccacaaactaagccttacccactagacatgtggaagtatggtagtgctttgcaatagaggcccgaagaccggtccttatatggccgaggtgctactatcaaaaccatgcaccccgagcccagcctaaaaccattttgaggattttgaatacagggggaggtgtgaatccaattccacaataatccaacataatccaaccattccatagtgtccaggtgatgagaatattcccaaagtctagggttgtaaaaccacctaatgttgcctaactaaccagcgaagcatctacctaaattcatactagcggtaccacgagtagagtgtccactagttggggttttgtttattctagggtgaacaaggtaataataacaatagtaataataataaggtcataacaaaggtaaataggcatggctaaataaaacagtgataacgcgggaatttaaataaagcgataatgcaataatttaaatcaaaataattttataaaatgggattcaatatgttaaaggatgatgtgacttgccttgctcgctttcccaaacgtcggcttcaacctccacgaagagcggatctttcgaagctgtagcgtctacatgaccaacggaaaagaaaaggattttactctaataaactccatataacaagcaggaacaaagcacacaaatgggttcttgacttctcaaggaaaaattagagacttgaacggtccaattccgagttcaaatggccaagttatggccatttgaagtttatatgctctttaaatgaatatttgcgaatttcttcatttaaaatttaatttaaaaaggttttattgtgtcagccgagggggaggggcgcgcggaccgggtccacgggagtggggcccacgcggcagcctcacggtccacggtggaccgggtgcacccgggctcacaccggctggcgccgtgggccccacacgtcagccgcacccgagggcgcgggcggctgacggccgggccccacgcggcagccactcggcgcgcccgagggcggccatgccggcgcggtcggcgggaggcggcgcgcccacgctccgatggtcgccgccggcgaccaccggcgcagcggagcggcggccgagagaggggagggaagggggaaaggaggcgaccgtccacggctcaccccggggcgacggcggcgacgggggaggtggccggagcggagggaggcggtggcgtggctcgggtcgacggggacggcggtgctccggcggtcggctaccgaaacggagaggtggacgaggtcggcgaggatgcggcgaagccgaaggaagcggcgccgaggtgggaggcggtccggggcgacgacggcggcggaccggagctcggcggtgacggcggagagagagagcgacgtcgcgagctcgaatccggcgaggaggaagggcggcgagaggcggaaacggacggaggaggtgcggggagggtttaaatagggttggaagggggagagggcggccggaggggaaggaaaccggcgcggcgttctcgggctccatcaatggcgccggcgggattaggggagggtttccaaatgaatccaagggagagagggagggaaaattggggggaaagggagagggaatcacggggaataattcccccctattgattgcacgcggggacgacgggatgcggcggattcggcggcggcggcggcgcttggcgtgggcggagcggcgggagcggcgggaggtcagagatgacgggtaggccccacccgtcagcgagggtggcgggcgggcccgcccgtcagcggcgcgcgcgcggggttgggctgagtgggccgcggggagaggagagagagggagagggagatgggccaagccggcccaagagggggaggggggaattttaaggtttttctttttataaaatcattttaactttgtttatttcttcttaattattatttgtgctctgaaaattctactaaaatttatttacacattttaggcttttaggaaatatacaaaaaaatcctctaagcattgtttgacttttactttgcacattttaatttttggaggctttcacacggattttaattattctaggcataatttaaaggatatattttagggtcgttttgggacgtgacaccggacgccattccccggcaccccgttagggagtgtatggctaggagagccatggggaatggcgatgaaggtgtggcggaggccgggacggtgagcggcggcttcaccggcatgacgacgagacgttgacggattgaagaagggcggctcccccgtgcacgcagccagggtaccggtcctgccggaccccggtggcgtgggagtgggggaacggcgtcggcgtcggcttggtgtcggtggaggtggtgaaggagcggttgttggtggcggcagcgactccatctccggggaaatattgcatggctcgccgggcagtgtcaccactgccgtccatccgtggtaggcgtagtactgcacccgctacacacagatacggcgaggcacggcggcaaccggagacggaggcggaggaggagcaaccggagtagtggccaccacaatgcgtcggcgagggtggtggcgacggccaccagccctagcccgacgttcatggtgttggtggcgacagtggtggtggcagccactcctctccgatcgacggagaaggtggtgaaggcgacgggcatgctgattgcgagggaagccgagaacggcatccataatccaatgaaaggtaggcatcgtaccttctctgattcttctattcgcttttctattagatcaaaagcgatgtttcttccttgtttcacttcgcgatctccttcgcgagagcgaaagtgctgataacgtgatgaaagtgtataagattgattgagcgagagggattgagcgagagagaattgcacacaagaatgtagggaatgaatgagcgggatgagcgggatcctttattgatcaatgcggtacaatatatagatggggaaagggtggtaaccggagacgcgagcgcctagggaaggcgcggttgccttcggttgcgatccatccttttatatagatgagatcaccctgttattttataacactatgcacatactcctcatgtttatgtgtttcaatggtaatatttttgcagctcaatttactatttttttaactcaatagttcatactactacgtatatttgaaactgtcctaattacctgagatgggtgatccaccaggttcgataagcggattattgatttgattacccaaataaattaaatataaaaatataaattgaataaatatttttattgaaattactatcaggtcttgcctagtagttaagttatattgaaaaagaaaacaaaagtattgacatgttggaagcagcaaattgaaaattataaataccgtaaccaggaaaaaagcatatgaactaagtacctcattcatcatgcacatatgcacgagaattttattttaaaacatctgagtcaaacatctttagtggggcaaaacattttggaaaaaaaaaaatccttttcatgtacttccagatatgccaacacattatggacatgatttctaagaaatccttgtgtctgaaactaggatttggaaaaactttagattcatatttcatcggatctaaattctttcccaacatcttctgctgaaaggacatataaataagagatgcgcaataggatttctctagcatcactggagcatgaagcacaagtgagatcaacattgttaggtgagtagttttttttctatttaacatgtttcttgtgtttaacctatcacaaaaaagtagccatatgaagaccttgatctttatgacacacttggttttacaaagccatatatatggtctaggtggaggaagaccaacaaaaatcatcttgtaaaacttctaagatgagtactgctggctgctccaaatgaaggtccaaatatctccattaccctcttgcaattgtagttgattgacttatgtttgaagttacagagattcatgatatgtctgagctgacagtggcagttctagatgtttaaaaggtcttcactgtgtccaatttgaaaattgcttgagaacattatcaagataatacatgaatgtagactgagccttgctgttgtcgtggcttactctcattgtgataatgctatgtgcgtagagatagagtttgttatcctcaatattagttgagtagttgttataacaatgtaatcttatccagagattggttatgcctaatctctaggatctcctgtattgccacggtatggggcttttcctaccacatatataaacacgcaagcggcgcatggcacggtgcgatcgttttaagccaaaatccacatgatatcagagcattatggtcgtaaagttgaacataaccacaccattaactgttttaacgtactccaatatcaaaacttgaaaaaacagatgaaacatttatacaacggatacaatccttataaatttgagatacgattgtagaacttaaaatcgtggtagatcaatatctaaatgacaaacaatgtggttttttgaaactttaggaccgtaatacttgtggttatgcgccacaatatgtgtggttttatatgaagttaatttactctcttatctattatcttaaaaaaagagataaaataacttttatattttgaacgactagctagttctcatgcacgtgatagagatgtgtgaggtcatgaagacgttccaactgctttttttttttaacagtagacggtaggagatctacccgatattttagaagaagagagttgaccctatttataaggaaaatcgggcccaaaaaccatacaacttcacagtttgctaaagggaaaccggcaaaaccttacacagaagacacaaaaagcccgtgacaaaactacaaaccacagtagacaccgagggaagagcaagaccttcaaggcgaagcctccaaggaggtaaacaacgacagaagccgctgccgacgcccacccaactgggctgggttttcacccgaaaggggagggagtccacaaggcaacacctccaaggaggaaaacggtgcccgcaggcgtcgatgtcgctgatcctatgagaccagactaggctttcgcctaagactccctcaaaaggtgtagagcctctaagaagccagagccagaatgtttaaagttatcgttgctcggctcatcggatgaacccgatacagcagctccgactccacctaaacacaaagactctagcaatgaagaggacaagcacccagctcaacactcggcactacgacaggtttacacagacacagggcacttgaaacacgacgaggcccaagagcgctgactacagatagaccgaaccaccaacacagacaaacacaacacctcagtcgggtctggaaacagacaaccaaaagaagggaggagcaccaaagatgaaggaggcttgggccgcctggagaggaactgagagctgagacagggcaacaaagacgtcggtgtcttccattaatccggcgaggttctccaggcttcgtgagacaaaccaaacaattgaacaaccaccttcaactaaaccaccagcgcagagaggggcgtgctgggggtgagcagaagagcaactaagaagaaaccttggtgaggggaaggaatgggggagcgggggcgccggcacaagcacacgcccctttctttcgccgggggacggcgcagagagcaaaggaggaaggggggggggctcagcaaccgccggagatagaagaggccgaagaccagagtcgccggcgccctggaaggctgacgcaccaccaaccaccgaagccggcaggcgccgcaacgccaccatgcgagcaccggcgaattctgccgcccgcgcgccggcagccgcactgctgcacatgcccgccgccacgggagtgcctaccgccgccgcaaccccgccgctggggggaggggggagagagagagagaggtaggtggtctgaggggatgggggtggggaggcctccggagccggaaaccgccgcacccgccgagccgccatgcgccagggcacagcaccgacccagcgctgcagaggctcgcgactgccggccaccacgccgccacgcgaacgcctaccaccgccagccgccgccgttgtcagccatcatgtcgccacgcgccgtggagactttgacggccgcacccccgcctcgaagcgccgcccgacgccgccgtcttcggatctggcgacgacgggcccagatctgtcgccgcccagcctggagatcccactgccacttgcggacgccgcgtcccccgcgtagagacagggcgccgccgccatcctcgttcaccaaccggctttgccggtggcgatctccggcggcggcgaggggggagggaggggaaaggtggggcgagggtttcgtcccccggtcgcctgcgcgtgggcgacgcagggggacaagcagcaactcagatatgcgaatggactaagaggagatatctatctatctattatatactaaaagtccattaaacgtcctacaaacactctcaagacaacacgtggcattcttataaacgctcttaaaacgccacgtggcactatttaatctcaccatcgattttcatttaaattggtggactcgttattttagaccattagattatatctatatctatatctatatctatcccgttgattttcacttaaattgatcgacccgttatttagatcattagattagatatatatctctaatactaatactttccacctatacatacgagagagaataggttcgccaaaaaaaaaatgtaagtacgtaagattgaaaaggaacaataaaacctacatacgtacggcaaaagaataaagccatcgtgtcaaaaaaagataaaaccaaaaaaaatatacgtatatagtatcatacaaaaaaatttaaaaaactcccatatactcccacatattagttattattaataaatttgaaaaaaaacaaatatattcttcgaatcagtaaaggtgtctcatgtgattatcaactataagtattgaaaataaaccaagcgctatactatagatgttggtcaaaatataaatgtttaacaccataaacacacgtggtgtctactgtatactaggaatctactcaaaacttaaaaaacattcttttgatcacctccatcttctcttttagtaccgtcgaattacaacttcactcattttcaaattgcgtaatgtttaacaccataaacacgtggtgtctactctataccatgaatctactctcaaaacataaaaaaaacattcttttgatcacctccatcttctctttttcctttcatgaagggcataagcatgaataatatagtttgctacgttgctattgtcatgaataatatagtttgctacgttgctattgtcagggttacgggttaggtataccttctacccttcgacatacgtcacatatcgatatggtatacttgcgcgtgtacggacgtttttggcatacgttaagggaattcatcatggagttcacagatggaaggagtcctactcggacaaaactgggttgtcattgtatcatgccgggtccgatgtctccgagtcctacttggagaccagccgacttgcaatataaaagggaccccccgggaggacctaaggcatcgaatcttaccgccaacacatccaccacagcctacgaagtcggagcttacaggagccaagtcgcccggtgatctagtcgaatcaattcgactacgatctcgtcggtatcgtcgagttccgctattccctttgtaatatgtggtttccatcatataatcccatatcaactggattagggctattacctatcaaggggcctaaaccagtataatctttgttttctgcctgcttgatgtcgtattatgtagatcctcgtaccagcgtaccccaataccctctatatccggtctacgggtatcccccgtcgacagctataagtataacagggacgtacatatggttgagttaaggcggtcgcaatggagaccacagtcaccaatagtgctcaacatactacttaccgatgcacaactcgataagggtgtgatagtaaattaggcattaaaattgtgctccaggttagtctggaggtgcacaactacatcgatatgggacccatgtttcaaagcaaatgacaaaaaaaagtctagccactacaatcggcttcacgcattagagaagcatttatgtataacattatgttattctattaatttgtacaagtggtatttttacaatatttatatatagttttgaaaattggtgaggtacgaaacatttacgtgtagtggatatttcaatgtattaatgatgtattaggcttattttattgatacattacgtagttcatctatgaatagttacttggcttttaaacagtgataataggttgaagtgacaacaagaaaatttaatttatatgtggcaaagtgattttatttaatctaggagaaaaccttattacttaaatatattaaagtatgcaatatatttctcggcttataaatggtgagatataaccttttttaaaaattgtcttcataaaactgcccgcgcatctgctcgggctttcttcttagttgttcttaaaaaagttgactaactttagtatcaaaatatcaaactttttctgattgatggatacggggtggctaatttaatccacgccacaaaagattaaacctgccacggagcttatctgcctgcatctacgagtttaaccagcacaaaccagcacatctcggcgatgcatgatcatatctacttgttacccgtgatgccagggaatagaattcgggttcaaacaaaggcacactgtttcccggtagacgcgaaggccgttccattctctctgtctaagctgaattccaaattcctcccaagccaacagacagtatgatccaacagattgagtagagccttgtgcttgttggtattgtgcatgctctacatccgagctgcaggttgatggactccctacatccaagttagacatattactttttaacaccaagatcaaaaagaaattaaatc

SEQ ID NO: 9185 - DNA, 14919 bp, Oryza sativa
ctgcagcccattttcaatccggcacatcaatttttttcaccaatttagagtcggactttttttggtttctgagagggaatcggatataggagtcggacttttttattttaattttttcgctattttttttaacggacgaaggaagcatctcttattttttaagtagtagagatagagactggggaagaatatataggacacttgcaaacctagcttgtggatgtaaaatacaaaaatgaagcccaatacattttttcttttttctatttctcctaaacaattatcagtttttccttcaaatttgattttatcttacttttgatcaaaaaatttcttcactatctaccattagaaatcaagaactacatccatgattttttttattttttctgaaaatttgaatttgctcaaaatttctcaaaccctaaccaccggtaaccgatcccctccgcacgcggtaagcgcgataaccgcaattaccgcgcgataacgtgaaccctgggtatcacacgctctcaatgtgcttacttattcttagaagcacagtagcttccttgctaaagcaaataatacgagctataatttgtttaagtaattttgtattgtcaggacttgttgaaataatgcaaattatgggtggtctgacatgaaaatacgtaattgttcatctaccaaaattcatttatcgtcgtcgtccttccccttattatgcggttactagttgacatactgaatttacatcgtggggattagtactccaaaagttccatagtgatatacattgctcgtactgaatttgtcaaaaaaaaaatcaacagttttattattgcttcaaataattaatcaacccgacgttatggtcatggatttctacaccatttcaaggtaatagtttcttctgtagtaagagataaaaaaacttccaatttttaatgactagttctcgtgtacgtacgtgctagagtcctacagatgcatgaggtcatggggacgttcgagctttgaggtcgtagacgaaggtcgttccatttccttggtctacactagattccctgtgcctcctacgccctaactaaatgagaaacatgtgtagacccttttgcttgctggcgttatgcatgctactcccgtgctggaaattcttgctaattcgacgatcggtatacgcgtcctataaactgtgcttcgtccaagatgacgcgcagctaatatctgtagtcctccttgtggaccacctaaaaatatattctatccgtcccaaaatataagagatctaaaagaatgtgatatatctggacaagttctttatccagattcatattaatatgatacatcatatccattcaaagtcccttatgttttgggacggaggaagtatgtggcatcggatctcgtcttaattatcataccatctaatctgggaggtcatacatgcctttttcttttcgagagacatatgatttggtttttgctatatataaaatgattatgatggagatttaattgattatagtgctcatgggaagcttaatttcacagtaattaagtctgaagatcctgaaacaggaagccactcagatgccctttttatcatcaaaagggttttcggtttcaaaaatcatgcatagtagtagtttgttttgatatgaccaaacatattttcatttcagatataagtctaaaggtatactatcaaactaatactgttcttgcactgctccttttcaatcgatcgcactaattacaaagggcaagatcagatccatgcaagtgacacacaggtcacccataccccactccaaacacccagatttcctcctcgatcatgcaagtcatggcgacgccttgagcttcggcttcacagttcgaaaatcgaaccacaagcggaggaaacagatcgagacagaaggcggtacctgaaaccatattggaacgaacaattcttggttatctgtatatggaattcccgatgcctcgtatgcccttaatttgcacatccaacaccacaccaagatatcaggttgtagtaagcatatatgtagagcaactttgctttcatgagaagctatcggtttgtaatgcagttatgtttttttttccctgaaaattaagtaggaagatttgagatttcaaactggagtccacttaggatatcctggtgtaatgcgtgtaatgcgtccattatgactatgtgctatatatgtaggtggtattttctccgggttgataatggttgtcgttttagcgaagtgtcgacgggggacacccgtagaccggatatagagagtattggggtacgctggtacgaggatctacgtagtacgacatcaaggaaacaagagacaaagattatactggttcaggccccttaatagccctaatccagttgatatgggattatatggagataaccacaaattacaaatggaataatagaactcgacgataccgacaagatcgtagtcgagttgattcgactagatcacccgacgactttgctcctgtaggcaccggcttcgtagactgtggtcattgtgttggctatgagattcgatgccttaggccttcccggggggtcccttttatatcgcaggtcaggtggtctccaagtaggactcggagacatcggactctgcatgatacagtgacgacccagtcctatacgggtagggacctttccattggtggacttcgtgatggatttccttagcgtatacagtgaacgtctgtacacgcgcagatgtaccatattgccgtatagcgtacatccaagggtagagggtataccttatccgtaaccctgacagtagcccccgacttgagcttaaatgaacttatgtaatcggtcgcgacttctgatgtcggagttgctgtcgttctcgactggtcgatctcggtgtgaggactgtagagacaaggagtggtcgacaacaccatgcgaagttcaactgttatgagtgaatttaaattgaagtccaaaaaaccgcctcgcgcaacggacccagaaatttccggcggccatctctctcctttccttggaattcgcaccgtcggtagtgcgcctattcaaaggagttttgggaatccattttggagtccggctgttgcaagaacattctagcctccgaacgctcttcgtcttctccgcttccacgcaaaccctaattcgctcgcctcggtttcttctccggtgatctccaacggcgatgaaccttgacaagtccacttccaccagcgcgtctttgaagaagttgcaggaggagggcgctctccccggtcgcgggaccatggagagggaaccgggaggtactgaacctaaacccgtcctgggccgcatggttgcggttgaggattatattctctgtggctttcttcctccgccttctgagtttttccttctcgtcttgaacttctacggtctttctctgctccatctgaaccccatctccatagccttccttagcattttttatcatctatgtgaggcctacattggggtagagccgtttcttgacctcctccgtttttactacgagttgcgctggatggaacctaaaaaggtatccgggtgtgttggtttttgacttcaagatggcctgaagtcacgatatatccctttctagtgcccctcttctcgtagcaaatggcgggcgaggtggttctgaggagcaaccagacaagattccgtcttggaccgccaaacccgccttgaccctatccctccagtctttcattgacatcatcgatgacctccgagtacgagggttgttggagtatgaagtcgctgccgacttcattggtagacggatccagctgctccaggctcgagcccatccagcctttgactactctgggccggaggacacgacccgggtttctcctcagggtatttttcttgtattctgggtttctctcctttcatgcgcattcctcctgacttatcgaaatttggttctcgaactacaggtttgaacagcgcaaccgtggagcgccgtgttgcccaggtgatgatcagtggtcccacgacggtgagcaacgcccccatccctctttgcgagaaagaggcggctgagcgcgaagccgcaatcaacgtgagtgtaatcgatgaccctttaccctttaactctttagatcgcatcgtgacttcatgttgtgcaggctctccccatgactgacatcatcgggccgctcgcggaccaccagacggcggcttcgttgaaggagggcattgcccaggaggcgtccgacgcggccattgccgctactgctgccacgaccagcggcggcaaagttccgacgcccaccccatcgataagcctttttggttatcaattacatagtcggaaaatgtcgccctcatatcgtactcggtttacttaggcctcggatgcgtctcccccgcctccacgacggcagaggctggtgacactcggcgagaagtaagtggacgaaatttgaggcccttgacttgatcggattttggcgttttgttatgatgaccaacatggccgtctttcgtagggcggcgcgggcgaaggcggcgcaagatgggtctggggaaactccagcgtgtctcctgcagtggcctcgactgatgtcgttgtcgtgcccaggagccgcgaggtgacgcctagcggccctgccagcgatcttgcacccggtcgaggcccgcctgctgccgtcctcacatggggggagctccaagtcgagatggggcgcatcctcgaggctggtgctcgcggcataagttgcgagatcgcggaggcaagggcggcggcggcggcgtcggcgaacgagcgtgccgacaaactggcgcgtgacctggcggaggttcgcgaggacctccagaaaatgagggaactggtagccggcaacgaacggcaatggcaggggctcgagaactgcatgtcggaactcgagaacaacccgtcggagatccgaggtttgttgcgggtcacctacaccggcctacaccagctcgccagggaatgtagtgtcaagatcaccatcccggcgaaccctgatgagttctcattgacgtcttcgctcgcagaactggcggcggcgatggaggtgatcccctccaagcacgcggcagggatcggggaggaaacgtccaatgggatctacaccggggcgtgccatgtcctcgcgtgcgtaaggttggcgcaccctgaactcgatctccagaagatcttggatcagggggcggctagcgacgcgcgtaacgatgtgatggaggaggttggcgatctgggggagtccgttctcccactttttgaagagtagggctactacttgtctgtaccccttaaccaatcgcgctttgtaaaactttcgttggttccaactgcctttgtgtgtgcagttattgccttagttttccttagcgtcttgattttgagtactttgtgttgattatagagacgtcgatgtcgaggatatccagcagcgcgggcagcctgagttgcctgtaatcgctccggtactcgcactcgagccgtatgcgccacaggacgatgtggaccaggatatggcgatgactcctttaggttgttttttttgtctccatctcctttgctcttctatctggattagcttaacttgccgtgctctcggaagaggagaacagcttaacttagttatttgcttgccgagcagacctcgagagtgcgcttgctgaccacgaccgtcgcgtccaatactggaggacgaagttcggggtcgccgaacttgagaggactatgttggaagtgaagagggaccggggcatggagacactccgaggtcgcgaggtgtggttcaactcgtacctcaggagtttttgcacagctatggtcgttgtctgcagggaactccgaatacctcgtggggatcccaaggagtcagcggccgggtatatctcatggctgaacggggcctgtgctcagctcgaaggcatcggcaagcgtatcaacgaggccttgaagcaggagtgtcgtcgatcgagccggtatgccggagggcacgtgctggcatgtatacgagatcatcgtccgcagttacacctcgagttcctccacgaagggttttctcgttctcggaggactcctgcggagatagacaacctagcgaagtcgatggcgccgctagcggagaaaatcttctagtcgatggattggcgttggccttcctggtagtctttgtatatctgtgacaagcatcttaggaaaagtgtaatatattttggaattttttgcggtctgtaagaaatacttgtgaagtagaaagggagtctatctaactaagctttcttactctggatgtggtgcgtacgagtgtcttctcacttcgcgacttcgatcagtcacttgagttatacactctccctagcccccaaccttgtcatcggagaattcttctcggaagattaggctcttagacatttgacttgccttagttgaataagcactgatcctagcccccagccgtgaagttggaaaatccatttccgattacacggcttggttaatacgcatgacgagaactcttacactaccagatcttacatggtctttcgtctctaaaggatccgacaaggccttatcagctctgggcgtccccagccaaagttcccttaggttcctcgaaggccttgtcaagacggcgtaaagggacatgaggataggtttcaacgctaggtgtcatctgggtaagggatcgttgggaagggacactttgattgaaatctgtaccttgaaacaggctttactgaagttgtaagatgtcttacaagtatggatactattgacttatacatagaatttacgcaattggtcaatgttccaagaatttgctaactcgcgaccatcgccgtctgcaatcttgaatgcgcctggccgcaagacttgtgtgatcgtgtacggtccttcccatttgagtgagagttttttcgccctgcttggctttggactcgccgaaggacgtagtcgccgatcgaaagtatgcgtgctcggatgcgcttctcgtgataccggcggagggcctgttggtagctagctgccctgacggcaacccgttctcgatgctcctcgagtaggttcacgtcgtcgtttagctgttcctcctaatcctcgtcggagtacttatgcactcgtgtactctgatgtcgtaactcggtagggagcatggcttctgagtcgtacatgagaaagaagggtgtctctttgttggacgttgtcggtgtggtgcgcacggcccagagtactgaggggagttcttcgacccacttcttgtcatgtgatatcagcctgtcgtagacacgggtcttgatcccttgttgtactatgccatttgccctctcgacctgtccgttgctctaagggtgagaaaccgaggcagagcagaacttgactcccagtccgatgcagtaatcctggaaatcgacactgatgaactgggagccgttatccgttatgatgcggtgaggcagtccatatctgcaaaatatccctttaatgaatttgatggcattgtcggccttgatttctcccgtgggtgttgcctcgatccatttggtgaatttgccgatcgccacgaacaggaatttgtagccgccctgtcctcgtgggaatggaccgagtatgtcgagcccccagcacaagaacggccaagtcagagggatggtttgcagtgcttgcgctggtagctttgtgtgtttgctatgaaattgacaagcttcacactgttgtactatgtcgcaagcgtctttgagggcggttggccagaaaaatccttgtcaaatggcttttccgaccaatatacaaccggcaacatgtgacccacagatcccttcgtgtatgtcgaggaggaggtgttttccgtcgtcagacgagacgcatttgagaagtaccctgtttggcgccttcttgtatggatcgttgccgattatacaggagatttttgcttgacgggttattttctcgacttctgcatcgtccttgggcaactcgtcgctgcttatgaatttaatgagtggggtccgccagtcgtccgtggtctcgatgtcggcaacggcacgctctgcctctgtagcccctgagctgatgtcgggggcgactaggctatcttcgccgtttgcctcttttactgatggctttgtcaggatgtccagaaaggtgccgggttctagtggctctcgtctggatgcacgccgtgctagattgtccggctcgatgttgtccttgcgatatacgtgtcggacctcgatcccatcaaatctgtttttcagcttcctgacttctgcgagatacttggacagctcagggctagagcacttgtaatctttgtgcacctggtttgcgactagttcagaatccccttttacgatcagtcgtttgactccaagtgcagctgcagctcttatcccagcgagtagtccttcgcacacggctgtgttgttggttgccctgaagttaaggtgaattgcatacttgaactgatctcctgaaggtgatgtcaagatgaaccccgcacctgctccctggctgttgagtgcgccatcgaacgccattgtccatgtttcgttgtcggtctgactgtctaacctgttttcaggcgtagtccaatcggctacgaagtcagcgagaacatgggacttgatggctgttcgtggtacgaagtggacatcaaattggcttagctcgactacccatttcgcaatgcggccgacaacgtctttgtttctcatgacctcaccaagagggaaggaggagacaactgtgaccctatgggcttcgaagtagtggcgtagctttcttgacgtcatgattactacgtagagcagtttttggatctgtgggtatcttgtcttcgcgtcgtggagagcttcgctgacgtaatagactggtctttgcacgttttctcttttgacaacaatgacagtactcacagagtaaggcgtggcggcgatatagaggaataagtcttcattaggttggggagcaacaagtacagggggatttgacaggtagcgcttgagcgcgataaacgcctcttcggcttcctgtgtccatacaaatttgtcttttttttagcagagcgaagaaaggttgtgctcaatcttccatcctagcgacgaacctacttagtgccgccatgcatccggttagcttctatacctccttgagtcttgtgggcgacttcatgttctcgattgccttgatcttctcggggtttgcttctattcctctgccagagacgaggaacccgagcaatttgcccgatggtactccgaacgtgcacttctcaggattgagcatgagacgatatcgtctaaggttgtcgaaggtttcccgtagatcgtcaatcaatgagtcgtctgtcttggtcttgacaacaatgtcatcgacgtaggcctcaacattgttacccagctgatcgctaagtgccccttagaccgtacgctggaaggtatttcatgcggttatcagtccaaacggcattttaatgtagcagaatacaccgaacggcgtgatgaatgctgtcttctcctcatactcttttgccatgctgatttggtgatagccggagtaagcgtcaaggaagcttaacagctcacaaccagctgttgagtccactagttggtctattcgagggagagggaagtgatccttggggcacgccttgttgaggtcggtgaagccgacgcacatcctccacttcccgttggccttccgcaccatgactgggttggctagccactctggatggagtacctctttgatgaaactaactttgagaagcttatcgagctcttctcgtatggcatgtttccgatctggtgcaaatctccgcagtttttgttttactggcttggcgtcgggtcgcaccataagtttgtgctcaatcacctccttggggacccccggcatgtcggacggttgccaagcaaatatgtctgcattgtcacggaggaaggtgatgagcgcaagtttctatttctcgttcagtgatgccccgatcttgactgtcttgtcgaggttggcactagagagtggaacgattttgattgcgctgtcttgtcggcgtcttagttgttttgctcactttcttgggtggctcggctgtggcgggtgggctgggcgtatgctcgaccatgtcgaggctccgcttgtcgcagtggaccgccagctttgcgttcccttgaatagtgattgttcccttcggcccgggcatcttgagtacttgatacgcgtagtgagatgcggccatgaacttcgcgagtgcggttcttccgatgatggcattgtatgctgtgtcaaactcaacaacatcaaatgttatctgctctgtttggaagttgctcatttggccgaaagtcacaggaagcgtgatcttgcccaatggtttggacgaagactggggagtgattccgtggaaaggttgatcggttggtgtcaacttgcttcgtggaatcccctttgcgtccaaggtgctggcgaagagaaggttgatggaactgctgccatcgatgaggactcgcactaccttgatattccgaatagtgggttcgaccacgatcggatatcgtcctaggataacagctaccttggggtggtcctcatctgagaactcgatcttctgtttagaacacttcatcttcggtgcaaccccttgccatgtcgaacaaacctcgcgctccacttttttgtattctcactttgaagagtacgctatggaacctccgaagatgtgcgagacatgaagatcaaaatctgggtacgccgagtccgagtcctgagtggttgcctcagcggccttctcgactacacgtactcgtttgcccttctccaaagccagttgcttttccagcgactttttaaagatgaggcaatcctccagagaatgtctgcccaacttgtgtatggggcaccatattctcttcgtatcattgccttgtaggtctgggtgtttgggagggcgctcgtattcagacgcgaggacttctgcttgagctttccttttcccactcttgccgcttttcttctcgcttgtttcaggttcgtctttggctggcttcttctctcctcccgcctttggcttgtcgttcttgcgtctcagtgcgtcgtccgcatgagcgcatcgatcgacgacctcgaaaaaccttcgagttgttgtgattcgccttgttgccaactcctgggtagtatagcgatctctgacactggttttgaaagcgcgaatcacagaagcgtcggtgatatcggggatcgtatttctgcattcattaaagcgccgaacatagtccctcaaagattcgcccggattctgtgttaatgtgtgtaaatcgtcttcgattgcgtggcgcttgtaagttccttggaagttagcaacgaattgctgccacaaatctgccatgaagaaatcgagtagggtgggaggtgcatcagccacgaacgcgcagaacctttcaactccgttggcaaatagtttgctaacgtgttgtcgtctgccccggcagcgtatagtaccgtggactagacctggaggaattctttagggtcagtactcccattgtacttctctattgctccgggtcacaatctctcatgccatcggacaacacgtagagaattgttgaaagctctacacccggcgctgggggcggtgggttgtcggcgatcgtgtgtcctccgtggatgtctatcggatgacgaggatgaagatgaagactacgatgacgatgggtcacccggctccggtgtccgattccgagggcgatgttcaggttctcgggaattctatcgtcgtccaccattgttgtcctggcgccgatccccattatcatcaccgtcatgtcggcgtcctcgtccagtatcgtccggcgtccgctgttcgcgatcgttgcggtcgcggcggttatgacgattatggtggtgttggtcttcgttcgagcggcctcctcgctcttcgttctcacgacgtcgtgaagagacacgatgtcgggaacgattctcgttgtctcgcgcacgtcgtgcttctcggcggccattcagatggtcgcggagatcgccggtgccgcaaggtggaggagtagctcatctaggtgacgtccgttgctccggtggttcgccatcggcaccgccagctatcggatgttttggttgtgctctagtagtggcctcctcgaacgcgttactaagattggctaccgattcctgtagtcgttctgtccatcgtgcgagatcatcgttaagtacggggtcatagggagcttctctcagtattgcgttgacggtgccaaggtgttgggccggcgtgaccgcctgattctccacctctgcgttagcgtgcgcagacgtgctagtcccacctatggcaaacacgtcgcgtggtgtactggaagatgacgagccatagtcttcgagcaagtgtaggactgatggctcgtgggggtcgatgtcgattactccaacgaatcgatccgaggtcaacgtcgctccttgttctttgtctgtatccttaagagaggttcctgactactagaccttaggatgcgtcgttttcatggcacggagaaagaccttgcagcttgagacttcgtgattcttcgtcttgtgaataggacaatagacatcacgagttggagaagtacgctggattccacgctccttgcaagcatgaatttcagcttgtacgttgagaaaaacccagcaagcttgcaagttgtgcttcctggacttgtggatgggacaccaggactttgttacctcggaagttgtccttgtcagctcatggttcttgtcggaaggacaaggtttggccgcactaggaaccttctcggactcgtatgacgtcgatgttctgttctccgctatggcgggaggatccttcgacacagggtcgtttgaggttatagctacggcgttctcgtttccggtcattgatggaccagccgagattggtaccgtggtgtaaaccgggaaaacaatttcgctgacttgagtccacaccagcattgttgaagtagggactccttgaatggggccggtgttgacgccgttgtcgacaaagcttgatgtcatagtagtagaaccttgagcaccaagttcccgtacctggcgcgccactgtcgacaggggacacccgtagaccggatatagagggtattggggtacgctgctacaaggatctacgtagtacgacatcaaggaaacaggagacaaagattttactggttcaggccccttaataggtaatagccctaatccagtttatatgggattatatggagataaccacaaattacaaagggaataatagaactcgacgataccgacgagatcgtagtcgagttgattcaactagatcacctggcgacttcgctcctgtagactccggctccgtaggctgtggtcattgtgttggctatgagattcgatgccttaggccttctcggggggtcccttttatatcgcaggtcaggtagtccccaagtaggactcggagacatcggacccttcacgatacagtgacgacccagtcctatacgggtagggacatttccattggtggacttcgtgatggattttcgtagtgtatgcagagaacgtccgtacacgcgcagatgtaccatattgccatatagcgtacatccaagggtagagggtataccttatccgtaaccctgacaggaaggatgatatcaaactttaaaatctttaactataagtaagttataaaatatttctcttggaaatatagagacacaaatatagattagcattaaaaagtacttccacaaaataataataataataatagtaacaataataatataatagatgatagtgctcaaagttattatttaaataccgtatccttgtccaaaatgataagtgttattagaaccgaaggaagtagtagatgctactcccttctttctaaattgatcatcatataagtttatacaccaagttcgagaacaatttaaatcacatcaatcaagacaccatgcatacattctcctacaatgcatgcatcgattaaaatctcatgccaattacacctaagtatgcacatattctcccatactgcattaattgtattccgatgaaatccgtgtccatgcagttatataatgatcaatttgagaaattttgaattctattacatgatgatcaatttaggaaggagggagtaatacgttggttagatgaattgacttgcatcaagcagcactagaacggtaaccaccatctcaattgggcacgacgtccatcatagcctagaaatcacaaatataacttcccgcctctcccaggctggaccagtcttttctacacactttgtcttcactcgtgtgcacccaggaagaatttcccgatcggtcacctattctgaaattgcttcaggccaagcacgcttaacattgtagttttttggagatcggttctggagaagaagttgtaacttgttgatatctaacagtggagggacttagaaaaattttcaatcggatctgagaaaccttactcatattatagtcaaacatacatctcaatcaggcataagtatagagcccatcacagatgactcatccgtgacggacattaagtcatctcaatcgagcattagtatagtgcccgtcatagatgagtcatccgtgatgggcgctatactaatgcccccattgagatgacttaatctctatcgggcattaactaaagcccgtcacagatgagtcatcggtgacgggccctatactaatgcccgattgagatgacttaatctctaccaggtattaaatactcatcagtgacagaccctatactaatgctcgattgagatgacttaatctctatcgggcattaaataatgcccgtcactgatgattatttttctattttccatatgaaatgtttatattgggctgcagga

SEQ ID NO: 9186 - DNA, 1109 bp, Oryza sativa
acacaaatgtgtaaattttgtgaacaatgttactaacactttgtcggataaagaaatgacaaaaataaaagatgtagatcttaatgagttatacgacttttttgttgatgacttttttagttaaatcatttagtatttgaaaatggtgtttcaagttgtcatatttacaggttcaaattcaaactgttcaaaaaatgttatatagaaaaatgaccaaaataaaagttatagatcttgatgagttatacaactttgttgttgatgactttttcagttgaaattatttagtatttgaaaagttgtttgaagttgttatatttacaaattcaaattcaatctattcaaacaaatgatatatagaaaaatgaccaaaataaaagttatagatcttgatgagttatacaactttgttattgatgactttttcagattgaaatcatttagtatttggaaatgttgtttgaagttgtcatattttcaaattcaaactattgaaaaaaagttatatagagaaatgaccaaactaaaagttgtaaatcttgataagttatacaactttgttgttgacaattgttccatttgaaatcatttagtatttgaaaatgttgtttgaaattgtcatattttaaaatttaaattcaaactgttaaaaaaaagttatatagaaaaagaccaaactaaaaagttgtaaatcttgataagttatacaactttgttgttgacaatttttccatttgaagtcatttactaccaaaaaaattattttgactcataaaataaattattatactgcagttaactatttcattacatgtcaacttacaaatataaacatttcatatggaaaatgaaaaaatattcatcggtggcgggcattagttaaagcccgatagagattatgtcatctcaatcgagcattagtacaatgcccgtcatgaataagtcttctgtgacgggcctagttattatctcaatcaggcctcaagttggtgtccgtcatggatgatggtcatccgtgacgggctccaacttgaggcccgattgagatatgaaatgttatctcaatcgggcctaaattactgccggtcactgataggtggcatgcgtga

SEQ ID NO: 9187 - DNA, 25300 bp, Oryza sativa
cagtgggattgcaccattgtatcatgtttagttccagtatgtacatgccaagcagcaccaccagcagactgacacagtgataggcgccgaatggtacttctgtgagcgaggtgtacgagaatctttacagacggcgagccattttccactctcgtaagattgcggcattttgctgcatgaatgccggccgttgcattctgcattctcctgctgcccatttggatgacacaggacacgacccgctcgtgcaggggttgccactgacaatgccgagctatggaagccattggcagccaaagccacgtccatatcccgaggtggatgaaagaccaggcatgtcctccgtgaacatctaattcctcatgcctcctaaaccccaacacgcacaaatgaaccgaagctttttagggcactcccaaccctccacctagtgtctatagaatttattaggctgccacataagcaaaaatatgatctgtgttggcggctgtaaaatgtcgattctataccgccaacatctacataaagttcggataataaaacatctaacatagtgataggtgcttaatctcacatattccataagtgttggtatatatttgtatgcagatgataaaccccgatgttgggaggaaaatcagagtatagtgagagaaatgtgtatccatataaggaggggttgtgaacttcatcaaaacatcagtgaattaacccaaaactgcgagaaatggacagagaagagcccagggagtccacagatcgaaggccaggctaggagggcccagcccaggttcagccgaacccctctgatcactgttgatccttgggtttggcttggacgctccagatgctctcccaatgatggttgcgaggcaattcggacatttccccttacaatcgtcatacctgtcctataaatagacctcacttcattcactctcacacacacttccaagcttgagctgaattataagaggctctattgtactatattgtatactagaatagaaagagagtagagtagaagaagtcggaagaattccggagttgtcggtaatcttctcctatttttcttattctgtttataactttgaatttaatataatattcttctcgagtaatttagatttatcttgtgagaattatctcttggttagttcctaaatagcatacgtgattattgttcactataattaactgaaatatagtgattgctttggtgagttataaacactaaagtagatagtaattgcttagacgtggtgtttaggtaattgttatccagtaattgatgtgtatcccgcagtacgtttgaggtgggtgtagaggtggtgatagccctcaagatcacttgtaagtcctccctgtccgggtacatagtagagcgacatctgagaacagcgggttgccagtgcctgaagtattgcgttaggattaaaattaagctttccctagacactgtttctcactaataaatcctctctatcctggcctatcatttgcttggtgtccttggatgaatcggaggaagatctgatcacacacgttcccttggaatcgatacccttggaatactccgtaagggaaagtgctacatcggtatatctgtgcacttgcggattttatctgtgaccgtaagaaataccaaaaatctggcaaagaaattaaagaagggagagaagaaaaaagagagaaaccgtgtctcatgcacgagacggggttgggcgcaagcaccaagactaggaaacgagagaaactagcgttgggggcaactcatcgtttcttccgtccggattttcctcaagctcccgatctgctgcacccgcctccatcccaccgccatgcctaccaccatcccacgctaaatcctcacgattttttggcgtgtccccaatcctcttcgcgccaacaccaactcgtgcttccctctatccatcttgttgcctccttttttccccaatcacttgtcttctccaatctctctcgtgatagctagaatcagccaaaatcatccccaatcactcatccctgagaaagtagttctcccaagccatgtgcaaggatgaatccgacggaatcgaagaagcgtcgatccaaatccaatcaggctgccggtgaaccgaccgcccttgatccagatgccgctagtgttgtgggagccgatggtgctccagatgctactgctgttgcttgtggtgctctacgagctagtgctccaggcgctggctttcctaccgcaggtgctcatgccgccagtccatggtggcaagaatcatctcctgatagctcggaatggtatggtgcaaatttttgggtgcaaagatttaggttgatcaatgttattggtgaattaatgggttatattagactgacaactttttgcttcaaagaattgctaatatattgttgtatagctggtacttttttgcttcaaagaatttttcgctaggcttggtggcaagatgtatagctggtactgctaattacttgtattcacctgattaatcttagtcaagctcatatatgctagtttatggggactgatttttttctgaaatatattgcgcttgtatttcaccacttctgttcttgtcatagatatcataatttttttattgttttctttttcaggatgtatccaccaggtggtttcctgaattatttacagataataagatctctccatttagccagacacatccatttgtgaactatcataatgcaagtaagcttccagaaaatttccactttgttggtgcaccaattagttattctacaatgttctaaagcgataccgtcaccaactaggaggtgtgctgcagcacaaataggttcacaagataaagaaacaattgatattgaggacgatgacaccatttagcctttccgatgctaggtccgagaagcgattgaattggtcaaatgaagaagacattagattggtatgttaatcttctctgtttctttttaaagatttgagtctgtatgcttttaattttatttgcacttcattaaaggtacggtttattcttctcctaattgtaggctagtgcttggctgcacaattcatttaactcgatcgatggaaatgataagaagtcaaatcaatattggttagatgttactgctacatacaacaacaccactaagagtaaccgtatgagaaattgtaatcagttgaagcaacgttgagagcgcattaagaaaccagtctccgaattcaacggtttttatgcaagaatcactaaaatacatcaaagtggtatgagtgaagaccaaaagatggaccaagcattccagctatatgcctctgaacataatgacaagcgtttcacaatggtgcatgtagggaggatattacgacatgagaaaaagtggtctacatatttgaagaaaattaagaaggaaaaggacaagagtgtaactcctaacccaactcatgttgtgaatgtcaaagatgctccaaaacaacgtcctattgggcataagaaggccaaagatgaatgcagtggaaaacgtctgacatcagacgctatttctgttattgaccacaaactagataaattcattgaagcaagcagcaatgctgagaagatgggagaggtacaacaaagtttggcaaataagaagctagaagtagccaaccttaatcataaagcagctcaggaacaaacaaagggtaaaatgattgacctttacaaagacttactgctagctcccacaagtgatcttagtcaagaagctttggctgagagatccaaagcattggagtgtatgagattggctttgtttgctaaagataattgaggtatgtttttaatatattgttggtaaacaaattgtgttgtgacagtaccattcaaatctgaacaagtgacaattttgtcaattgtgtgaactcattttatttttctagtgcttgtttgaacataattaattatgtgaactcattattttatactgcatgttgaacacaattaattttgtgaacccattttctttttatactacaattgaatactatcaattgtgtgaatgcatcctctttttatactgcaactgaccactatatattgtgtgaactcattttatttttctagtgcttgtttgaacacaattagttatgtgaactcattttttatactgcaactgaacaccattaattgtgtgaacctatttgactacccaaacatatttatgtgtgtgtctatatatatatatatatatatatatcctctagctcacacattctccccctcccctgccttccacattctttcttccctctttactcttccatcttctctcatccttaacaccatgtcgaaccaatctgatggtgattcccctgcgcatgatgattctcttgatgaggtgagtaccatagatccaatggatctgtacccattggatcatattaggagcatactgcgtgatcttgctaatcatgtagtagcggaattgaagccgaagttgaagctctacaagatatgagacctactatgcagagtggtccaaggaggtatgttttaggccttatgaagaatcttaagggctattgaaagattactttgtacagaatccagtctataatgatacaaccttttagagaagattcaggatgagaaagcacctcttcttacacattgttgaagccctagggcagtgggataaatatttcacactgagaatggatgctcttaaccgcccagggttatctccacttaagaaatgtacatcggctattcgccaattgggaaatggtagccctgtagatcagcttgatgagtatctaaagattggagatagtactacaatggagtgcttgaagatgtgtgtgaagggtgtgattgatgtattcggtgcagagtatttgcgacgccccacggtgcaagatgttgaacgcttagtgcagattgatgagcgccgtggtttccctggcatgttagggagcattgactgcatgcactgacattgggagaaatgccctgttgcatggtagggaatgtatactcgtggtgatcaaggtgttcctatggtcattctagaagcagtagcttcacatgatcgttggatatggcatgccttctttggtgttgctggatccaacaatgatactaacatgcttaatcaatcaccattgttcatccagcaactgagaggggagggtcctcaagtgtagtgccatgtcaatggaaggctatacaacacaggttactaccttgcaaatggcatatacccataatgggttgtctttgttaagtcaatacatcatccacaatctgaaaagcgcaagttgtttgcaaaacatcaagaagggaaaaggaaggatgttgaatgtgcttttggtattttgcaatctcgctttggtattttgaaacgacctgcacatctatatgatcaaggtgatcttgagaatatcatgctagcttgtattatccttcacaacatggtaatcgaagatgagaaagacatcgagtagcttcctcttgatttgaatgagacatcaagcacatcaactgtattagaagctacaatctcgcatggacctaacctagagatggaagaagtgatacaaagaaatgttattattcatgatcgtactactcataagctacttcaatcagacttgattgagcatatctagcaaaactttaggaattcaaactaattaggtgattgttaatcatttaaagtctaatttacaatttgtgtgttgccaataactagtatgtttcattttaagttgcaatctctgttacattttagcctagcagtaccagtttagctaaatatgttatctcttatttttcttgctctaaagcttctgaattattttgatattgatttgccaactattttcttttttgtagatcaagtcctgctattttggtgctgctgtgctgctggaggaaatgctatggatcaagtttggatgctgtcgaagcgtgtggcagacttgtggttacatatgtttctttggtttgctgttgcagtgcacctagaagaactgctcatgtcatcagagactaatttgagtccaactatttcggctaccagtttgggtcctaccattttggctacctatatgtttttttcctttttattgtactgagatggatgaacttgaaaatttgctacttctttatgctcatatatgcactgatatctgctagttctactcatataatgtgatttgcactaatatatgttcatgttttgatatttggcactacagtattatgtagattgatattcaaatttggatgtatgtattgatgcgtgtcacatggatgtatgtattgatgcgtgtcacagttgatccttcgtttacatgacatgcaaatagttattaaattttcttctcttaagaaactgctatagacactgtgcattggggaggtagtgtctacaaatacatttattattgtttctctcttttagacactacctatagacaccgtgggttgggagtgccatagcatgttcacatttcattgtgattttcagtaattgtgatcggtatcccgggctcccaagttccacccagtacctatactgctcccagattaatcaatgtaccgacactaactgaaacctattaatgtcactgggagcatgctgctgccatttgagtcagtgctcctagacttttcttttcccggaagaaaggccatccaatgatagaaggaaaaaatattataataaagtttttactcccgccttatttactctatggatacttcttcagtaaaggcaacgtactacttgacaattgatgaattgtgaagtaactcagatgagtattactccctccgttccttaatatagggtgcaactgctctggaccctaataccaaggaggcgtaactattttctcgggtgacgacgcatgcaacgtttgctctgcccgtgtgcagcatgcatgcagcccttcgcatctgcctttaaatgcatgcatctgttcgcatcctcccccacgaacgaccagctattttggcgcgcgaaagaccccgcgaacgcatgcacgtaaaaatagcttggagatttggaggcatcatcaatggaatgcatcaatgaaaattttggacgcgccatcaacgaaaatttcgaacgcaccatcaacgaaaatttgaattgagctaatctaatcgccagcttgttctataaatatggtgagagacattcattccacaataagcttgtctcagctttcctcccatgattgaacacaatggcaggtttggatctaaatcaaccttttaattgggatgaagttgaggatttggagggtgaaatacttgatttgaactacgattatgtttgctatttagagaacgaaggtgtgtacggttgctgctagtgttttcttatttttctcttatgtacctagtgtttcgatcttcttctatgatctgtatgtgcttgatgatctagtttgttatatcggtcagatgaagaaggtgggcacgaagacgttgacaacacagccgcccgcggcgacaatgatgatggcggcggcggcggtgacaacgatgatggcagccgtggcggcaacaacgatgatggcagcgacgacggcggtggcagcggcggcggagacggcgacaatgatgatggcggcggcggtggcggtggagcacacgccggcacaggtaatacacttaagtgtttttttttgctcagcttgtttactggatgagcctttgcatgtagctatgcatgcacagtaccatgcaaaccatgagtaatcttgttgttgttgcttgatcgcggtcgatatataccatgagtaaacatgacaaaactatgcaaaccatgcaaatcatgactgtaatatatgcacgtactaagcatcatcaaccatgtctaggtatcaatatcaagaggaggaggcactaccctcctgatgtaaaacgaaccatatatgccaagttattagagaaatcaaatcctggcatgatgaaggagggagtgacaaagtcagttgctaatgaaatgggggtgccgttgagagttgtccaacgcgtatggcgacatagacagattggagatggaattgaagcttttgagtccaagaagaagaagtattgtggcacaaaaaacttccgtttgatcctagtgtcatcaaagatgtgccgcttggacaacgccatagcatccgtgacctggccaacgctttgcatatggcaaaagccacattgtttaggcgtttgaaggaaggattgtttaggcgccatacaaatgccataaagttcaccctgaccgaagataacatgaaggcccgtgtgcatttttgcatacaaatgcttgatagctaaagcataccggacgacccaactttcaaatctctgtataacgtcatatacatagatgagaaatggttttataggacaagggtagaccagagtttttacttgggcaatgacgaagagaatcctaaaagaacagtggtttcattgataaggtaatgtttatagcagcgcaagctcgtccaaggtttgatgagcatggcgtatgtatatttgatggaaaaattgggatttttcccttcacttactggcagccggcccagaggagaagtcgcaatagggagaggggtgaattgtttagtttttcttaattacttgaaatatgactactactcacaaccatattaatctttgttactcgattgaatgtaggaaccttggagttgaaggccatgatatcggtcacgagggacgctatccgaagctacctcattgaaaagatcttgcccgccatcaaagaaaaatggcctatcgaggaacgcggacttcctatctacattcaacaagacaacgcgaagacacacattgctgttgacgatctagaattcttaggtgcggcacaagaagatgggtgggatatatgattagtatgtcaaccgcccaattctcctgatcttaatgttttggatctaggtttttttgcagccctgcagtcgttgtttcataagtcatctccatcaagcatcgaagacattgagacaaatgtgatcaaagcatatgaagaatatccggtggataaatcaaatcgtgtgtttctcacacaacagggttgcgtgagagagattatgcgtgcaaaaggagggcaacattatgccatcccacatctgaagaagggaacattggaaagtaatggtctgctgccaataaggttgcaatgtgataagcaaatctatcttgatgcattggatttcatcaatgcatagcttaggattttactcttgtaactgtgctttgtccaacaactaaaaaaatggagtattcatgtttgatttcattttatcttcaacaaaaagaacttgcatttaaccgaactaaaaaaatagaggatggaacaatatgaaaataaagaactgatcttgaacaaattagaaaatgtgcatactctctcaacatactcagggaacattagttttgccatttccatagagacagatacaataattctagctgtcttccttgtcatcggtctgttcgagtgaatatggaacaatagtgtcgttcgctagtgaatcaataacataccgtacatcgtcggagttgattaaatgatcagcgctggccgcgagaccttcgcccatgatcgtcgattcaaccacgctgtcatcacaggtttcggcatccatcgctgtcctcgcaatcattgacgtggttagctcgctcctcctgcagccgcatgcgaacggcgtggagacaaaccattcgcgcaagagctatatccatttgcccttgctgccgcatgcggacggcggcgtcgcaaagcactcgggtacggctgagctccatttgcgcacgctaccgcattcggatggcgtggacacgaatcgatcgcgcacgaccgaactccatctctgcttgttgccgcatgcgccggcaactcctggccttcgtcttgccgctcgccgggcactccaccatcttctctgccatatccatcgctgctcgccggtgctcgccgatgtgttacaactaatgcaagtgagcttgtaaatggagtccggccagtgagccaagagctttaaagcaaccaaaagaaagaaagaggccgtaagcaacatgcaagaaatgaagagccaactccacgcattgaaaacctttgcatgcatgcgcacggaagtcgaccagagcatacttttgttttaatgctacttgcttgcatgtgcatgggcgccctatattctggtacacttcaaaaaatcagttgcgccctatattatggaacagagggagtatgtaggggatattggactcgaatttcattagttgcacctactaatatatgcatgcttgccaatagtctactaatttgtcatgctgcagtatagtatgtgcaatccgtttttcttgacggatttttttcttgacgaatctttttatttctccacaaagccgaacgtgggaatctggagatggtttggcaaagtgaccatgtcttggcgtcattttttctctcaaataatctagagacttatttgctaagggaaaggcaccacgtggcctaatcaaagcttgctagcaatatcagcattagaatataagataggcacactagttgacgcgctttctactagtggttttataaaccgtgcaatactcattttatgtgatattatctaaacgttttagaattcattctatactgtgaaaccaagttatcaggaaataagatagcattgatacattctgtttcttgaaaggaacatataatatacattttccaacctgtggtatttctatgctaccaaatcaattgccaagtaatgtgtgtcttgattgttaatttcaagtattatatgatccatcatcacctatccggctatcttatgtatctctattgtcaaagtgaacagaataaagttggtcggttaaattctaagctactgaagaaacaactttattatgtaaacatgtcaaacaatcaactgacaaatgtttttccttatttactgattaggacacactgaaattgtcacaaaggcaacataggagatacacttgatatgcggtcataggaggtatatggtctcaacccccaggtcccgtgtttaatatccaacacgctcacaatcccttcaaatcttgtgttttttttacaaaggcagcatgctttgacattcaggtcaggaggacttcaaatgaaattcttaaacactattatgttgtgatattcccctcgtccaattgtaagtgcaaccatgagttttttttgcccaaatttgatcatccatcttattggaattttttttatacttagtatttttgtttttatgagatgataaaacatgaatagcactatatgtgtgacttatgtttttaatttttttcaaataagacagacgatcaaagttgagcacggaaaatcatggctgcacttcaaatgggatggatggagtataaggccctgtttagattccctggcaagttttttcacactcacatcgaatgtttggacacatgcatgaagtattaaatatagacaaaaataaaaactaattacacagattgcgtgtaaaatgcaagacgaatcttttaaacctaattgctccatgatttggcaatgtggtgttacagtaaacatttgctaatgatggattaattaggtttaataaattcgtttcgcagtttacaagcagattctgtaatttgtttagttgttagactacgtttaatacttcaaatgtgtgtccgtatatccgatgtgacacggtaaaaaattttaccgctggatctaaacacaacctaagtgaatttgctgcttcttattagcagagtgggaaatccatatgcatttcagaagaaggttaagcatgtgatgatagagaatcaactgttgaaagcttgcttattatgttcagaaatttcacaaatgcatctccttccctgatgtataaaattactgctatagccaaagggaaaaaaaaagggccttgcactgtcaaaattttcattggggcttacatgcttgtatggctgcttggaccattgggctgcacgccgacactctatggggtcgatgagtctatcgcacctgccagataaatcacgaagcgccatacgagtcgcgagattgaaggagcgaggccacgaaaattatggcacgcgtttacatcctcgaaccgcgccacgccacgaggcagggccgtccgcccggaaccagcgttgaattcgataagagatttgtcacgctgcagtatagataggctaagaaaatttaaaacggaaaacaattttaggttggaaaacaaatttataacaaattaaatttttcattcctagtttcagtaccaccaacttgtaaagaagtcgatcatcttttggacgagtttgaggggactagatggtcactgcgaccaagtcgataactgcttgcactggaccacacaaccacagtcggccggaactcaaacaggaaggtagattgatggccgcttgtggttctaggaaatggagtgtcaactgcagctgggacaagcatccgattgcggcgtctccaccacttcaccaccttcgaaatcgacggagatccatctgaccgaaattggtctcggtctgatcgtgtggatggcgccggtctgactggtatagatcacccggactgactaccgatgtcgcctaccgcgcctgtcgccgccgccggtcggaccgcccgaatgccgccggtctgaccgccggtagatcgccggttagaccgccgaaacccggtaaacacaaatcgaagaactcttaaagtagatgatgactttattgattctctctgtgtttacaaagtgcaccaacagcactcaaccaaagctacattcttcaattcaaaattttcatttactttaaccaaacctgtagcgagaacggcacatgtagaagcatcaccaaagataatcgattcagtcttgcatgccttcttgagggaggagaaccaatttttatcaccggttgtcacgtcccaaaaggactctaaaatacatcctctaaattatgcctagaataattaaaatccgtgtgaaagcctccaacaattaaaatgtgcaaagttaaaagttaaataaggcttggaggatttttgtatatttcctaaaagcctaaaatgcgtaaataaattttagtgcaattttcagagcacaaataataattattaagaaataaacaaagttaaaatgattttataaaaagaaaaactctaaaaagtcccctttccctccctctccctcttgggccggctcagcccatctcactccccctccctctcctctccccgcggcccatccggcctctccccgcgcgcgcgccgctgacgggcgggcccgcccgccaccctcgctgacgggtggggcccacccgtcatccccttcctcccgccgctcccgccgcctcgcccgcgccctagcgccgccgccgccgcgaatcccaccgcctccagccgtccccgcgtgcaataaagaggggaaaatcactccccgtgatcccctctccctttccccccatttttccctctctctctcgcgttcaaacgggtggatttgcccccgcaaatctcgccggcgccattgatggcggccggacctcccgcgcctattccttccccgccggccgctctctcccccttccaaccctatttaaacactccctgcacctcctccgtccgtttccgcctctcgccgcccttccacctcgccggaatcgagctcgcgccgtcgctctctctctccgccattgccgccgagctccggtccgccgccgtcgtcgccccagaccacctcccacctcggcgctgcctccttcggcttcgccgcatcctcgccgacctcgtccacccctccgtttcgctcgtcgaccaccggagcgccgccgtccccgttgacccgagccgcgccgccgccttcctccgctccggctgccttttcgtcgtcgccgtcgacctagggtgagccttggaccaccgcctcgtttccccctttccctcccctctctcggctgccgctccgatgtgcccatggccgccgccggccaccataggggcgcgggcgcgccgcctcccgccggccgcgccgacgtggccgccttcgggcgcaccgagcggctgccgcgtggggcccggccgtcagccgcccgcgccctcgggtgcggctgacgcgtgggacccacggcgccggccggtgtgagcccgagtgcacccggtccaccgtggaccgtgagactgccgcgtgggccccactcccgtggacccggtccacgcgccccctcccctcggctaacgcaataaacccttttaaaattaaaatttaactgaagaaattcgcaaatattcatttaaagagcatataaacttcaaatggccataacttggccatttgaattcggaattggaccgttcaagtctctaatttttccttaagaagtcaagaacccatttttgtgctttgttcctgcttgttatatggagtttattagagtaaaagacttttcttttccgttggtcgtctagacgctgcagcttcggaagatccgctcttcgtggaagttgaagccgacgtttgggaaagcgagcaaggcaagtcacatcatccttgaacatattgaatcccagtttataaaattatgttgattaaaattattgcattatcgctttatttaaattcccgcgttattactgttttatctagccatgcctatttacctttgttatgaccttattattgttattgttattatttccttattcaccctagaataaacaaaaccccaactagtggacactctactcatagtaccactagtatgattttaggtagatgcttcgctggttaattaggcaacattaggtggttttacaactctagactttgggatattcatatcacctggacactatggaatggttggattattgtggaattggattcacacctccccctctattcaaaatcctcaaaatggttttaggctgggctcggggtgcatggttttgatattagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggatatctctaggacaaatgaaggctacacgagctgcggcccggtagtcgagatgtcatggcacagggccggtgtcctgctgctaggggttcagtcctgcctacctgtcccgggggttccggccgtaggtggggttgggtcggtactcttgtctatggctaggatgggttggaaactatgtcacgtcttccgtccgtataccgtggtggtatgtggcacgtgattacacgtgaggaagatgtgtcttgtgggtaaagatgtacacctctgatcagagtataatctattcgaatagccgcgccctcggttatgggcatgccgagcaatgtacccaagttagtgttttaattcttaaaaccagcttaacaactaaaatatggaatggttggcctgggttggcttgggacgagctgggacccagggtcgggttgccagttcggtctgaatcatcgtagaccttgggttaaggcaggttcgtgtgggttcacggccttgattaataatatcgtatagctctggaatcgtgtttacaaaatagctttgagcaactaagtgtctcttaatgctgtttactgcaaaccctaaccctttatattataacccccttgtactcccttgcatttatcctgcacttgtgggtgtgtcttgttgagtacggtggttgtactcagtcttgctcaatttttccgaaacccagaagaggaacccctggaagatgaaggctttggtgtctagctcgtgcttgccgtcaagcgcctatggtcattgccctagtcttccgctgtttcccatttgtctttgtgtgtgctgggccttcgccgcccatataataaattaactatttacgcttccgcttgataaactctgaaatgtatcaacttttggtgtaccttgcctcctgggacaaggaataatacacgcacgtaaggaacgcccgttgggttaattccggtcgtgacaccggtcatgtgccgcgaacaaccggaatccacgatccacacgttctcctttcttgccaccaaagcctacacagaagcagaagttgaagcctcagtactggggttagatgataataaaaatttaggaatccagtactgagacatacgaccagaagatccaataggcatatatccatgtgcaaaatcaattttagaattttcagaaaaattcctccgaggccggtctaaccgaggtacagcagccggtcagaccgggggccggtctgaccgcttctgtaccgccggtctgaccgatgctcagtagcaggtctgaccgcaggacctagtgcggtctgaccggtttcctcgagggaaaaccagatttttgccactttgattttgcaaaagcaatctctctctcctttttctgtttatgtgctaatctaaaacaaaaaccaacaatatgtccatctttgccacaaaaggaacaagtatatttttggcgatgattagacacattcgtagaattagaagacttagcaacacaagcaacaacaggagattttgaagaagatgcattcaaggtagacatgataccagcagatttaaacacagttttgttagtatcaggtttaaccaaaatctcaccacttctagcaccaacacctaacacaacaggaggatgtctagaattatgagcataaggattaaaatctaaaccacggttatgtgtgctaacctttgattgatccaaaatcatgttgaggttctctttaccatcagaaaatcttagcaaagaatttttcaaataagaaacctcttttttccaaattagcacaattttcacaatctaccatgacacttttgcttttatgacatttggggcaagaaagcacttcattgtttttcacaacatcttccatgtactcaacacgacctaaagcatctttcaatttcaacttattcaaattacatgttgagcaatcgaaaacatcatgaggttgttttaactttttagcagaaatcatgttaaacatcaatctagcatgaaaagcaattatatatttttacaacaactttttagttaaaaaaactcatccaaagtgcgtgtgtgcaaagcaaaactacaagcaagagaagatctatttttcaaatcatgtgcagcattaacatctctaatttttgaaatctcattcattaaaacctaacaatttgagcaattatcatcattaggaataagagattttaatctagcaatttcagatttaagagattcagtgataaattcctgttttctatacatcttctcacacttcttattttttgcactcaaaatattaatagcttcctcaaaagcacctacctcattatcttcatactctgtgtcagattcaccacgcgccatgaagcaaacatcggagatgttctttcccttatcatcatctccactttcaccatctacatcacttagtggctcgaaggcggcgcaaacttgttgaaaagccttcctaagattgtccagcttcctcccttgggatgaacccttcggcttgttgttgatgttggtcttctcaccatctttgtcttctcttttgcctctcccaagcttaggataatgcgaacgaagatgatcaattgaaccacattcaaagcaatgatttggaccacctcttttcctgttcctggcattattcatagctcgagcaattctgttagcaaccaaagccaaatcctcctcctcgatttgttcgagttgatcatcggatgtggcattaaaaacagtaagaaaagaagatttagatgaagaagcatcaacatccaaagaggaagaagaagaaaccaaagcactcgacttagaatcaacttttcgagaaagaacattcatctcatgtgttttcaattttgtataaagtgaatccaaagtcaaagtagacatgttaacagactcctaaatagatgtaactttcatcacccaaatagacatatcaagaccattcaaaaagtgacgagaaatctcatattgtggataattagcatcataagaagaatctacagatctaagatcactcgaaattttattaaacctagagagatagtcatccaaagcttctccaggtttcatctcaaatttaatatactcctttttgaaaatatcacgacgaagttctttaatgttatttcttccttgatgaaagttactcaaagcattccaaatttcatgagcagttcgaaagtgcgcaacacgatcataatccgaacgagaaataccactcaaaagaatgttgcgagctttgcaattttgttcaaaagcagtttttcagcagcagtattaatagcttcaggaatcacataaggatgagaaacttttctccaaatatcataatcttcagccataatataagattgcaccctaatacaccaatgagaaaaatcctttccatcaaaaacatgaggcttagttgaaaacttagcaggagtagccatggtaaaaactctagatcgataaaaatccaaagaagaaaacaaggctctgataccacttgtaggatcgaatcacaagaactaagccaaccagaggggggatgaatggttggtatacccaaaaaccgaaaacttttagcggaaataaaagttacccttgaaatcgacggagatcgatctgccggtctgatcgtgtggatgtcgtaagtctgactggtatagatcacccagtttgaccaccgatgtcgcctgccgcgcctgtcgccgccgccggtcggaccgcccgaatgccgccggtctaactgccgcttgccgccggtttgaccgccggtagatcgccggttagaccgccgaaacccgataaacacaaatcgaagaactcttaaagtggatgacgactttattgattctctctgtgtttacaaagtgcaccaacagcactccttacaaaaattttgactaaactcgaaaccctaactcaaaactcaattcaattgctctctaaagcgataccgggaagcctcacgctccccctctatttatactcgaggtagagagcctaaagccacgaaccaaactcatactaggagtcctaaacaccttagaaaaccctctagtacaagaaacaaactttacataaccaatcatatcaaattcggactccttccaaattcgactccgcatcccatacgcacacaatacctccatcgtatgccatatggaatctccatcaaccacgctcatcaactctagcctaagtatcccgcatgatctctgaccaccacggacgtcgtcttatccccaagccgactcccggtccatcaccgcaaatactctcccgaggcatcgagtcacctacacatgaaataaacaaagaaaccatattccgagaccaagctatctccaacttgactcattagtagcaaataacagtattacatacgtatagtatccatctagaagccataatcatgaaataatcacggatatccaaacaaataacccgaaaccgaaaacgacacagtctgaccggcctgaccgcttggtcaccgccggtctgaccggcatacacagcccggtctgaccggtcacataaaataataaaatcctgcgatcacctatgaatccaatcatctccaaaaccacttcgtgaataaattccaaataacaaaaccaataatttccaatgcccaattgttcatcacacaataataatcaaaaacacctttgattttacaatacaaacatctggctggtaggatggctacggcagtcggcagttgccttgcaacccttgaccacgggttgactccccaccaacgcaccttttcatttgatttttgctaaaaaaaaaacaagtgcggcccaaaaaacgagcctaagaactaactaggctgtcctgtcgcccattcattcaatgacttgccttagtctggtccgactgaaggcggtttattgcccagttcatcataaaacctgccggttaaagtggtctgaatcgattcaattgcatgtcctgtctttctattcgaccgaactatgccaacctctattttcggttttctccggttgaactgcctgttcggtccggttttttctactatgggcacaagacgcttcttgttcacgctggatttttttataacattgaaactattcttctccctcttccgttaatggaaaagaaaggttcataacagattacggagtttacaaagaaactactgttaaagcagataaaactagctacacttcatagccggagaaatatgctttcaataggtagagccgtactgaggcctgttttattttccaaatttttttttccaaaaacgtcatattaaatctttggacacatgcatgaagcattaaatatagataaaaacgaaaactaattatacggtaaatagcgagacgaatcttttgagcctaattagtctataattagccataaatgctatagtaacccacatatactaatgacggcttaattaggctagattcatttcatggtttccagacgagttatgaaattagttttttgattcatgtccaaaaacccatttcaatatccgatcaagcattcgatgtgacacttaaaaatattcttttcgtgatctaaacagagcggtcaacatatatcggggcgttcaacaatattatccagaacacgacatgcttgactgccatcatgcatatgtaccactactgcaaccacaactgtaagtctgcaacaagatcacactataacatgggagagagaaaatgaaggccgataaatcggtacataggctaggctgtgttcggatccattcaaacttccaattttttcttctgtcatattaaatatttggacatatgtatgaaacataaaatgtggacaaaaaaaatcaattgcacagtttgcatataaattgtgaaacgaatcttttgagtctaattgtgccatgatttgacaatgtggtgctacagtaaacatttgctaatgacggattaattaggcttaatagattcatctcgcagtttacaagcggaatctgtaatttattttttattagtctatatttaatacttcaaatgtgtgtccatatacatcaagcaaccgaccaccaagcaactatctctccaggatttctcagattgtccattttttttaaaaaaaagtcaaaatttagtcaaattcaattaaaatttgttacaatatcaaatatttcgtgcaaaaaagttccagtaatcccgaggttcacgaaatttcggtgaccactgaaatgacaaaaaaattcagccatttccgaaagtgtaaaccctgtacataattagctaatcctgtgcaactgataatgcgattttccctaattgtatctggtatataattttgtcttttttctgcaaatgcaattgcattttgtatgcaactctatcaattaatatctaatgttataaattcgttctaccaatatcgaatgatgcatttttctcattttcttctattaactttgtaatttatagggacccggagcgaacatgtatctcctttctatcctcttttggtaatatattaagatagattgtgctacaaaaccacctaatacaacaagtagcagttcctttttgctttgagtgagtaattgaaaattaaaaatatagtccaaactaggaaaagagaacacgaaatctaagatagttggagtaaaataattcgcgcaaacagtaagaggaaagaggttgaagagaagtctacaatagctggagggaggagctctccctgttcaattaagatcttatatcaagttagtcattcagtctgaatatatgttcttccgtgaacaagcaagatttgttgcttcaatcccatttctataatcgattagctgcttctatatatgcaattacatattttgcatgtgctctaattaagtgatcgatctgcaaactgagatctctatggtgagtggtgcccatcactacaatcgatcacttaggatagcttcgaggctgccgacggtcgatcgacggtgatgccaataaatcacaaagcttagtgctgaagtacaagagcctatttgatctgacagtgaagggaatcgatctgaagccccagattaattgtacactcacctgcagctcagggaaaatatattgccctctttcctaacctttttcttttttgcctaatctgttttttctccatgccacaacccgtgtactcctactagaagcgcagagttatggaagaaaaaaaatgcgatggccaaacatatcttcatggacacgtcgagtacccgatgccttctaagccctatacgctatagcaccagcaccagcaccagcatatataccagcctctcctatatatatatatagtatatgtggtaactttcagcctgaattgcagattggattaatactagacatatggtttctttacggggctgccggctgcagataggagtattgagtatcgcatcttgttagtttaatttcttcgaaaatatctaccaactgagacggaaagcgcatagacaaattttatctcggtgagataaagatttttttcttgattttctttagcacacttttcaaactattaaacgatacgtttcgtgcgaaaaatatctataaattgttttaaaatattaaatatatccatttgttaagtttgtaataattaaaatttaattaatcatgtgttaaagttttttcgttttacgtacgtcagcttaatctttatctcttcatcagtttcaaacaacactaaaacatagggatctaagccccaactccaaacgtacgaccacagcccacaggacacaggtagcactgaaaagagataaatgaagatggttctgtgaaagaacattagcaacctggaattaactcgtccccgcacttggcccgaacagtttacacttggttttgggtgagagatataactagggatagaaaggtcaattcatataccgtaaatcattggattctttctttatcatttctttaattccatagttttggacccacagagctgccatcctgactaggggcaaacggtgacttattaagggcgaaatcacgtaccctgcattttacctctaagtacaagctaaagcatgtgcgttgtaattatattataaagagtaaatttcataaaactacacgttttatggtccaagttgtagaaaaccacacacactttgacacttagcacttaattacatatatttggtagtgtagttttacaaaaccacactatcaatgaatggattcacccgcgagatgacatggttgtttcacataggacgaggacgtgtgatcctattatcagccatcgcacgaaattaataggatatgccacgtcatcatcctagatgtaacaaccacgtcatcacatgggtaaatccattcatcgatactgtggttttgtgaaactaaactaccaaaatataggtacttaagtgccaagtgtcaaaatgtgtgtggttttcttcaacttgaaccataaatcatgtagttttgtaaaatttactctattataaaaggtaaaagcaaaagtaaaaattacaagtttataaaatagttaattgattagacatataatattatcttcaagggacaattgcttatttgaccctgttttaaagcctaactaccaatatgaccctattttttttagtttgcttatttgaccctacctttttaaaacaaacactccgtttggccctttttccgtagcaccattaagtttttatttaaaaaaaagaatgaaatataattacttttcttaatgaccaaaataccatcgaacaaaccctatccttatctatcctgtctctccccgtttctcgtctatctctctctcggcgagtgccggtggcggctcgtggagggagcggccgtggcagcggccgcagggcgcggagcgggggaatccacacggcgctggctcgtggagggagggagcgacgtcggcggcctaagagcaacttcctcccgctgccctccttgtgcaacggcagccgcgctgcggtcggcggcggctcgatgaggtggaggagtggctgcgacgacagcggcatgggagggatggcagtggctcaacgaagaggaggagcgacggcggcttgatgaggaggagggtcggcagtggctcaacgaggcgaaggagtggcggcggtggctcgacgaggaggaggaggggcgacgccgacagggtggatccggcaaaggctcggcgatgaggcgacggatccggtggcgccgagacgcacatgcgatggatctggctccagcggtcggcgaaggcggcgcggcggtggcggacttcggtggggaggaggcggttctgcggggagggagggaacaccggtggcggcggcgcatggtgaggcaggcgacgatggctcgcggagggtcggagggaggattggtggaagcggctgctccgcatggatgggcttgagagtttgccgtcggcggcgcggtgtcaacatgtttttttcttttctttttttggtacacataaatctgtgccatgtatttctgtttgaggcaatttaatatatactaattagtgcacaaaactgcattgaataaaaaactttaagaaaccaggttaaattcacaagggtataaatgacatatttgtcttgagttaacaccgtcatgttgacttcatggaatagggccaagtctcatcttcattagtaaaaggaaaaagtatgaattaccccctgaactatcgtggtcgtccgaattaccccctgaacctaaaaaccggacattgctcatcctgaactttcaataccggacgaattacccccctcgacccaatccagagcggttttatcctacgtagcgtacgcgtgccaatccagtcagcatttttttttaaaaaattgtgggacccatatgtcatacatacccttcccctcttcctctctcttcactctctctctctcacggggcgcgcatgagcggcagcgcgagcggcggtgggcggcggcacgctgtgaggaaggggcgggcggtgggcgacagcgcgaggcgagcatggcgtcaccggaggcggggtcccgtggctcgcggtctgctcccccctcgccgcagccgctcctccccttcctttccccttcttcctccaggtccagcggtggtgacggcagaggggcgacggcgggagcagcgagcgtgggcagctgcgagggcgtcggactccggtcggccgaacgggatggtgg

SEQ ID NO: 9188 - DNA, 8983 bp, Oryza sativa
  unsure (1)..(8983): unsure at all n locations
ccgctgcatgcagccgtccgccgtccagcgcccacccactcatctcgcgccgccgcctgcctactgcccggcctcgcgcgccgccgtccgcccatccgccgctcccttgtctcgcgccgccgccatccaccgggaggcccctgtggtcgacgcggccgcggcgcgcagccccctggcggctaccgcctcgcctcacctcgctgctgcccacgctcgctgccttcgccgtcgccgtctgaactctgaaggacaagagagagagagagtgagtgagggatagaagagatagaagagagatacaaaaaccgacaggtggggccacctattttttaataaataagttgctgactggactgccacgtgtacgtcacgtagaccaaaaccaccgcggattgggtcgaggggggtaattcgtccggtttgcatagttggaggtgaagaatgtccggttttgtggttcgggggtaattcggatgaccgcgatagttcgggggtaattcgtacttttttccttgtaaaaaagagggtcaaatgggtcaaactcaaaaaagaagggccaaattagtagctagtcctcaaaatagcgtcaaaaatgcaattgccctgaaaaaactaatagacaaaaagaaataaatataatatggttgtaagtagttttttttatcttgatggttgtaattagttgggatgagggaatatgtgaattagctatttatatatttttaggacacattttaaatgttaaaggcagcaatatattgagatggaaggagtaataaaattgacacaatgatagatggcactctgctattgtgtgctcccataccaccgaaagtaatataatatttataaactcgcttatacattatagctggtatatctataaaagtaaattggaaacatatgaaaattacacataaacgtatacatatatatttaaacctgacgtccagtgatcaatatatacaatatacgacttctcatatgtacgtgctccatccagggaaataaactctcttgttaatcttgcagcaaatcacattattaatgataatcacagggattaataactccattatgaattcaaggttgaggtcacttttattctttttcctttatttatcaaccgattaattaatcaaacataatattaaaaagagtagagataaaagttgtgcgagcctcctgattagtccaatatatgtctcatatatgatctaatggtgtagttttatttatcagttttatcaaacgttactcgtattttagaagatgtggctcattctctttgagataactttggtgctttcacatattaagatgccaccagctcaatatattgagaaagcgtactgtacaaatgccaaagttaaattatcatcaaccttccccctaattaatctgcaagtactaagattatgtcgctgcgatttactactccacaagcacaagtccacggaacttgccgatcgtgagtttgtcaaaagaaaaaaaaaagggtaaagtttcagagtagtttaatgattgaaataatcaattctcagctgatccgtggaatggaaggaccgaagtgtcagtgatatgccctgcaggcaatcatagagatgattgtatcacatactatgtttatatatttatccgactttatttcttgaaatagataactcattattggttaataaatatgtgattctttcatgagactctttatgttgtgtgttgctatttctaaaggattcctgatcaaatatcatatgtggaacaaatatatttagatgatcagcacatatgttaattaatgatcatgtctcatggatcatggtatagagataacaaattaataatgtggacacatgttggtgaacatgttgttggatagatccaacatgagacactgcaagagccatatgtgttgtgtcatcagtgatctcatttagtgttggtgttgaatccttagattatcatggttcctagctaacatgtgtagtagcttacttagggattgctaaacgctactctgtaattgggtagttataaaactagttttcgggtatgctatgaaatatgtagtggaatatgaataatcaagatgggatttgccccttctatggagaaatatctctgggcccttcgatgttgtagattatggaaatgcatggccatgccaaaggtgattgaggagtcaatcacgagttatataatctatcaacaggttcgagtgaatgattgagctattagaggatggcacatatctagccttgagcttaatcgatatcgtgaggcaaaggggttcatataagtatacactagaggttcagtcgatatgatctttttgtatgcccggtggctcaatatgttctgctaggggccgctgttgatgcgtggaccgaaaaagagttttcgggttatagccgagtgtacatgaacctatagggtcgcacgcttaatgggccggaataaggggattggatggagatctaatatgagcttaattcggataggaatccaaatatgagtcctacgggccttggaggtccgagtaatggatcttatatattcgtgaggagtgtgaccggcggagatattgcatcacgtgagaaaccctagccgccactcccttcccgagcagaaccctagccgcacgagggtgcagcacatctgcgcgtggcgttccatccctgtacgtgtggataccgatagaggcgctgctggtttacggtgctgatcggcgtgggagtacggcgagcacgaggaggagaaggtcgagccggtgtgatcgactacttcctctacatcgacgcccgctacttcgcgagagttccttcaacttctcagcgtcttccgctgtgcagcttgtcgagtggtaacgatctatgatctaatacttgtatggttcctgatttacacgatataaaattttgattaagctatcgtaacctacgggtatcccaacagtacccctggctcacctctgttctactgcacagcggcatcactgatccattgatcaatcattcacacatagatagcatatcgattggttacaccacaagtaattgtaaaattagaagatgagtgtagctcgacagcgaaagatagcgagcaacctcatcttttcgctaatgtttatgtttattagctaaaattttatttttaaccttaaaaacattgcgtactgaggctaaccgagttattttcatcgaagtttattttttagcttttatttttacatcgttaagaacatgtattttacaaattattttcgattgcaaatataccgttggtttatttctcaaaaaagtaaaacaatgcggacgaggccgactgagtcattgaccgtttgctccgcacgcgcggtgctgaaatatggtcatgacgtgcaagaaacgaacttgcctgcagctagtccagccggccgacagcagtagtagcatatcagcctcatcgattacccatatttcctaataagctattttaatttattataaaataaaaattaatttataagtaaagtttttatatatgtgttcctgacgagttaaaaataaatgctaaaagaactacattatatcagtttcaaaattatgtttgaaattttaaattttgattttggctttagcctattatgacaatcgatgaggctctatgtaaccctccttccttctgcatttgctttacttggtcacagactctgagctggaagcaggttacaatcaagcacaggtcttggggaatcaggaaatactctcctatgcatcaccgtataactagttcccaaggtctcctaagccctatatgctaaagcacacaccacgcatcaacatgtcaacatatgcacatgtgttagctagtgttgcgttcttttctgaaaaatgataacgttatgctggatatttgctcttttttttatgcagctgagatatatatagcggcatccaactttgtactatctcttttttttttgtaaaaatcaaataaccaaggaaatttgacattgatttaggtgagatatattcaacaactggcagtgtcgaaacatgaattcggcaataataaaaggggtagcgcacgagacctaaaagtggatggatgcggagacaaaggatttagataggttcaggccctctcaatgagagataataccctactcctatttggagatttgaatccgccgggtgtagtatagatctgacgatcatatgtgctcatgcaccctagagggcctcctgcccatcttatataggatgggcggcaggattacaagatagaaaccttaaccaatacggtatcggtttcctaaatctattttacaatattatcaaatcaagactttaggccgttccataatatacagggaaacgtaatacccaagtcatgatccgttacatattctatagatataagttatcccatataaccagtcggataaccatgtcgtgtgggcatgtggtacccataatctccatagtagcccctgagaccttcacagtcaaaaaacaatcttctctcgaaccagattactccaaagccaaatgcttcaattatctttgccatggtctctcgagtacttttaccaaatatgaagactgtggagggctgaaaaataaagtcaggtgcatcgattagacgcacctaataggtgtagcccccgactatgtggttagctaaataaactaagcatatagtcaaggaataaataattcaaccaaccgagtggctttgataattgtaatcaaccaagtgaattgatatcaatatatagcatatgcggtgtgaatctccgaataatatgatccgagtaatataccgactgctttgtaaaatatgatgtgtgcaacctaaagttggctacatcattgaaaattcacatagcaaaatagccataaagaagcttgtatgctgtgaataaagaattttctaaagtattgggcatacgccatgcgcacactgctttaacagatgtgcttaagtccctaaaagacacatggtttcaccacacctaaaaatatatggcatatgtggtgtaacatccgagtaaataaactcataaatgatttaccaaccacctagaaaattaccacaatatataatcagcctaagccataatattggtcaataaaagtgcacacttacgtgccaaaaagcaatgatatcgtatccaatcaattgctttattaacccaaacagcgccttgactatatataaaaaagtcagcggggcagctatgaaaaacttcaccgttgggtaccttttaagatgcattgtaccaactcttaaaaagttgagcaactgcggtataaaaggattttaaggtattgggcacttgatcacgtgcactttggcctaagcaaaaagtgcctaagtccctaaaataacgtgacaggccacacctgaaaatatgggctgcagacatattaggcctaggccaaaaaatatgccttcgacaccctttaaaggatgacgcatataacatgctcctaagtaataaatcttctgggtgatatataccaagtgtagctcatgtgaatagcttctgatctgagtgattatccctcatgggatactccaaaatagatataaaaattaaatcccgactggcacaagtattcggttgatagcccttacggggaataatgaataatccagtcattgagaataagaaatcgactcatgaccataaattcaagttgaatgtatctggaacaagtccaaattgaagatataattctcgcgcttgagttgatgagcccctatgcatgtagcttatccttctgtcgtagtcataattgtccattgataatagccattagcaacggcgaagacgtcagggccgatgaagtatatataggtaacggcgagcatgtgcataacgaagatgatgcaatgccccttgatttataaaaatgacagtagaacttgatgttatagctgttgtagaagcttcacttagaggaatgtagatgttgttgtccaactcgtcgaaactgagctgattgattgataactctaaactcccggacatgtatattaaatctcaaacttgacacttgagcaatttgaagcagattgtggcggcatccagaagtcaaaattgccagtgaaataataagagttgctgaagtagaacgtctgctctgaagtaaagacgaagataatgactcctaaagttgactccttgattgattgattgctttatcttgacataaaacttgtcggattttgagtcttgtatttgtgtagcctccgactctttggttagttgggaaacaactgaacatagagtcgagaactgtagcttgtcgtcgagtactcattgcttaagtgaggttacatgttgaagatgtccgagtataagtcttgaaaattatagaactacttgtagtagtagattagcacgacgtcaaatttcgtgacgcatgccaatatgtcgaggctcatgtagacgtcgtagttggtgaagtagcacaacttgcgaagtagcagcaatagagattgccggtgcagaagaccatgaagatgaagttgctccaccatggtgacaaagttgcatagcagtaatgaagttgcacatgagtcagcggcaacagaagcaaaccggtagtgaagatgcgcagttgtgaagataaaagcaccagtcggcggtggcataaccagtcggcgacggaagacgatgatgtccatcagtagtggtagcggtataaaccatatgtagaggtgagggcactagtcaacagcagacgagatgaccggcagtgaagaagataaggccaattaacactggcagaatcatgcagccatggaaatgaataaactagtcggcagcagacgtagacagcttgcgttgaagatgatgacgcctattagcggtggcggcgacgtagccagccgtgaagaagatagcatcagttggcgtcataacaggccagccgtgcaggcggaaacaccagtcggcggtggacgaggcggccggtcggtgaagacgtagacatccaacaacggcggcataataggcaagccgtgcaggcggaaacaccagtcggcggcggacgaggcggccggtcggtgaagacgtagacgcccaacaacggcggcataataggccagccgtgtaggcggaaacaccagtcggcggcggatgaggcggccggtcggtgaagacgtagacgcccaacaacggtggtgtgaccaaccaaccgtataggcgaagacaccagtcggcggcgacgacggcaagctggtggtgatgttctgactgattcattcctggagcgtaagagataagcttaaagccatgaatcccttttgtgcatatctggatctggatcttgcagaacaaacatataggatgagtagtatctgatgtaaaaacagtcctcgatgaaaattcaagtactttaaaatatttataaatatgtatttcttctcttgtcaattttgatttccacgagcaaatgactcattacgtttaaacactctgcccgactagtcatagccaccaggcaccgggagtcagcctaagtacttcccaaacatgcatatgagtgacatgagttcgtcattaatggaacaaagtttcacggatcagaatttactactcgggtacttttgcaattattaagagcagaaaataaatttatctcatctctatgcttctgatttaattattccgagtaatactaagcaccttgcgttattcggtccatccaacgagcccccgggtgctaggaatcggcccaaaggcaactatccattggcaaaccaaacggaaagcataggaagatggaactccataactcgataggcacttttgtactcagattatgtcgcaagcaatcaagataaatattatgaaaattgttaaaaaatatgatataacatatgtagcccccgactcactagtcaacggcgaaccaattgatgtagtgaggtagaggaaaagaaaaatatcatataaagaaaaataatgatgacttagctttgtaatattccccttggtgatggcagaggtggccaatgtgggaacaaagtcgtccatcaataacaatgaagacaccaatcggcggcgacgaaggcggtcgacggtgaaagcgatgcccaccaacggcggcataataggccagccgtgtaggcggagaaaccagtcggcagcagcgacggaagcgagacggtcggtgaagatgatgtcgctatcagtagcaacgtagtaggccggccgtgaggacgaacaaaccagtcagcgatgaagtccatgtccatgaagatcgtgtcagtgatatcggaaacaacgtgcctgttatatggctgtcgcatagtcggacatgtaaatacaaatcatatctgattaggagataaaagaatgtgcaagcatgcatctgtatttgctccagtagattaattgactcatatgcactgatcgatgcttattggacgatcggtctcaagcctgcgattgttggtagcagcctgtagattaaggaatcttgattggttggcttgtagcaggcagccatgcaatacatggtgatgatgagtagatgcatgtaataagagagctgctccgaagcccctgattatgtcgctgtgagatcgaggaaagatgctgaccggactgtttggctatcgaagcagtcggccgggccatgatgcgcgtgcgtagccaaccgcacaccacatatgtcgcaagatcaggactgcaaactttgtagcatgccgtgtatcgtccaaggcatgcggcccatgctattgacgatcctgttgacagtagtatccggttattctcctgacgataaagtttctctctctgaagcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9189 - DNA, 730 bp, Oryza sativa
atactatatatcaagcagatcgtgatagtctgcaacctagctcggtggtgcacaatgctgagactaggaattcggaagaccatagacacattgtttcgggagatcacgatgattctataggggttgatgaaattgccatcaactactctgaaactagagaatcttttgatagaagagctacaattgtcgacattaatttttctgaacaaattgctgattgcctccaagttgatccagaacctaggtctataaaagagttccaaaagcgctctgactggaacaaatggaaggacgcaattgacgcataattcgcctcgctttacaaaagagatgtattctcggctgtaatgcctactcctcgtagtatctttcctgtgggatacaaatgggttttcgtccagaaacggaatgaaaacaacgaggtggtgagatataaagcaaggcttgtagcacaaggttttacgcaaaaacctggcgttgatttcaacgaaacttactctccagttatgagtggtataactttcagatatttaatatcattggcaatacaaaatcgtctatttatgcagttgatggacgtagtgacagcatatctttatgggtcacttgattctaatatttacatgaaggttcctgacggaatcgacatcccgaatcagaaggtaaatcgtaacatgtattgtgttaagttgcagaagtcattttatggcttaaaacaatccggcatgat

SEQ ID NO: 9190 - DNA, 417 bp, Oryza sativa
ccaaagattacacatgagctctgattgatagtgagctgagacaccacagcactaatcactaaccatcccaacagaatgcccactaagtccaatctgtcttccttttatccccagcatcctttgagtaattgtcaaggccgtttcagacaaccgggtacaaggtagcagtagcagttagtacatatatatattgcccattcctcttgcccacccatccatcaggaccatcactaccaccacttcaccaccaaacccaaccaagaacaagttttcaggggcaaattaagaagagcttggtgacgatatgagcacggcgaggttcatcaagtgcgtcaccgtcggcgacggcgccgtcggcaagacatgcatgctcatctcctacaccagcaacactttccccacggtgagctgagctcc

SEQ ID NO: 9191 - DNA, 1733 bp, Oryza sativa
  unsure (1)..(1733): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccatcttatggagcaaagatcagctacatggtatttctttgttgatttgaattatgttgtagtgttatgatttttctgtttgtctcaccaatttcatttcattttgtttgtagccgtcattttgttatccctttgtggaaaggaactggatatactaccatgttcatgcaaggttattactcagtcttttccatatagtggtaattatcttttgttgtttcactaatctttgtgttcaatatagcgtttctcatatctcaggctgtgttcttccccctcctttcccaactcacccctctcgttttccgagcacgcttttcaaactactaaacggtgcgtgttttgcaaaaaaattctatacgaaagttgctttaaaaaatcatatttatccatttttcaaaaaaaagagctaatacttaattaatcatacgctaatgagtcgctccgttttacgtgttggagggattagttcccaactgtgggaaatgaacacaacctcagtcccttacgtagaacatgccttttgaattgcaagataatatcaaatcttgtttacgtcttattctggaagtatctaactgtatatcaaatgttttgttgattactgttaaatgaaacaagtgaagtttcccccttttttgtggaaaattttgatcaaggacggaacctaaatctcgtttaactcttattctggaagtatctaactttatgtcagatgttttgttgattaccactaaatgaaataagtgaagtttccttattctttggaatattttgatcatgtgccttacaaattgaacaattatatgaacccacgtcctgatccattttctgtttgtagaagtaaagtaattggttatttttgatatggttcatgtttgtgtctaatatcctatccacatgcaagttagtgtagaaactaaggtgctgtaaccaatttcagcatttgatctttatgtttagtatcctgcacctcatttttcatggtgactggtagtagtatttgtttgttttcctgttactctgcaatggaaaaccatatatagtaggtttgagtacagtatttcacctcttctgtatatctggtttaattgattaagttcactagaattttgaattttcagcacgttttctaatatttaggccttttgttctaccctttcttattgaacatcccagttcagatgccgcatatgatcttcaccggacttgaagactacaaagcaaggggcactcaagcaagcccttactatacgatcactcattatacagagtttgcagaaaccaaggatacagtgcttatccgaggagacgttgttttcaccagtaaactgactgattcagaggcgaaatgtcttttagagagtgctcactcattctacctgaatgatgtgaggtacaggcttgtagagcgcttcaacaaagaaccacatgagtttgagttcaaagatgtcctgcaagtgcttgaaatgccaaccatgtgacaagattgaagacctgcaatagcaaagcttcctggagcatgtcagtgcatttttacagtggcagggtctagattgcact

SEQ ID NO: 9192 - DNA, 614 bp, Oryza sativa
tcttcctcaatctctactgaagctacagatgccagtgcaaactgaccaacataatcttcaaaatagtcgctcccaaaaagcattccaaagacagcagttggatcaatcatgttatccctaaaaaagccattttaaaagttcaatagctttatgttgataataactaatacaatgtacatgcagcatgcagctaaaacttcaaatcgcttgtgcaattgaattttgttttacaatttggccgatccaattctatagaaacaaagaatttggagcttaatttctatctaggttgatagaatagtgacagaaatattcaagacttactgtggaaggccttcttttccatgcttgtcataagaatcctttcttacaggatcactgagtatttgataggcctcacccagttccttgcagaagtaaccaattttagttagtaatcctcctataaaggtagtgggtgaattaataagggctactgatagggatgcaagcgggccgacccatgaacccgcttataggcaaaattagtgagcagtggcggagccaggataaaatatagtgggggctccttagtcttttgagccttataacaatctcagacaaagtttatttta

SEQ ID NO: 9193 - DNA, 602 bp, Oryza sativa
cccatccacatcggcagaatcgtttcacgtcacgtccacccgtgcacgcatctcgctaggctagcattacatatagccagcagcgcatggtcaccaccatgatcaactctcgagaaaaatcgagcagctagttagttcctcacttctagggattcgctttggctacgtacattggtgtacgatggcgtcgtctcgctccgtcgtgctccgggtgctggtcgcggtggccgtcgtggcagcagccggggcgccgcgcctcgccgtcgcggactcgccgccgcttcaggacatctgcgtggccgacctgcgggcggcgacagcggtcgacgggttcccgtgcaagccgacggcgtccgtggtgagcgacgacttcttctgcgacgccatcgtccaggcgcccagcacgagcaacccgttcggcgtcaactccacgcgcgccacggtgtccgcgttccccggcctgaacacgctgggcctctccatcacgcgcaccgacctcgcgcccggcggcctcaacccgccgcactcgcacccgcgcgcctcggagctcgggctcgtgctcagcgggaaggtcatggtggggttcaccacggcggccaacc

SEQ ID NO: 9194 - DNA, 318 bp, Oryza sativa
accggagtgcagcatcgagggcggtgcttgggcaaaacacgatgcgacggctcctgtctcccaagcacaacattggctgcgtgtaggacaaaaacggatggctcgggccttggtgacattgtcggccttgacgcctcggcagtcacaccaacgacgaccatatcctcctcctcccttgcccttccctttcccctaccagcggcaatagctgcacaagcacgagccatacaccccccgccccccgcccccgggtgtccagcgttggagatcaggcgaaggtagaggccaaacacgtgtggtgcaaggcgcaatgggagt

SEQ ID NO: 9195 - DNA, 692 bp, Oryza sativa
tttttaaagtgatttcttatacgatttcttatgtatttccaaaagcgaaccgaacttaaaaaccgaaaccggatttgtattttcaaaagcgacggacttaaaaccgatttttttaaaccccccaaccccggggggggaaaaattttggggaaaaccccccgggttaacttaaaataccagtaaaatcatcttcaatttttatatcgactcttataaataagaaatgccgatgaaaataagaacagaacttgaagactgagcttcgaatctatgcttcctgatgagtctcgccacatcaaaaacctgcattcagtcagtcttaatacgcagcccaaacttctgcagtccttatttgtgtgcattcgagttttcgatgatattcgaagaggagaaccattagccctgcagctctagtctcatcgcccctacgactcccctgaaccctcgactccttcccactagctcgccgctgcctgagcacaccgctggagttccacgtgggtgcaaggatggcggcggcggggttcctttcagctctcggcaggcctctatggccgcttcttgcgggcgggcaggagcggcgctaggcttcgggcgtggcgtcggcaggtcggctgctccggtgaggacggcgtccggttgaagcggaactcgcgactcactctcctagtggcagagtggcggcaacgctg

SEQ ID NO: 9196 - DNA, 867 bp, Oryza sativa
caattaactgcccctacccaggtattaaaagaaagagttcttctcaattctccatcccccctttttccaaatttttccccccccccccccaaaccccccccaaaaaaaaaattttcatgtctcccaaacaaacaaaactcttaatagtctcatccctctaaatttccaatccctcctaaaaactttctccaaccaaacggaccgtagggggttaggcgtggatgatgatgcgtggttgtgtttaggaattttgtttgggagaaagagggaagattcatcttgatgtgactggcagttacagtcccttagtggtaaagcaattgctaattggatttttctgagaggttacgtgaaacttactcgatcggtatatgtttactaggcgtgctgccttaagcggtgccatttgcttaattagctagctcttgtggctggctgtatgcctgtatatgttttcttgtactgtcgatctgtaaatggttgagaaatcacaccttgttctgcgtagatgcgcaccttctgcattacttcagctggtcttgatctgagaatttgttttcatttttgtcgatatcatttcgggaataatagcatgcttggcacttagattttgtcgcttgatgaggtgaatgatgatcggcgtagatggttctgtccctttgccggccgtgccagttactgcgtcgcaaaaagttgcactcatgctgtccaaggcataaggatcactgacctaccctttcccggtgaacacgcactcatttccctctcaaaacttggcgaactagcaaatcaaaagacaatagcacggctggtactaccagtacagtagtactgtccacaacagtgatcgaacgaccgatcgattcg

SEQ ID NO: 9197 - DNA, 478 bp, Oryza sativa
ctgtagatttcttcctaggagaggtctggcattcttttcatgcaaaatctattgcaccatctgccaaatgaacatgaatttaccgatgttatgcttcttacataaatgtttggtcgttatgatgcaggcccttgattccttcaaggctgaaagtgagtctgagcttaacttgtcagctggagacattgttattgtccggaaggtaatatacctctgctgtccatgttttgtaatcttcaattgagttgccgatattgttccgatgtttctaaatacaagttcctggcagctaacatatcataattgagctgtcagtaatctaatgtggtcttgtccgaacacagatatcaaccaatggttgggcagaaggcgaatgcaagggaaaagcaggatggttcccacatggttatatcgaaagacgagagcgagttctagctagcaaggttccacatattttctaggagttcgaggataaatg

SEQ ID NO: 9198 - DNA, 5186 bp, Oryza sativa
  unsure (1)..(5186): unsure at all n locations
nnnnnnnnnnnnnnnnnnnnnnnnnnnnnnnnnnnnnnnnnnccaagcaagctcaagctcaacatatttgaaatctgagcttggctgaaagcttgttaatgagataatatctgtatccaatagaaaaaaaatccatgataaaaaggaggaaaaccacaatttaaattttaaaattagcaaacaagaaaaatgctatgaaagatattttacactcctacatactattttattatgcagataaatactagttttgtacctaatcttatagtttatttgcatcacacaaccaagctcatgaacttttgcatatatatgctcatcctagctcatttggagccttagccacgcccacatgagctaagctcgaggacatcacgactcacgagccttaaactattatacatgtaacaagcaaaccgacgactaatctagatatatcataagaatccagctgtcccaacttatatataaaaataagccgaccaagagtaaacataatgtttccataaacctcacgccagccacgacctcaaacatattattatctgttcttcaaagataaaactttttaaacataaggcgcgccaaaaccgcgagcatattattatctgctgtacagggagcagacgactttcatcaagaaagggccaccacacaccacggtgagctttggcgttggctttggcgttggcgtggtagttggtacgtggaggcgtggagcagttcacctaaagcatcccggattacgtgctccgagatggaaacatggccgaaatattcgtcgcgatgggaataaactacccggtgggcgcgtggccgccatgcgacaacgcgatctgtccgggggatcgcgacgaatccgacgtgcaagttggggggcttaaattagcaagaggcgtgtggccgccacgagagatagagaaaaagagggatccggtggaagaggccggcacgatgccgttggcacatgcgactttcgcgccgcgcgcgcgaggtcgtctctcgttcgtaccccagttggtacaaaaaccgcggtggcgcgtggcggccacaagaatccagaaaaagaagttgggagaggttgggaagaaccgacgagaggagggagacgaatcagacgatcccgtgggaagcgtagccttcatgggctcatggctcgcaaaaccagcggcctctctcttttggctttcaggactccaaaagaaaatgaaatctttcgtcgagagatccattccagttgaatttcagactttcagttaggctttttggttttcttctttgagaaatgctctccagttcaatttgctaagatctgaatattgcgtacggttgtagcggaacttttattggtagtggagtagtattataccattttaatttgtagtgaaagcaaccgtgtttatctttcttttgtcaacgttccagctgtatcgtcctttttcttatattattctaccttccatttgtgcaaccgggtcactggattgataattttctatgctataagatcgagaaatcaggtgcagaatatctcgaggctaacagatcatcagatctgtgatcaccagatattttcgttggatcggtcgagtgcttgtttttttacacctcaaaagtaattttctgtagtgtaagtttcgcaagtctgtaactttaattctatataaagaaatctgaactttagtgtggaagaagaaggcctatattccttatgaagatgggctttcgtggcataaataggcccaagatgaactgggccttttactggactctctgagggggcatatgacaatctgtgcactgttcttgttttctgtgttctaaactgttcttttccattggtacaagttcctttgaccattggcaatcccggctgcaccttcaacgcattctttggcatttgctggccaatcaaccaaaaacaattcaacgtgccagtggcacacctggatattcgcaaccaagagcatcagctagtttctgaactgtcacagagacacagacaaatcaaaaacaaacgggaggcaaagtgagaagggaatcggtatacaataattaacaccaatattctcatttgagaccatttgcctggtcttgcctcatcacaaattcacaacaaccattacacttacaccccctgattattcccagttcggtatccagggattcgctagttaataatcagccactaggtacagtactactggcaaaccaagagtagttaattaaacagctagctagcacaaccccttgattattttctttttcatctccagatagatcgatttctgcgtcacacgcatcatcacgccgacgacgagatgttcatgccgtgaaagatcgtcgcgaacagccggagcacggcgtaggtgatgagcatggcgagccagccgccgaggaggaccctagtgccggacctcaccatgttggcgccgccgaggtacccgcccgcggcgccgaagccggccagcccgacgctgctcgcggcgcacacgacgccgaccctggggccccacggcttgatgaacccgctcgtcagcaacggcaggaggccgccgatcgcgaacgccagcgccgacgcgaacgcggcctgcgtcgggctcggcagtttctccctcgcggccgcggcatcggcgccgtcgatgtcgccgtcgcgctcgatctgcgtcacctcgatgtcgtactgcgcgtacacggacacgaactcgccgatggccatgctgcacgcgccggccacgagcccggccagcccggacacgagcatggccttgttgttttcgttcacggcgccgatgccgatcatgagggacgccacggagacgagcccgtcgttggcgccgaggaccgcggcgcggagccactgcgcgcgggccatgtagttcacctcctcgccaccgtccccttcgccaccgccgccgccgccgccgactcctctcgggacgacgtcggcctcggccgccttcaacgacgtgtagtgaggagccgcctcgacgtcgacgacgacgacggcggcggctagatcctcctccttgggcaacctgcacgtgcagttaggagtggcggctccggcatggacgtgggagctgtggtgaggatccatggatacgaagcacaagcaagctaccggaggctgggcgaatcagctgatcgagacgggaggagaagatcgatcgagaggagtgtagcgtgtgcggagaagatggatggggatcgcagtgtggcggccacacgcctcggccaccggcatttataggggtgactcgggtgaggccgctagggttggcgaaatggagggcccagatcgctcggcgtgtgccggccacgcgcccctcgctgacttgtggatcggatgccgacgtggaccgggaccactttgagatagacccggacgacgatgtgacagtgacaatgcgtttctcgccgtccgtctcgtttgatcccctaaccatcgtctcgtcgtgtacaaagcatatgtgcctcacggctggctgcaactccgtattatgtcatcacacaatactcacatggttcgatagatggggtggatcgtgctggaccgtcagggtgtttgagggtgggtgagatgagatggtccccaaaagaaaatattccttacaaacacaccttaagtagtggtgaactaatccaatccgtccccctctctctctcactaacatgtgggttaggctgcatctctacattatgttatcacgcgatacatacttggttcgatggatgggatgggtcgtgttggattgcaagggtattttgtttgaggatgggtgggatgagatggtccccaaaagaaaatattccctacgaacacacctcaagaagtggtggactaatccaacccacccttctttctcactaacatgtgggcctggttgtatctctatattatgttatcatgcgatacacacctagttcgatggatttgatggatcatgctggaccgtcagggtgtttgtaggtgttttgtttgagcatgggtgggatgagatggtccccaaaagaaaatattccatatgatcacacctaagtggtggactaatccaatccacccctctctctcactaacatgtgggccgcacccggtcgatcccttaataacgtaggatcaccccacataccatccgattcctaaaaaatgcaggaccactacacgctcataccaaatagatgatatgattattccattcaaaaagagggatagtctaagtcattctatctcatctccaaactacacaatgatcaccccattatatgtatatatcaatatgtgctgtgtattattaagttgttagtagtacgaatgaagtactgtaaaatattgaaagaaaaataaacaaatgtttgttgacgtttaaaataacagtttacaaatgcacaaaccgaacatgcacatgcatgctgatgatgatgcataacgaaagatccgatcacagaacaccgatctgtgcgtgatacacgcgtggtttacactccaccccggttatatgttagattaattacgtagtagcattcatttcgatctaaagatagtgcggattcacgattaaggaagaatgaattgaacaaagcaagcaccacacgcacagctagcacacacggtggctctgagcttttgggcattgcaagcgccgggaacaagggacaagcatagcaaatattactccttactagcatattactccttagtccttacttagcatgcaagatcggcttgcattggggctctagctagcaagctatagccaactctgggtgggaggcagaaaaaaagaaaattttaagattcgatcttgacgcattctttttattaatctgaagaatgtgctgcggccactggcataaaaagattagacaggcgcgtggccaccacgggtagtgcatatttcgtggagtgaacaaccggaaagggaaaaccgccatcacagctgtggtcatcatcagtgtcttcaagtgcacaatagtacttactgcttactatatttcatttggtagagaggaacttaattagctcaattgatactactaggagatatcggtgtatattgtggcttaattgcgccgtttcttttccctctttctgttcaatttttggcgtctttcctttatttacaaaaactagcggggatggattctaatagctcgagtggatgtccacccatttattgcatgtc

SEQ ID NO: 9199 - DNA, 2492 bp, Oryza sativa
aaaatcccttgtatttaggggcagagggagtataaggctatacctctatgattttgcaccttttcaaagaaaagaatttttacaactctatgcatgtgcgctcgtttgtttcttatttttcagatactgataataaaaaagctgtaccaaattcgaccatgaatagtgttgaccgtaacaaaattcgtgggttttcttttcgcaagcgtagctcactgattaggttcattgtgatgaaagcagtctactcggattcaagtcctaaacttgacatagttgctgctcgtatttacggctaattattcattcagtcgtaggcgatatacccatcgatagttagatgctcgtggttactctgttacactactatagaaagacactataggtgctagaatagctaaaaccgacatcgatagtattttttcacacttacacgtgctcattggggggggggagcagcaaaaaccgacacctttgtgaatagataggtgccggttctatataaaaaccaacacgtaaaatattagtattggtttattcaaaagaaccagaacctataatatattataggttctggtttttaagaaccaacacctacaatcatataggtgtcagaattttaaataaacagacacctattaaaaaaattggtcggagccgactgaaccgaccaaccttatctactcccactcctagtcatccttatcatccacactgctaccccactcctgtccctcctccttcctcctctctcctcctccacactaccgccccactcccacccgtcctcaccgccgcctccccccacatgcttctgctacgctcctcctttctcccactcttactctccctgtcgagggatccaggtgatggcagcgcgaatacacgatgacagcgacgacgacggtggcacgacagcacgatgacggtggctacgcgacggcgctggcgccctcccctctgccagatccgacgaaaagggaggcgacgggctccccaagccgtccgcctcatccctgccgtcctcgtcaccgatggccacgtcatccccgttgtccatgttgtggatccacctctggacattgctcatcactgcggcgttgtcgtcgttgcctgaccccctccttggttctagctcaatgggcgctggatttggtgaccctggtacttggcgtcgacctctcctcgccgacagaggtaatgtcctcatcggcaatagcgacgatgatgatagtagcccctgtgctgcccactccgccagatctagaggcacctggcaacgccgggtagtcccttcgtcctcggctccaccgccgacatcaaaggtcagtgtcccttgtcctctccctactccatactcccctctccttcactctcctcctccttctctcgccctcctctcgccctcctctctcttgttgatcttgttgtcggcaattgtctacaggacaacaggtgggcagactcctccatggtggacaacagtcgcgagttgtctagaatttctaaattcaaatccatgtgatgaaaattgtaatattatgtgatgtgttgatggattatgtgacttttaatcctataaatttgtgaatttcgttggatatctgtttcattctttagggattttaatcataggctcattgtctcgagcctgtctcgatggtttttttttctcctgtagggtcattggtgttagttgttcaaaccttataggtgcatgttttctttacaaccgacacctatatattgttatatgtgccggttatgtaaccgacaccgatgcctttagtcatcagtgccatctgcttggatgccggttgagaaaaccaatacctttgtgtggttccaactaacacctattaatgtttttttagtagtattaatttcaagatataccggtcaaatgctcataggagtagggggatcgggatcctctgcattagagtacaaaatgcaaaggagctacaataatttgcattaggaggaaactgcaccatccattcatgattaaagacatatgataaacatccacagtatgaatgtgatagcaatggatataagctaaaatattgatgctacagtaatggattgatctgaaccgtccgttgttaatctaactactcaaatactactgcaaaacattgtagcatattgcattaatagttcaattatagaggatccatatccggagtagggcatatatgtttgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggcgccccgaccccctgagggtttggcgccacgtgtgtgggttaggagagcacagcggggctcacctaaccgcgtttattgcaggttggacgaacgcctcacgcctaatttaatgca

SEQ ID NO: 9200 - DNA, 53295 bp, Oryza sativa
  unsure (1)..(53295): unsure at all n locations
cgagtcaagtttgggtcaaagtaggatgggtccccccccaaaagaagggtaggtagaaatggtgtatgtggtatccccctgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccaactctttgtaactccttcatacacagatccaccagaacacaggagtagggtattacgcttctcagcggcccgaacctgtctacatcgcccgtgtcttgcgcatttactctctcgcgaaacattccccagaccgatcgagggcgaagaacctcacttagcgcccccggccgaaccggcaaaggggggcctgcgcggtctcccggtgaggagccccacgctccgtcatctggcgcgccaggtagggggcgcgcgtgggtttttctaagccctcgtcctctttcgtgtgcgccaagcttctcccgctcagcccaatggccgaacgggcagtggcgcacaacctctctccgagcgctagcggtgacgacagcgagcagaacccgcgtcgtcgagctcgtactccaccgcccccctctcgccgaagtcttaggcgggaggaggcgctcgagggggtcgaaagatccgcgacttcgccgcacgcgggcgatggagaaggacggcgagacggggagcgtcgtctcctcgtctacggtgatggcagcacgccccagggcgcgctccaggctgcgggcgcgctcttgcgtcacccgcccgtcgtccctgatccagagactccaacccgccgttggctagatgacgtggccaacttggtcatgacggcgcagcagcgcctaggcgccggcgggcggtcctccgccaccaaggccactggcgttgctactgccggctccgtgtcgtcgaggcgaagggcgcggcgagcggcagccgttacccgccgttcatctgccattccctcgtcaacgcctcccacccaagaagatgtgcgtgaggggccggatgcccgcctcaatatcgagcgccggcgcaatgatcgccgtgctgcccacgcatcggagggcgcttcctcgtccggagcgccacttcggtccgggcacgggggccagccccccgtgtccccggttggcggtgccggctgtcgagcctttgtggcgagccttcggaacgtccgttggcccccaaggttccggcccaccatcaccgaaaaatacgacgaaagcgtcaaccccgccgagtttctccagatctacacgactgggatcgaggccgccgggggtgacgacagggtcatggcgaatttcttccccatggccctgaaaggacaggcgcgggattggctaatgaacttgccacccgcgtcggtccactcttgggaggatttgtgccagcagttcaccatgaacttccagggcacatatccgcgcccaggtgaagaagcggacttacacgcggtacagcgaggggacgatgagtctctttgctcgtacattcagcggttttgtcaagtccgcaacaccataccgtgcatccttgcacacgcggtgatctacgcgttcagggggggcgtgcggcacaaccgcatgcttgagaagatcgcctccaaggagccccagaccactgcggagctttttcagctcgcggaccgtgtggctcgcaaggaggaggcatggacctggaactccaccggttccggtgtggcagcttcggccgcccccggatccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggccggcgctcccagcagggagcgcccgaccagcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccagcaaccggcgaagtgaggccaagcagaaggcccccgccgagaacattgacgatggcgacgatgacctagggttccaggagcccggggccaccatcgccaccgtcgatgggggagcacgcgctcacgcttctcgtcggagcctcaaggccatgaagcggagcttctggccgcggcccctacccatgaggcgacgcggcgggcgcggtggtcggaggttgccctcaccttcgaccagaccgaccacccgccatgcattgcccggggaggacagatcgcatggtggtttcccccaccgtttgcaacgtgaagttggggcgtgtcctcatagatgggggtgcagccctcaacatcctttcccccgcagcctttgatgccatcaaggccccggggatggtgctccggccgtcccagccgatcatcggtgtgacgccggggcacacttggccgctaggtcatatcgacctcccggtcaccttcggtggttccgccaacttccgcacggagcgggtgaacttcgatgtggcggacctcagtctgccctacaacgcggtcctagggaggcccgcgttggtgaagttcatggtggcggtccactacgcctatctccagatgaagatgccgggccccggtggccccatcaccgtccatggcgacctcaaagtcgcgcttgcttgcatggagcagcgcgcggaccacctcgccgcggcatccaagcccgcgggtggcgacgagaggctcagcacctccgtcccagccgccccgaggcatcggatgatcacgtgcgacgaggtcccgatcaagcaggttgccctgggcgacggcccgtccaagaccacacgaatcggtggtcttctggacgataaataggaagacgcgctcgtctccttcctgcgggcaaacgccgacgtcttcgcctggagaccggcggacatgaccggggtccccagggaggtgattgagcaccgtctcgccgtacggccgggcgcaaggccggtccggcagaaagtgcggtggcaggccccggaacgtcaagccttcatccgcgaggaggtggcgcgacttctggaggccagattcatccaagaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacacgcaaccaggagaccttactttcggatctagcggaaactttcgaaagtctccgcaccgcccgcataaagctgaaccccgacaagtgcgtgttcggcgtgcctgcgggcatgcttctcgggttcttggtctctgcccgaggcattgaggccaaccccgagaagatacgagctatagagcggatgcgccccccagcaagcttagggatgtgcaatgcgtcactggctgtatggccgccctaagtcggttcatatcgaggctgggagagaaggcgctacccctatttaaactcgtcaaacgctccgggccgtttatctggacggaggaggctgaacgggccctcactcagttgaaggcgtacctcagttctcccccagtcctggtcgccccggagccagatgagccgttgctactctacctggcgggaaccccgcaggtggtcagcgcggcgttggtcatggagcgcgacgaggacgaccctcgcttcgcgcatccccaccctgtgtcgactcgacccgggagagagcagggaggagaggcccccgagccgaacggtggcccaaggcccccgacggccggagctggccctccgcccgcttgtccgaaggtgccaggcgcccccgacccccaggatggccacggggccactgcgggaaggccgcgcctgtcgccctctgaccccgaggtcatcggcacagaagccgagtgcgccccgcgcggcctctcggagcgtgacgaggacgatcctcgctctgcgcgtccccaccctgtgtcgattcgacccgggagagagcagggaggagaggcccccgagccgaacggtggcctaaggcccccgacggccggagctggccctccgcccgcttgtccgacggtgctaggcgcccccgacccccaggatggccccggggccactgcaggaaggccgcgcctgtcgccctccgaccccgaggtcgtcggcacagaagctgagtgcgccccgcgcggcctctcggacgaagagcgccctggaaatgcggcccctagtgaagaagatcggccccgccgaaaggtgtagcggcccgtctacttcgttagcgaggcccttcgggacgccaagacccgataccctcaggcctagaagatgctttacgctattctgatggcttcgaggaagttgcgccattatttccaggcgcatcaggtcacggtggttacgtcctaccccctcggccaaatcttgcataaccgagagggtactggacgggtggtgaaatgggcaatcgaactctctgagttcgatttgcactttgaaccacgccacgcagtcaagagccaggccctcgccgactttgtggcagagtggacaccggctcccgagcccgtctccatccccgaggccagctcgggcccttcgcagctgcctcacaccgcctattgggtgatgcagttcgacggctccctgtctcttcagggtgccggtgcgggggtcacgttgacctcgccgagcggagatgtcctcaaatacctggtccgcctcgactttcgggcaaccaacaatatggcagagtacgagggactccttgcgggactcagagtggcggctggactggggatccgccgcctcctggtgttaggcgactctcagttggtcgttaaccaggtctccaaggagtaccagtgctctgacccgcagatggatgcttacgtgcgccaggtgcggcgtatggagcgccattttgacgggatagagcttcggcacgtgcccagacgggataacgcggtcgccgacgaactctcaaggctcgcttcctcgcgagcccagaccccaccgggcgcctttgaagaaaggcttgcccagccgtcggcgcgacccgaccccctaggggagacggacgcgcctgaacggcccccgaggcccgtcagagtccaggcctcgggacccgaggggagcgctcccagctcccttagattgattgcttggatcgctgagatccaggcgtacctcgcagataagactctacccgaggaccgcgaagggagtgaacgcgtccagcgcatctccaagcgctacgtgctggtggaagggaccctctatcggcacgcggctaacggagtcctcctgaagtgcattcctcgggaataaggcgtcgagcttcttgccgatatccatgaaggcgagtgcggagcccactctgcctcacgcaccttggttggcaaggcctttcgccagggtttctattggccgacgactgtcaacgatgcggtcgacctggtccggcggtgcagggcgtgccagttccacgccaagcaaacccatcagccggcccaagccctgcagaccatacctctttcatggccgtttgctgtctgggggctcgatatcctgggtccgtttagacgggccccgggcgggttcgagtatctgtatgtcgctatcgacaagttcactaagtggcccgaggcttatccggtcaccaagatcgataagcactccgcacttaaattcatcaggggcatcactgctcggtttggggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaaccaagaccttcaacatcctcaagaagcatggcgactcgtggatcgaggagttgccagcggtgctttgggcgaaccaaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcatcgacgacctcgtcctacgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtctcgggctcgggccaaccccgcaccccgcccgggcgtgcagggttggccgggggctaccacatgcataagcttatcttttttctcttccgtatttcaataaaagcattttcgatttcctaaggactgtgtctgtgccattgtttcctttcgaagaatcttggcttgaattagcacgctcgtgctcgatcctgccctcagtggcccgggccggctaaaatcgccaaacggggcccagaaccgagccgtgccccggggcgtggtgaactccgggggggaatcggcaaaggcccacaatcgggtccccataaccctcggtcaccgcgctcccggcctggccagtctcgacacgtggatctccccaggcactagccccgacccgcgccgtttgaggctgggacctgggcacgagtcctcgttcaagccaagacacagaaggaccgcggcacagaccatcctcgtctcatatacacaacgaacagagctgacacaaaaatttcctctttatttgattgcagattgaattagtttatacaagaagggggcccgaaggcctcagaagaagaaagaaaaagctatttaagattggcgggggcctgggggctcacgccgacgcgcccgggtcgccggcctcgtcgtcgctgtcgtccgcaccaccgtcgccgccctcctcgtcggagtcgagggcgaacgcgagccgaggggccgtaccctcgaagctgtggacgatgtggacggcggcgtcccggacctgtgcgcgcgcgccatcctcggttccaggagagaactcgtccagcgctgcccacggggagaagtccgggtccctggcctagtagcttgccagtacgagctccaccgccccccgggcgaggtccctcgaggatgacttgatcgtctcctcgagctcctcggggagccgctggagggtcccggccatctctgagaggcgctgggcgaggcccccctggttggcggcatatttcgcgatccgcccgccccagaggcccgcctgccgcccggcgcggtctagacgggagacggcgtcccgaaacatgccgggccctacctcgcctgccaagcggagggcctcgacctccccggcggacgagtccagcgcgccctgcagctcggcgatggtgtgttcggcagctgcgaggcgggcggctagatcgccgtcgcccgcggctgccccgccgctgcgcgccctcgcgtccagctccttcgcccgcgcctcgagctcagcggcccgctgatccagtgcggccctctcggcacgggcgccttccagattacggcgcgcctgctcctcccgcgctgccccgcggagggacaggctgtccgccagccgctgcgccgcggcctcggcctcctcgagagctcgctcccgctcggtgagcgcgtcctcgcggaggcggagtgcggactcctcttcggcgcaggcggcctcgtgcgccgccagcgttgcctcccggatggcgacggcggcctcgcgacccgccagttccctttccttcgtgtccagggcgcgggcgcgctcctccagcaccgtggcgcgagcctcaagggcctcttcacgctgccgggacgcgttgagcttcttctctagctccgcctcccggctcccgtattggaggcagaggtcgtcccgcgccgcgttaaaaacggcggtggcaatgagggcagtctcccgctcctcctccacctccctggcgatctccgccaggtccctacgacgggcctcgagctctgaggcgtgccggcggtgtgccttgcggcccgcctccaccatggcctccaccgagcgtcgcccctcttcgacacgcgcccacgccgcgtcgagctccgcccgctctgcctgcaggacctccatctgggcacttaacccgtccaacaccgtggtgttcgcggtggccaaggcctgcagaaggggctccgcgctcagtggggcagcggaaggcatgggggagagccgcctcggtaaggatgccgcacggctcgtcccaccgatcgacgtgccggactcagggacgtcccccgaagctggcccgtcctgagcgtcgcccgagaggtcgggcccgagcggtgcgcccgcggcctcgtcgtgggtggcctcggaagtcgtcgtcgcctcgggcggagtcgggtcggaggcttggcaggccgcccggcgtgcgcgcgccgcctccgtctcccggacggactcctcggcccggtggagtcgggcctcctcccaagcggcttcctcagcctggcaagcccggacagcctcctgggcagcttcctcggcttcccggaggcggtttgcggtttctcgccggtcagctccccgcctccgggcctccgcggtcgccgtctcctcggcctcagaccggccggacttggaatggcgggaagggcgcgacgggatctcgctgaggtagaagaaaaactagaagacgaaaaacgggtgagtgaaaacttgccttgggagatgggagaatgaatacggccgcagtgggcgcagggacgaacctgcgaggaggtcggctaaacgaccaccttgggggggagatgaggtttccccggtatggttcggtcccccccatcttgtggagccgcttcttttttcgcttcccctcgggccgcgacgtcggcacagcaccctccgggcgcctgctgctggcacgcaccgccccgccccctcggggaggagatggggagggggtatcctcctgtttcctcttcccccgggcgtcggtagggcggctgccccccgggcccccgtcacggggcccagaagcacgaccccctcccggggtagattgttcccccctgcggctcccgcccgcgccatcgtggcctcggggggcccgctcccccgacgccccgacctcctgcatgatggtcaggatgttggcgcgctctggatcgcaggagaggggaaggaccccttgagagatgaaggatgcctccacggagctgagattcagcacccgttggaccactattctgaagtcctcagggtcccagtcccatttgcgcccctggtgggtcctcatgatgtcctcgggcccggtgtactcccaggcgccccgggcgtgccgctggagcggcgcgatccggcgacgaaggtagtcgccgaacaccatggcccccgtgagcccctgggaccgcaaaccagccaggcggtcaagaacggcgtcgtagccgtctcccagatctaccggcgcccgccagctggaggcctgcgccgggggctggctcggaagtcggaggcgcgcttcgtcggcgagaggggtgtagaaccagtcactcttccagtcatcccacttcttgcgaaggacgcagggaatgtagcggttcagcaccggcccccgcggctggaagtagcagccaccgactaccgacggtggcgacaccggctgtacggtgaagaaccaccggaacaaccggagagatgggcgcaccccgatgaacatctcgcacaggtgcgcgaagatggccaacgtcattactgcgttgggggtgaggtgcgccatctggagatcataaagctccagaacatccatgaagaaagaagagaatgacgggaccagccctgccattgcgaagggaaggaagaatacggaccgccccgggtagtgtggcgccgggcgtccctcacccagcgcaaccacctcccggccggtggcagattccggcatgaatcggcgcggcagcccggcctgcctctcgctcacgatgcgagaaggcggcagcacgctaccgtcgagcggtgcggagccccgtgccataacgccggcggaggaggggtttgagagcgagtgagtgcggcgagggtagggcacaggaaacgagaagttagagcgcaagcggcgaaggcaaggggaataatggcgagaggaaggaaacgaatctcttcctcggcgtctttatacccttgccaaacgctatgcccggctcctcgcttcccgcgcccactatctcgccccctcgtttctcgcgcccactcctccattaatcctgctcgcccgtttgcggcgcacgaggcggatgtgcggccgtggcagtcgagatgggacatatcatgcgcgcgttaactacgctcgccgaccgatgcaccatcatcacatctccaggcgaaacgaaccggctcgtcccaattcgcgcgctactcaagtaatgtagcggtcttgaagaaagccgctcattattgtcggtcggtttttcccttgccgatgcgcgcgatttgcgaccactggattcctgtccgcctgtagagaccggtcccacctgtcaccaggcctgaggagtggcgtcacgcccgagcgttttcctcgaggagggcgatcgccctggcataacgccgggggctactgtcggtgacatgggaccggggatatcttgactagaggtttggggcagccgcggtcacccacgtggcctgaccccctcgggggggtcgggcccgaggttgatgaggccgcccctccctctatctccccgaggggtcgggccgctcccgtttcgaccccccgggggctggggtgccccgaccccctgagggtttggcgccacgtgtgtgggttaggtgagcacagcggcgctcacctaaccgcgtttattgcgggttggacgagcgcctcacgccgcatttaatgcagcatagcgcatgcttatccggtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtgggaactcctggagttggcgcgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgtgtcatcagcaaacaaccgtgcttccacgttgcacctgcttccggcggagtggaggttggtatgacccatcccgtcggagggtcattcggacagcagccattgcaaatctccgcccattaatgagggaggacagggttatcccggtgtcaggcgaaagtacgagccaagttttggtcaaagtaggatgggtcccgacccaaaagaagggtaggtagaaatggtgtatgtggtatccccttgagatataaaaggaggaccatgcctacgaagaggggggaccaaaaaaaaggagggacggaaaaaaagactagaggagacctgagcaagtagactggagaaaagaggagtgagaggggctctagagtgggaactctcttgctctccagctctttgtaactccttcatacacagatccaccagaacacaggagtagggtattatgcttctcagcggcccgaacctgtctacatcgcccatgtcttgcgcatttactctctcgcgaaacattccccagaccgatcgagggcgaagaacctcacttagcgcccccggccgaaccggcaaagggggcctgcgcggtctcccggtgaggagccccacgctccgtcaatgttcatagggataagtatgcacttgttatgagcacctgagtttgtaccatgtttttaaaataattgtgcttttttaaaggctaggtattaactttttactaaactattcttaacaatgatgtgtcatgtatatttgtagttaaattaattgttaaaataaatatttgtaaaggttttgtaatatttttttaagttcgtgtaccagagttattttttcttcaattgaggctgctgcctgtgcgtgctgatcagcgggcagaggcaaaatgacatcacgtcgccactcacaatcaccgcttgccagtggtttgccacaagaaatgggttttatcttgttctttgcggctctgcatcactaattcgacaaactctatttttcactcaactattggccgaatctatactacgcctttctcaagtattaaaaccatttcaaaaagatttctcaaatttgaggtggctaacgtggcatccacaaggcaacccagtaagtgactacctcccatcttcttcctacaccacccccctctctcccctcactccctcctatgggcactccacttgtgggtaaggttgcaagggggtaggcccgtgaacccacttacaatacaaaaaagcgggtaatcccgcgtaattgggtacgcgggcctgccccttgcacccctacttgtgggtcaccgacggcacaaccggtggctagcaggcgacagaggaggaggagctcgagtacaacctaagccaccacactcctcctattgaacttgggaaagtggtgacgaagatctcacaacacgagtgaaggtactcaaacatcgtgcgggattcatatgggtcatcatgacaacaaccgtctgaaggcagtgggaggtggagaggaagacctcgattagtgtagagggaaagttctcaaggtagtactttaggttgaggcggatggagtgttgccttcaaatgcattgcataagagggaaaagagggatgccgctatagcaaggaaggagttggtcgttgtgacatcccctgaggagagggcggtaccaagaaaggagacgatggaggggaggacgctacctagcagggaagtcggaagctgtggcggcaaagagggccttggagagttgtgcatggatgagagacgacgtggtgaggagctggaggaggttcgctttgatggtgatgtagttgaagggcgagaggttgatggcgttgtcaccaggaggtcttaggcggagaaggagattcttaaattggatggaagcaaggagccacatccgcgggtcatggcgcagggaagagatgaggcccaacaacgtgagcgtgaaaagcccaaggagcacaaggaggacgccaagctttgcttggttgcatgacgtgtgacggtgtcaagggagaatgattacgtgaaccatctcgtcagagtgtcgagcctctccagagccatcttcattcccgttgtacggtgatatggcagaaggcaactagggtttggtggaacaaaggagatcaagagaggtgctggagctcccgcaagagagggaggtgagactaagagaagggagtagttgaggaaaaaggtgagagatagccatgtacatatcgatggagttgttttaatattcattcgcgatatacccggtttaaagggattaaaatggactccaacccacccaaagagcgcgcgtgcaatttgaaggtagaaatgggctttcatggcagtactttcctgcggaaaccggcccaaggctacagttttcgggccccagacccagaatgcgaggtaccaaggcctgcctagtcactgaaaacgccgcttctcttctgcgagcctgcactaaaaaaagccagaagaattttgccccagatccataccaatatcaacacaagttcttctccaaattgctggcattagaactttgcaaattttaaattaagcactgtatggcaaacggggaacggggttcctcttgccttagttccaacaatgcaaaatttatttgaaagtcatcggttcactagttcatcactggcagaattaattataccatcctcataccgcctattcacatctctatctcaaataggagtacagaacattaagcctttgatttctggattacgagcaatattttgaagtttgaagatagatactttaatttaccgaacactcggcacagtagtcagtacagtcacataattacacacgcacacgctggagctgctatattcgtcaagaggctcccacctacgtataaaagcgtataaacagtggcgtaattcttctagagttcaagaatggcgagggattctcgcagaaatcagtggtaactcgtatcttctctttaactaaaagcatcagtccatcagttatatacacacgaattccttagcataacgtcactgagctcaccgcatagcccgctttgtggtaggggatcttcacctgtgaagtttacgaaggaaagaacggtgctatggtttttctggtggctcttgctgttttgctctactccgggacatcaacctctccttgatttctttaaatgattggagctcttcgagtgcatcagatttcctacgggacacgacagaactggttgaggctgcttcactagattcaaccgctgatgcttgagatggacaattagagtttcgcagagggcgtgcagttttgagcaggtgcaccagagagccaactgcggcatcttgtgatttatgggacgacgaacttgcctgatctctagcttccttcccatcactgctcctgtatattatatagtgcatatagaaacggtgttagaaccatagaaactcagtagtggaaacaaagaaccgaatagtagaaatacaagaggacatacataactgttatattttatcaaaagccatgggtacagctcaacaaagataaacatgaatggggtgaataataatagaggcacatatccagagaggttatattagatctgaatctcctgttaatatagggtgctgcgtcaaaagaatatctgatcgcactgggaatagtaaaatagactaatcatcttattcaatacaccatatagactatcacgcaacaaatgtagctcaatgcattgaatataattatcctattttggcaccacataacaatgaccgcccaaacaagcaaaactagatgtttaatttagagtaaatttcacataaccttatgtattaggacatgccactacaaatatgccattttagataaatgccactactattcacgatatcggctacgtgccactagaatttggggaaattagaaccgtgccactagtattatggtccttgttgaacaaaaccacaaaggttttggcatgtggcacaaccccggatatcatggttctagagtttcacaaaacctcattgttaaccaattgttctttgtttcatcataagtatgagtttctaatatcaaatctcaaaactcgaattaatgaatttttttatctatcataaaaaactttagccatctaagttaagcattttttattttgctacaatgtcaagttaaatttgttgacgccttgacagtgtggttttataaaactatagtactataatataatacccaaggttatgtgtcacgtgccaaaacccccgtggttttctgcaatttggaccataataccgggggttctatgaaatttactatttaatttatgtacgagtgtaataaaagtaaaaggaaaactccatttgagcaattcactcttcctaaggcctgaaatttgaccctcgaccacaaaccagatactcagcaatcagcatccctgaataatcatcatccctctcccatgtgctatccatctagcttgtcagatgtagcatttctcgccattcaagttgttcactcaatatggtggtacagtgactgccggttggggttgtagatttctgttttcaatggttctgtaattgatttttatggtgaactgtaggggaaggcccatattgtatggattgtcattaagaaaataaagtgctgaattgtactttcctggagctcttctgcagacttatctcacacgtgcaagtagttcaactagcttagattttggtgtaataggtaaataaacttcattaggtgttcacagaagtcattagcaagcaaatttgcctaacccataggcatcaatgccatgccagctactgtgatggcataggtttgagtgaccattaccttgttatgtgaggacataagttcggtcgacccagcaagccagattatgtgttactacaggattaatcagtgccgttgatcagttaaatgttagtttgcgtatcattttcttggttaggtctgtttagctattgttgaggatcgttaggaacattatttggatattgcaaacgaccttctctatacaacagaggtggcattcattattaaacacaagcaagaacttagcctactctcttctgtcctgtcactctgttctcttccagggttccagggaggtgagggttcaggctgcaccctcctgtcgagcacaactacaccctttgccatttaagtccagggccaagccataacaaacatacttgcacatgtaggacatgtttgatatgtgtttgatgaccactagtacaatttaatcttttataagtgctttgttagtttctttctgccgttctggttgtatcttgatatcgcttttggttgttggccagtgtgttaatcattgtcgagttgtagcctagtggctattttgttccagaaactttaccaggatggccggtaatcccgactacactcttctatctacctatgctttctataaatagcttggctttggccttttgtctaaaaaacattttaatatgttaaaacttgttgattgtgactaagaggcaggttacatagaggttagaacttagaagttgcaaaaagaaaaagtcatcgagtcaagtccaaatttgtgctttgcatttgtagcaactgttagctctgacatatgattgtgttcactctaactataaagcaaagaaacttaagaactggtaactatgcaaaatctagatctttgcaataaactacatattggtagagctgtcgatcaaggcacaccgagtccatgttaactaagccaataaccctcatttttattattcctttttgctatctctaccagttattctaacactagttttgtagtatgacaaaataacatgtccaaaaggttttcaaatccttagtccccttaatgtcatatttaaacttttgaaaaaaaaaatcaaataatgtgcaacataataggatttgatagctctaacgatcaaatatttgtgtaaccggatagcctctagcattctttaacaactagatctatggatactaaatcaacttagtactgcctccctcccaaaatataacggataggagctagtacttcgtatttcatatgaatagataagacttcatgtaattcgtttctggctttatctgatgcactactgccctagcaaatggcgaaattcatcaaatctatagatagaatatttaagttactaccatacatacccaggctgggagctcggtgtatcaacatcatccacagcaaagggataatctgcatcatctatatcatcttgtcgaggggaatcacaggaggagagtgcagagaacctgccagattcgtccttagtgtccttgccctgcacatgggtcaaacggtgtcaacgcagacccaactcaaatacatatttttttcctggcttcaatagctagaggaagataaataagttatccatagctaatgcagaggataagattaagtcccataaaggcaatccactaaataaaaattaaaagtacaagagcagacatatattgcagcagacaagggtaatccaaatatccaaccatttgaagatcaaaagctgcttttgggtaagcctcagaaaataactaactcaacaaccattcttctgtttcaacaagtactatgaacgcatttcttttcaacaaataatatggtctcagcaagaaccaagagacaatcgaaacagttcacaactaataagagaccctgatatgtagtctattttttgccaaaaaaaaaaggagagatgagagctaaatggtgtatatgctaacaaacagtatttaggctgcttcaactccagtactaataatggcttacattccactatcaaacatggtttgttgcacaatatcatgaagctaaacttaacataacaacttaaacttgtgaatatgtactgctaaacattgacttgaaatagctcttggtagagtttgtttcctagtttccaaggtaaatgccagtaggctctactcagccacatgaaaacagaaaagtctacttcagatataccagatgaattgccttacactcactctcaaaagttatatgattcatgaaggatccagtattgagcagtgatgaagataaggcatacacaagtatcaaatataagttgaaagcatattggaggctttaaaaccatggatcaccttgcgtcctggcgacaagcttgcatagggatccattattcgaaatccatctgccctcccaaacgaggggcatctctctgatggagactgttgtgcactagatgttcctgtctcccctactctcctcggagacgttggtggcaatgtgatcggccggtgaattgggctcctcctgtcacccacctgtggtatgctcattggtgcagaccctcccttaggacgagattgaagatacccgctgggaaaattgggtggcgatggagtgggtgatgcgttgagcaaatgaggtggcgaaaatctagcttgctgcctaggcgcctgcggccagagcgctggcgtcgcccagctgtgcgggcgctgcggctgattggacagcgcctgcgggaaagcggaacctgtggctcctgtgagcgaagctgggaaggcacgcattggctcggcagcagggctgcccacgtagtcggcgatcagcatggagggcgacaaggaggagatctcgagattgaaggcagcgaggctggggaggtactggacagagacgacgaggcggccgtgctgcgtctcgacggggacgaactggtaggagcgcatggcggcctcctcgtcgcgggagagcggcacggcgaaggagccgacgcggtggaccatctcgtagttgtaggattggttggcgcagaggaggcggaagacgcggtacgccggcaggaagcggagcgtggcgtacaccgaccgaagcatcgtcatgcagcgcttgtacgcccggttcacgggtatcccctcgcccgccgcggcgtccggccagggctcgcacaccaccgtccatctctccaccacctccccgcccgctccgccgccgccgccgccgccggctgcggcgtgagccaggaggatgtccaccacgagcggctcccccgcctccggcgcctccactccctccgccgcgggcggaggctgcggatcgtggagcgggaggtggaaccacctgtcccgccgcctgaacgacgccgacgcggccggctgcagcgggcgcggcccgcgcacggcgagcacggcatggagcaccttgaggtggaactgctccaccatcagctccgcgcccccgcggccgcccgtccccgagtccgacatgctggacattgcgaccgccgaaccccgaccccagcgccgccgccgccgccgcccgcctcctccccctcaccacggctcaagctccacgacatggctggcgctcctcgcagcagcagcagcagaagcagtacggccgcataaatccgatctgctcgcgatcggagggaagcgcacggcgacgggggatagatctgcgcgtcgatgggagggaagaagaggagaggaagaggttggagttcgatggatgcggggggtgagaggagtagagttgtttatctgcaaggattaaggatcgctcgctggtttggttttggatttctggggttaaagggtcgctgttggtgtggtcatgatgagattataatggtggcgacgacgaaacgagattattttcgtgctcgtttaagataccttaagatattaaagttaactgaaatttttttatggttgagtttcaacgtaatttttctttctcaactcataaaatcgttcccggaatataggtacgtgtcagcccttcttcatttttgtttaatgtattggccattcgacgtatatgaacatatggcaaaggaatctttcaatggacgccggaatattgtcaaattttagtatcattcatcatgtgatcttagtatacagcttcagaggagttactgttgtatatttgtgttcgttagaagaataaagaaaattaaatccctcattttccgcttacacttccggattgctgaacgggagttttttaaaaaaagtggatagaaaagttattttaaaaaattgttaatttattttttaaaaatttaaaataataactacttaattaattatatgctaacggtggatctaattttgtccattttcttaaattttttatccccttctttcaaacacatccttaaaaaacaagaggagttactgtagtaaattattaaaatatcgtgtgctttgctagcagcttcttatctttgattatgggtaaatgttttgtcaacaccatattccaccttctttattgcgatcgaatagctttacctcttactcctctttttcatggactttgacaaacgcttcgaaatggtgattgctgcagaactgacgcaacatctctaaactaccctgaaatttcccaggaaaacagcccgtgccaaagctgaaaatgagctggaaaaagacgagtttggcaattctataccgccttgtttacgttttcattccgtcggtgcttcttcaccagtcaagtcgttcacttcttcctccaaaaaggaacatcagatggaaaatcaagtacgatgatctggtcaattgtactattaaattaataatacaacgaccttatccattattatcccatagcattattcttaggactcattccactaaaagtcctgctacaattgtaccgcatgtactattaataatagaatcttttagaggttctctcctatctttaagagatacaatacatcctcaccacctcaccaccaatatccctttagactgtctccaacaacgcgacgcatactcatttatccgtcgtgcacagtgattttgggtaaaaaaaaacagcctccaacgggagaggcaaatgcgatacgcatattgggtagcggccaaagcgctaggcaaatatacgtctcctctctccaccgaacactggagcggagctcgcgcagtcgcgcggtgggccagggtgaggcagagctggtgcggtgaggcggagctcccgcggcggggcggaggtggcgcggcggggcgggagcgccgtcggggagcaccgtcggggagcgtcgtcggagcgcgccgtcggggaggaggcgtagtgggcccgtagtggcgttagggcggagtgcggccgacggggagagtccgcggcggagcgcggtcgtcgcagttcccgctgctccgttctgagcatcgccgccacgaggacgagccgtgccgcgagccgccggtgggtgtgctccgcctgccaccaccgctccgccccgaccacagccgtcgcgaggagtcgtgccgcgagctgccagccgtcgcgaggagtcgtgccgcgagctgccagcgtaggctgttggagagaagaagattgggagcactgggtaggctgttggagaagggaatttttgagtgtccgacctttttactgtgcatcactcaatccatgatgagtctctagaatgggtctccgctgttggagacagtcttagaagttctcttctatccttggaagacaatacatacatggtacaacctcgccaatggagtgtagaaaagaatgtatgcccgtagcgactgttaaaactgttccatgctagctacgaacataaacatttgttctttctttttattcagctgagtgcctgagtccgatcaaatatgatgggattgagattttgtacagccggtaaatattgccttgctttgtacacagaattcaagattggaacatagactcgctgaatggctacttctgaatgctgagtggctgttaacattcggaagtctttcgtgttagttgaacatacattttaaccttgcaattcaggtgatatagaactccttttgtataagatcgaccctactgatcgtccaataaaaaatagcaaatgagttacatctatcatacagaagtgcatgacaaaggacctaaaagcaaaacaaaacaaaatgggaaaactggaaagcccccttccgtcagtagcatcttgtaggttcaatcagttcagagaagagcgcccatatctccagctattgtaggatctccgagtgaactgctgcggcgcaaaacttaacccaacatctctctcagggccttccctggctcaaggagtccgatcagtctggcaacaagggatgcactctccctgacatgctccaggtctttggtttcggtccaaaggcaacgagcaacctgtagccttctcctcttggaggcaagtgaaaccccccatttggtgtacatgctctctcgttcctcgattgagagccgtctttgcatctgcctgcagagcatctccctttcgcgctgcaacttcttcgcactgcatcccgagtcaatttatcagtaggtatcgaagtgtcacaaccgatgtaatgcagtgaacttgtaagaagtatgctgaacatgacttaccttgaaactagagaagtattcgggatactagctatcgctccattggagtaggtatctttaagaaatgatagcctcctaagttccacttccatgtaaatggaatcagctgggtctcctttgaatagcaagaaaaaataggtcctatggaccaaagaaacattgcatgcatgccaaaagtcaataatctcttgttgcttcttctcgaattccaggggccaccgtgaaggtgactgtagggcatctgtaatcggatccagtcctacactcctgatggttccttctgccaagtctccatttccactctggcaatcgaaacaaagaacaaaatcataattaaatgtggcatattggactatcttaaagtagtgcaacgagtatttttagtttataaataagccctccttgagctattaaaaatgtgaagcaccataaccgtgcgcagttctcaaacaagtagaatgagcagcatcaacaggaacaagataacatttccaatgactcacatgaccaagttgcttctgatactgaacctgtgccatttctttcagttcagcaacaaattcacctatgccagtaaattctgtgtcgcctgcaacagaactgttagccttcagtccatccctcgtggtagtaatttcagaaagcattgaccctgcccttgatagggtctcgctctctgcatcatagttcagtgcagatcccctttcttgacaatnttgaggtctcccagcgaaatctatgaaacttctgtttggtggggtgcaatcgtccttctccaaatcttcaaacaaactagatccagtaagagacctacagctnctgctcctaccaagtactttagagcttgacgaattacgtgttgaaagatccagatctttttacaatattgccaaaaggttttctgacattttcgaaatgctgctcaagggtaactggagattcatcacgaagcctagaattcatagatgaatttgaatcattgttgatatgcatactagaacctgcatttgggtcttgcaaactattgctccccacagccgacgattccaaacattcatttcctcctgtttcattggtttctatacaccgtacttctttgcagatatcatctgaatcttcattagagatctgtgagagatgatcacttctgttagttgggagcatcccactgaacggaggactgctgactgagtacctagatggggtagtaaactgcacattattttcagcctgctgaggcttatgttccctctgtgccactcgccggccttgaaacctaaaattttggacactgtcaacaacttctgatgactcagttgttgattgctcatcttcacacgtctgtggaacatcgaaggtaaagttcctcccagaaacctacatgtagatagaaggaaaaaggtaaataactttatgtggttatgaaacgatagttatactaaggaagtctgcataccgaggactgctttgaaacatggacatggttatctccaacaacctgaagcaaatcctgaagcctggactgagctaaatcacgctgtaacttcaattccttaatttctttctccatctgcaaggaagaatatgtgaaatcttttacaccatggctagaagttggtgtattgctggcattgaagagaattagcataaagcatgcataaaaatgatcattttaggatctacaagttctttaagtacaaagaaatagcaagagtgaacaccataaaggtcagaagtagcatttaccttccggatttggttatccttttccttcaccaatgattcaagactagaataggaagctggacatcgcaattcactctccaacctagcaagctctttttgcaattgcttaactagtgctttatcggacatgactacattaacctgggcatttgtaactacttcctttgcacaacttgcaaatagcagagtgtttctcgattgttccatatggctacgggcaggactcattgtacaaataattgcagttcttgcattaccacccagagaaggttgcagtatgcgtgtgagctttgaatctctgtatggtatgtgcccatttcttactttgctgcatagatgaaagcaagtaatcaaatgagccacagcatccatcctctaatgccatgggaaattggaattcaacacgacacaaagtattaagttatgttgtcaaccttagtttccgaatgacagttcctagggtaagtaaacttctattaatatgacagccttctttcagcctagcaccagctgataatgcctgagatgcacgttcacttcctgctaaatcaacaaaattctgcatggtacaacaaaatgcgctcaaacttcaccatttctacatgaaaaagaaatatgaccaaaatttaaatgtctcttaccacactagccacaagtgtagttgatttatccttacccaagaactcacgagcagaactttctattgtctgaaaggacagatgggtaagttagagttaatggaccaatgcaacatcaattttacatatttactatagcctttttcttttctaatgtgactgcgtagtgaacaaaccagtttaagtatttgatgcgatctggagctgttttcatttaagtatgtctccccggttttcctttgagctatataaaaacacagaatcagatggcagtaatcaccacctataaacttttttctagataatgtattaatgattaatctaccacaaacatcgcaccttcacatacagaaataagctccttgagatggttccagtccctcaatacaacctctgtgaggttttctacataggttcctttctgtaaaataaacaacaccaagatcattagtagaaagcaggagccaagcaggatttaaaaataattagataagtaggagttgttttgacctctgcatcatcccaaagtctaagaggagtgttttctgcacttagcagatcccttacaacttcattatatatttctattgctgaaaatttcaagacaaatgctctctcctcatgctgcaaaaagaacaacatgcctatcagcctgacagttcaaatgtgtctcgtttcaacaccagctatggattaataggtactaagataggtggctgattaccttgccaatgtaatcataaatatctgctaccgtatattcagttatgccagtcatggtgtatgtctttccactacttgtttgaccatatgcaaaaatactcgctgttacagaacaaattaaaaggaaataaaatgtgttcagttagttcatgcaatcttcaatcaaaaccaaattggataagataggcaataggtttggacttaacagttaatgccactaactacagagagggcaacctccttggccccttgcttgtatacttcgttcgtatcgcagtcagagcggaataccctatctgcaattggaatagagttgtgtcaaaaaacacagctggaaagtgagaatattaaagagcatacttgtagtacgagcaaactaaactcccacttatctgtattctagtggtgtgtagttgtccactaccaaaaaaaaatgtccaatacatttgtaaatgtaaacattcaatttcaggagggttagcttaatttctaaaggtgttctgtcagattttttttactgggacaggaatgtgtcgatgtgttctgttacttgtaacaaacgacgatgtataagtaacaaattaccagtgattggactccggcaggtatgttaaattctgagattttaaattttaaagaaatatacaaggtttgtcctgatttgaagcaactggaatgcaatacataagagctgaccagataagcaaaatcctaacaggagatgcagaactaatgaattacagatgtagaaaacccagagttgtgaacttgtgatgaactaaccgaaggagtatgcagtcggagccgatggcctgtcagggaaggtgctccgggagattatggtagtgtcattgatgcactcccactccgacggatcccctctcgcaatctccttgtcgctgagaggcctcagcctcactgacaccagtatcctctccagcttccccacaccgccgccgccgccgccattgaccacctcacctccgtccatcttgtcccactgcaccacctcatccccgccaatcgcccccatttcacccctctacacacacacacacacacacacacactccccctctcccctggcccctacaccatctgccaagagcccaaaatcacaccattataagcgacagaaaagcagtcacatccaaaataataataatcaaacgggtcagcaaaggcaaactggaattcaagaacccgtcctactcgttgggcggggaggggagccacggggtgttgagttgttgctcctgcaggtggaggagaaggcaaggcaagcacctctcgtggacccccaatcgtcgtggagacgattaagatggtggttagagcgtcgtccgcaacagtagaatcgcacactaactaggcctaaatctagcaaccgccccgcaagcagagcagctactctactcattccaatgttgactatcgcggctacttcccgagaacgcctaagcatatcccgcagggggcagcatcgcgagctactgccagatcacaatatcacatcagtgagctaggcactagcagccaagtagcagaaaccccgtaatgctcaagccacagcaagggagggagcaagaaaaacaaggtgaaggcgacgagtctacctaccctagaggccgaggcggaggcgcgcttctggaagcgggagccgccctgcagtgcccgccacggcgcgacggccgagcttggaggcggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgttttcccttttcccacacggttgaggggagagagagccggagaggagaccgttgattcccttgtccccactccccacgtcgctctcgctggttgctccttgccgtgcgtttttgcgcgatgcccctctgcttttcggtgtattgcgagcactaaacatacggaggcacggagtagtggatcatcattgggttgggtattcttgtttgcacaggagttgaggtctcagactggagtgactgacagactcacggcggccagactggtgccttcagaattcaggaagcagggattaccactagcggcacgagggatttgatgatgagattaagatgggaatttaatttttaatcccaatatcttgtttggtagaggtgatgaaaattgataaggaatttagttagagattatgtcattaataaaaacggatggctgagatttgcttaaacaaagtgaaggaggaattccctcccaattaactgcccctacccaggtattgaaaagaaaggagttccttcctcaattctccatcctcatcccaccaaaattttcatgtctcccaaacaaacaaaactcttaatagtctcatccctctaaatttccaatccctcctaaaaactttctccaaccaaacggaccgtagggggttaggcgtggatgatgatgcgtggttgtgtttaggaattttgtttgggagaaagagggaagattcatcttgatgtgactggcagttacagtcccttagtggtaaagcaattgctaattggatttttctgagaggttacgtgaaacttactcgatcggtatatgtttactaggcgtgctgccttaagcggtgccatttgcttaattagctagctcttgtggctggctgtatgcctgtatatgttttcttgtactgtcgatctgtaaatggttgagaaatcacaccttgttctgcgtagatgcgcaccttctgcattacttcagctggtcttgatctgagaatttgttttcatttttgtcgatatcatttcgggaataatagcatgcttggcacttagattttgtcgcttgatgaggtgaatgatgatcggcgtagatggttctgtccctttgccggccgtgccagttactgcgtcgcaaaaagttgcactcatgctgtccaaggcataaggatcactgacctaccctttcccggtgaacacgcactcatttccctctcaaaacttggcgaactagcaaatcaaaagacaatagcacggctggtactaccagtacagtagtactgtccacaacagtgatcgaacgaccgatcgattcgaagccacgatcgagcttcaagggaaaaacctacactacacacaacgaactgtacgtacttgtgactacgtctacggtagtagtactcctagtacatatagtatcggttgccatccgcgactgcaaccccgatagctaggccaacgaagtcaacagcgcgcgccaaccgaagatctcgcggcatcatctagcgagcgattcggcaccgcaccggttaactctcgcgcggcgcggcgcatgtggcgtccatgcggacgggagccgcgcgtcccgtaccgcttggcagcgaccgaagctgccgctcccgccgcgggaggaggaggaggaggaggtgcggcacggtgcgtcgtacggattttgtcggtagccgcggcgcgtatcgcgagcgcggacgtgcgaagcgacgcgcgctccacggctccagtgaaacggcggttcttcgcgcgcatcgtcgcgccgtgcggctggtgcgcgaatctgctggctggcaagagaaaaccgttgtttttggaggaggcgctgcttgtgtttttgggggagaggagggggtcagtcgagagactgcacgcctgacggaattcttcgtcaggttaacaacaaattaacgtccttttaggacggggtccagtgcgcgtactttgccggttaacacgtgacaggaatttctttgggtgaatcattgtgcgtggtccagtcgtgtatgccctctagaatccaaagtgctcaaaaataatttatggctgatattctagccaattgaattcatagcagtatgtactactacactgttgttctaccaaaccacattcttacagcccacttgcgtcgtctcgtcacattagttaagttaggcagttgtcggaaatggtgattgtggttattctttttcgactttgtgatattttgttgtcaaaaggtgcaaaagagaggatgtcactgattgaggttgagggcatgcttaccttcaactctaatcaaagtcgggctgtctactctattctctccgtcccaaaaaaaaaaaagacaaaccctagatttccgtatccaacgtttgacgtcttatttaaaaaaattatgaaaaaaaataaaaagacaaatcgcacataaagtattaatcatgttttatcatctaacaacaattaaaatactaattataaaaaaattatataagacggccggtcaaactttagacatggaaacccatgatttgtctctttttttggacggagagagtacatacgaagagaaaacatctggcacatgcttctttattgttcactgatatgtcgagcatgtttgatattgacacatctaatctaacggcaggctggttgggtgattgattgattggctacccttacctatgatcagccaatagcctgaggtttgatacactgataagcaaaccatgtaatataatgtccgagtccattttaatgagcatctatccgaaaattattattaaagtagaaactttatttcaaaataagtcaattcgtaccttcttattaccctcgttcacaaattgaaaaaaaatctaccctttcataccctctgcggctctacctacccacccactcaccaattctaacctttcattaatgaggggtgttttagtctttttctctagctcttgttaacttcggacgttatgattttttttttgataaaaaagcatattatatgtgttgctatagtgaatataatgtatggtcataatgaatcttttgtctcctaaacaccatataaattggcatgtccatgttccatgttacaccataatgttataatgctaaacaacatacacattgtgttcctcagagagatttgtctttagattaaaaggacaggattatatgtagttctaacatgctgatcatcttcactccgttgttctccatcaaaataagccggactttgcaaagtatgtgtaataagctcttgaaaaaagtatccactctgttttcttagggggggggggggtaaaattgcaccacctgttcatattcagggttgcaaacaacatatatgcaaggctaatgtaaatattcaacttataccaaggaaagtccatattaggtaaaatttgttaatttttaaagttttataagtaaattaataggacactaaatagagtctcatgcgagtacaacttcataggtattaattctggatgatggagttatttatctttatattacaccacttccttcgttcacgacctgtttaatagggctccacctcctaaatttaatttgaaaagctaggtcaggcgtagagtggatcagaagtagagttgtaaagcagcctaaacctcactacacctatttatttcgtgatagcactttagctcacttcgttccctttttgggtggagttaaaaccgttttgtcggactccagctctaagagaagtggagctggagctctaccaagcatgctctaaataaatgtagttttagcctaaaaattgtccttaaaaaagtatatttccaaagtatttcactagaactctttaatactattacctttttttttcttattatttttagtcactgaaccaatagtactctcctttcccccattttccacttatcgttctctcgtattaatgaaggtatagtaggagtagttttttaacctttgttttaatgctccacctatttagagacggagggggtacaaaagatagctctaaaagcaacaactagatgtccatgtaaccatgttagctctggcttttggaggcctagtatttaccacattaaatcagcaaaaaaaaaagagaaatgtattcgatgtatggccttagtgggtccagaagctataatttatacaaattacaatttatctattatatactaaaagtccatgaaactttctacaaacgctctcaagccaccacgtggcgctctaataaaatagagaaaatcctataaattctaagaaaaaagcataacatatatcccttaatttttatttaaattggtgggtccaatattatacaccattagataaaattgatcctaaaacaaactaaataccatgggtcccacctatcctctcctcccgtgcattggcaggtggagtatataccgtaccctccccccctttttttcctttcttcttcttttttccatttatatatataatggatatattttttaaataatgataattttacaaacaaagaatctaccatcatataacttaagccggtgtactttttactctgtactattattttcaaataatgcactattttaaaataaattttacacaattatatcgtgtcatatcaaataaacaatatctatattaactaatttatacgtgcacttaaactgatggctccattatataaatcatcggatctactttttattacactggtctattattctcaagtaatgcactgtcaccattatattgtgtacccattaaattaacaatttaaaatctatattaactaatttacacttacgctagaactggtggacctattattataatcatcggatctattgtttgctaataaataaagcgtccaaaattctctttttgcccgctgcacaatgcacgtctgcacctttgcttttcgcacgtgtgacaaagcatagtgtctgagacatctaaggtgatcacaaccgctatagtgctaccgctttgccacgtattaaatcatatatggagatgattaattttgttaataacatgaaaaaaaattaaaggtgtgatgcagtgagagaataattaagcacccatgggttgtgtttttttcaacactaattagctctatttaagttgaaaatgagagttgttacataacaattataatgtatttgtgttatttcatatttggattttgtactatttgttcgtaaaggtgaaaggaatcattatgttataaatgtgagcgcaatattgacgaatatcaatagaactcttactatgacaaaggtgataaagggagtttaaggccctctcttttttttccgatttcatattttggatttttgtttgcacgctttccaagtttctagatggtgtcttctttaaacaacattataactttttagaagtcaattcattcgtttataccctcaaatagctatcacataaattatataattcatcaatttcagctatcctaaaccttaagtactacatattttttttcatgcgagccatgatgatcagtaaattggtgaacaacggatcatcaaagtcgtaagatgaatatataagagttgctctgaacaattgtaaataggtgtcaaaattaattgttattaattagacatttaatggcttgctagccacaaaattaatttctctctacatatatataaacatggacgaagttggaacaaatattaccatatgtcccatacatatatattgcgcaattaacattctaattagtcatttaaaatttcttaaaatgctctcaagctgccacgtggtgctataataaattagggcaaatattaaattctaacaaaaaaaatcaaagtatctattattttatttcgcttaaatccgtaggtctaatattataaaccattagattaaattgatcttaaaacaaactaaatactacgaggtcccacctcgacataggtacgcacctacatgcgcgggtacgtacgcctcccctcccttttttttcatttttctctttcttctttttttcctatgcatatgcttccctccctttattactatatcatgcgtcttcatgagacgatttaatcaaaagaattttgagtatcttgcactcgcatttttaatttgcgggcatactacacgatatgtatatacatggactgtatgataattaactagcaatagtttcttatttactcgagaaaaaaaacatgattcaaaagtcgtaagtacttaatccatcttctactcaaaagtttgtgaatggttttctaagataccttaagaaaaatagaacccttaaattattataaaataacattatccaaactttagtttgccccgaatttatgagacaaaatttctgaacaaacaacaatcttacctttcaaataatataagtgcccgcgtatacgcgcgggccaccttcctagttatataaatgaaaatagaagttaaacttgtataccaaatgcaactaagtgataccccacgctttactataaaatacataaatgaatatatgccaaataatatataaataatgaatgttcaattattatgaaaataatgtgagaaagatgatgtaacatccttgtatgttaagctctacaatgttctcttttagatgatgtatctagtatgagatttaagataatctataatattaaattactagtggataatgatgtgttatgcttgtatgttgagctttatagttcctactaattattattagttggtaccaactatatagaagatatatattctacctttaaaatttattgtaaacataaattaaaagttgtatatcaaattctgttccacttccaaaataaggtgcgtgtaaaaattgtgcaggaaaattcacttggacattaaaaaaggttaaaattaagctccaaataaactatataaaattatgtatttattaattcaaaacttagaaatttattgagaaaactaaactaaggctccacaccaacctccaaccttttagaaatctgtcagcctgtcacatgcgactgccattctggatgatgcattttgatgctctctttttttccgagatgattctggatgacggtggaatgctagttaatcaaaaaactcatcgccacgttgctaatttagctgactttgtcaacttcgtcgaggacacacaacacaaccacacacacaaatccagcgcagcaacagatctattgactatcgaccatcaaggggattggatcgaacacacatacgtggcaaccaagtcttctgctccctgaattccctcgtctagatctcacacgtcacaagtctcgacgacctatagcttgcttcacggacgcaaacacaggggttgccgacttgccgtgctacgacacttcatgcgtaatttctgtgtgctgatcgatgaaccaactgctgtctccgcgttactctacgcatgcatgcatgtatataaacatgcatatggcgcgcaattgttttcgacgattactatatcgcatgattcttctgcatctcctgaaactagcatgggttctgaggcgcctgaccctgccgttgctgcatccgtgcctctcgtccgcctgaaccacgtctcctttcagtgcacgtcggtggaaaagtccgtcgacttctaccgccgagtgcttggcttcgagctcatcaagcggccggagtccctgaacttcaatggagcttggtgagtaattaattaacctacattacccctgaagcgtccagcacaaaaggaccgatcaagatgtaatctgcaatgcatgcaacttcgtagttagaaatttgaaccagttgtcgagctgcatacacaatgcctgatcatttcagtgtgaaatgctgcttgttacaggctatacaagtacgggatgggaatacatctgctgcagcggggcgacgacgccgacggttgcagcatcccgacaagaccgctgccggcgatcaacccgatgggaaaccacgtttccttccaggtatcagtcgcatgcacgcaggtcgatcagctactgttatgttcgagagcagagttcgtatttgtcttaactcgatttgagcgaatggcagtgctcagacatggcggtcatgaaggcgaggctacgagccatggaccgggagttcgtcgtgaggaaagtgtgggacggggagacggtggtggaccagctcttcttccacgaccccgacggcaatatgatcgaggtctgcaactgcgagaacctccccgtgatacccctcatcgttgcatcgacgcccgggcttcctgagctgctgccgccggcgatgcagaccaatgtccatggctagctcgagctacgttcttatgtctctcctttgtacataaatacatgattaaatttcattcgtttgaattggttcattcgtacgttagttgtaagtattctatttgctgcaccatgcatacacgttagttgtagtaattgattgctgccaagattacattactgcccaatatatatatatatatatatgaacaagttgtttatatataataaagtgttttaagtgttccaagtctccggtgtacgacgtacatgtctcccaagtattttactctgttcgtcccattttaagtgtagccatgattttccgcgcctaattttaacggtccgtcttatttaaaaaaaattaaaaacataagtcacgggtaaagtgctattcatgttgtatcatcacataacaacaacaaaaatactaattataaaaaattttcaaataagacggatgatcaaagttagacacggaaatttatggttgcacttaaaataggacggatggagtaatcctgaacagacttttcccgcctgagaaagcttaaaatcactacagaggcttttgctttgcctttcatgtgaagcgatcatcacaaagtgaaaaggaaaaaaaattactctcgttattttaaaggccatggagtatgcgtatcctctgcttttgctgtgccgaggaaaagtgggttacttctttaagtatgaaatcaccgtcacaccacatggagttataaaaaaacagtcacatacaaagttttgtcagaaatgcaacagtatttatccataccacacgagagcgcgtgctgctcagctctgtcatgcaatgcaacaggccgtgccaacgtccacagcccaatacatttgtgtggtcaattggcccagaacatgtacgagtcgctgaaacccagtgccagaaatagcccttatccacacaagccacacacagccagtggctccaaggcggcacggcacggcagcttagccgcgcgcgcgcaggcgcagcaaacctaaaaaaaccaccaccacccacgcaacacaaacacaagccaagccaaagccaagcgaaacagctgcgcgcagcatggcaaccacggcgtccccgttcctgtccccggccaagctgtcgctcgagcgccggctcccgcgcgcgacgtggacggcgcgacgaagcgtcaggttcccgccggtgcgagcccaagatcagcagcagcaggtgaaagaggaggaggaggaggcggcggtggaaaacctgccgccgccgccgcaggaggaggagcagaggcgggagcggaagacgaggaggcaggggccggcgcagccgctgccggtgcagccgctggcggagagcaagaacatgagccgggagtacggcgggcagtggctgagttgcacgacgcggcacatccgcatctacgccgcgtacatcaacccggagaccaacgccttcgaccagacgcagatggacaagctcaccctcctcctcgaccccaccgacgagttcgtctggaccgacgagacgtgccagaaggtctacgacgagttccaggacctcgtcgatcactacgaggtatactacgcaccgtaactcataggcagaattggcaattgcaaatgcagggtagcagtagtgtacacccatggtctctttctccaggtggaaatgttagttgtaagagcttaattggtagtacctgcttaactgacctggattgaatttacagggcgcggagctgtcagagtacacgcttcgtttgatcggatctgatcttgagcacttcatccgcaaactgctatacgatggggagataaagtacaacatgatgtctagagtcctcaatttcagcatgggcaaaccaaggatcaaattcaacagcagccagatcccagatgtaaaatagaatgcgtgttgtaccctaaagagaaagcatgtaactatcaatgattttcccgttcaaagatgcccaatgtatattttgctcttccagaagagccatgagctagggtatttccgaactcaaatcgggttcatacaaaagcagaacattcacagtcgataataattttgtcgactccaacatggttacataaagagaagctgagcaaactgagggtattaccctgtcgtgaagactaaggaagggtctagcactctagtttcatggcatttccgttctatggtttttgctgagtattagcggtgtgaaaatgtcgatacttcaggtaatccaatcacattgaaataacaccactgctttattgctttatgatggtgagatcaggtagaacatggaatccagccctcaaattcacaggcaaaactcaatgttaaattatttgcaaagaggatgtgcgcatattccaatagggaattatttctcgatcattggcaatatatttatttatctcattccatatagatacgagacaatctctgctgatgacattacgtcacccttaagagagtcattcccgcaaatagatgtttaatgttttggacttgagggtttgaccagctgcaatgtgtaaatctcaatcgatcaaaggaataacctcgtggtctttagaaacatcaacccatggcctgaattgatcttcatgtgcattattctgcaaaagagtgtcatacaattcaaaaattgccaattacaaaactgcatctcaatctttttttagaaaaatgccatcgctgcattaagtactaatgtcatcatgctacttaggtagttgtgttgtactaaactgcagagtacaattccacgcagtaagaaaatagtactattcagtaatgctgcaaataaactgtttacgctgctacttatatcaggctcacctagactgatcttaaaatgaactgtatattgagcagcaaatgaaccatctattccgacttagaaaaaaaacatctataagttatcgaaagaacacatttgctctagcaatagttctatgtggagggactaaaagattttgatggttaggtaagtcttgtgcataagaaagagatggtggcaagtacaaactagaatcatgaaagcaggtaattcctacactgtttatttattaagaaaccaaagcaatattaatgaggttacctgcaaccagaagaaaaacccacgcatcagagctaaaccatttggaaagctagtgtgcataacttggtcaacgagatctaaagttaaataaacaaaaaagacatttgttagtgcaataaccatgtagaactgccaacagatacattatgtaaatcagccagcaatacgctatgctactagtttatagtcaaatttaaaagtggcaatggtgtttataagcaacaacaaagaaagctaagtgatctgttgaagataaaagaaagcttctcaagaaaaataaaactatcactttcttaatatctagttttgatcttggtatggatctctgcatataagctcaaagtttaagcaaaccaattgataagctgacactgtccatacactgccgctggtggttttaaaaaacatcaatcaaagtgctcccatatctgtagatatcttgggcacagaaatactttaatactgagacttggaggttcaacactctagtaaaactaatgcagtggcaattgttcaaaataacatggcatgttttcttctggccttgcactcactttttcctttcggaaccattagtcctacaagcttatttgcaaaattaagtacatcaaaatgttgttctaagatcctatgcctacaactacactccagagattaaaccaacacatcaataagctattttgactgtatactaattggtcatgaatgtaacatcttaagaagaaatttgtaaacttataacaaacagttgaacaaaactaacatcaataagctattttgactgtatactaattggtcatgaatgtaacatcttaagaacaaatttgtaaggttataacaaacaactgaacaaagggttaatttgtaaggttataacaaacaaagggttataacaaactatacttaacttgcaatgtttgagcgagaaaactatgaacacatgtaaccataaattatggtcaacatatattcacaaagtgcaaatggttaacagtctgtaacagaatattaagattatccatggatttaactttacccagttacaatgaccataaatataattctgaggaaaaatgcaatacacaacagaataaccaaagaacaaacaacacatgtaaaacaatatatgtgcacgatacacaggcatacctgggtaatgatcaaagtatgaatttcccatttcctgtgtagggtagaactttacatcattgcgcacctgccgtaattttactaatggtgtacgaatagaagccatgtcaaatagcttaatatattcttttcgactaaatggtttgctgagagcatccaataacctctgcttgaaatctgaatccggtctactgttgatatgtgccggccatataacaccttgtgacccctgcatattataatatttttaagtaataagagaagtgcatcatgtaaacaagaggagaaaaaacccttatagtagattttattgtttgtgagataaatgcaaaattgccagatcaattggagaacaatgaaatactttagcatgtacattacataaccttagtatttgagactaattcttctttgaagagtccatatgggtgttactgttactgttccataattcaagtaggggaaaatttgagaaatatcatcacaaagatatgtgagcctggaccctctcgtgtcaatgacacatccgatggtatttttcaactcagtgatttttgcggtggtaataggcaaattggcccataaagtggaggggatgttcagcgtgaatttgctagagaatagtgttctggttggtacaatacagtatcagcttattcatacatgtccatcaacaggccttttgttgaatcgtactgaaatatcgaagactactatcatcttcttttgcgtatattctattaggcgaaaaacagagaactatttctggactgaaaacgtgtatacgctgctcaattcaaagaaacaacagtgccacaggtaacaacgattggagatgtataaaaaattctcaccggggggatggaagggccggcattattggaattgcttgaactcatcttcctcttcttcttactatctaatgttcgcacggatgcgtcacccaccgccacccagtcgcatacttttgggtccggaagaattaccaccggctcgtctgaatccatggccacctctttctcccgcgcatcctcgacctcgctgctgctctcggaggacgcggcgcacgggtaggtgacgacggcgccgtcaatctcgagcaccatgttgtcgttcaccacgcgcgtgtgcttgaggaagaggcggtagtcctcgtcgatgtcgacgagggagtcgatccaggagggggcaggaggctcggcgtccacctccaccgacgactccttctcctccggcgggcggttggtgctggcgcggccaggggagggatcggagacgcactcgccgtcggtgctgccggtgtcggcgggggcctcgtacttcacgagggaaggaggggagacgccatcggaggggagctcgagggtgtaggagtcgccatcggggcggatgtggcggaggaagtagaggtagtcggggtcgacctggtcggcggggtaatcgccggcggcgaaggggaactgcatggcggggcggcgaaggggtttgggctcgactcgaggcccgccttgggaatttggagggctcctctcatcttgcgcctatggacgctcgcgatttattggtggcgccatatgtgggggtcaatgaatgactgaaatttaatggtttcctgaccgaattcagctatcacgcagtatatttatggaagcattgccctttttttatcttattattatggtacagtgtaatactgtaacttggagtaaaaaatttacggattttttgtggttccagacaggctcgaccgctcgagtggaataaactggaggataagcgggaatcgttttgtgctcaagttcttttagtaacaggaatcgttcgcatacgcaacagtacatcagcaataatgtttgtaatttttccaccggtacaacatgattaaaaatgtctgcatattcaaaatgcaaagttcagaatttgtaatttttcaggtctgctcgtcagttcaaatgtttgttgaaactggtcgatgaagtgtttgcactgcctgaattttggttcgctcgaagttgctacctgtatttttttcagaaagagagaggaaaaccgcgaacaccaagaacaacacgaaaaggccatcttttggtggaaactttaaatttccaacaaacaaatcggacttctatccccgctaaaaaaaaatcggacttctatatccacacaaccaaaagttacatgaatgtttagatttcgactctcactaaaaaaaatattcatgcgttgcaacgggtgaagactattttaatttattattattatattatttagttaagatgaaattcactgtgttaaattcgcttagatatatatttttgttagaaaatcataagctgcaattagatgtccgatcgtctcaaattagtatgtgagtttttaaagtgatttcttatacgatttcttatgtatttctaaaagcgaacgaacttaaaaaccgaaaccggatttgtattttcaaaagcgaacggacttaaaaaccgatttatacacggatgacgtactaaaataccagtaaaatcatcttcaatttttatatcgactcttataaataagaaatgacgatgaaaataagaacagaacttgaagactgagcttcgaatctatgcttcctgatgagtctcgccacatcaaaaacctgcattcagtcagtcttaatacgcagcccaaacttctgcagtccttatttgtgttgcattcgagttttcgatgatattcgaagaggagaaccatctagccctgcagctctagtctcatcgcccctacgactcccctgaaccctcgactccttcccactagctcgccgctgcctgagcacaccgctggagttccacgtgggtgcaaggatggcggcggcggggttcctttcagctctcggcagccctctatggccgcttcttgcgggcgggcaggagcggcggctaggcttcgggcgtggcgtcggcaggtcggctgctccggtgaggacggcgtccggttgaagcggaactcgcgactcactctcctagtggcagagtggcggcaacgctgttggaggtgggcggtgggccggtggcgctggctatggctggtgaagcggtggtgttggctccttctggtggggcggcgcggtggtgatggaagcggcagatggacggcgtcagcgggggagtggcgatggcctcagggtagtaggggacggcaggtggcatgccgctgctaggcagttggcagcgccacggcggattcctctgcgtgtggcctgtccccttcgtcgcgatggtgaagatggcgacgaaggacaaaggtatgctcaccggcagtggtggtcctaggggcagcggcttactggtgtgacctttatgcctagatctagccatgtgattgttaagggcgacagctgaggtgttctggagtcaacggcggtggcctaagcgtcgccgccgtatccttggcaaggagacggcgggattgggtggaggtggtatcgttcgcagcgatgtctagcaaaagcgcctgggagtccgggcggaagacttctccggcggcgacggctgccctaggggtagcgatcgaaccgagacggtggcggcctgagtgccggtgcaaggttcgcagtgaggaggcggatcccgttggcggtggctgccctaggggcggcagatgcctgggagtccgggtggaagagattttcctcaacggcagctgcagaggtctccgacgacggcccttggggcggcgacgagctgggagtccaggaggtggaggaggatcccgaagacggtggcggccctaggggcggcagaggcctaggaattcagcgaagcggaaatggatcttgccggcccgcatttggttggcttgttttggctgggacgacggatgaaagtgggctaaaccaggcgacgtttggcatcaactcatatgaagcgaatgaagatggcatcaacggaggctcgcaacgatgatgcactaggagcgttgacgactagacaacttccactcgccgaatctcgttgttttaggagatgatgtcggaaagcaaggatgtgtcagggtagttggtttttccttttcttttagttttgtgttctctcttgagatgtgagtctaagtgctcttgtatatttttagctgtgtatatccttcgtgaatatagaggccggattaatgaaaattcattatctaaaaaattggtgttgcattcacctctaacagactcctttgcactacttctaccttcagccaaatctattcaatcctgatccggcggcttccggtccctagtgccttagctcaccgacggtatccagtgaaagcagagaagtccttccaacgcaacttgccactttccgaatgagctcaaacaaaacacaccagatcaagcaacacttagacccgaaatctagtatcgcgtcccagccatcgatcgtagtggcaaccaaaccgtattctagtatatatgcttattgcaaacagatcaccccggaaaaatggtaaccgtgatgatgctgtcaagttggtgcgtcaaaggctacctatagcaatcaggggccattacgatggcttgattgacttctttagactgatgtaattaagcaggccagctagcttccaattagtctagttgtccattgtttccatttgtatcctttggtcccatttgtactgcttttacagttttatagtagtccatatatagatgaatttacttatggcgagagcatctccatggtttaaagaagagcttgtataatcacggagcgttgccacaggaaagatcaagcctactccatctatcccataaaaaactaacatagtaatggatgtgatattttctagtaatgtcatctccaacattatgttggttttttaagacggaaggagtacacttgagtaatataggatgataatggatccaatattttagcatataaaatgtaaggggataggtttaaaaaaatgctatagtgagattcaatagacttttgagctaaaaatatttaagagttgagataggtgtcccgtgttaaagaacccatggacatggtccctgtcccgttaccacccaacatgagacgaatgattgggccggaacgggattgtgagcatcgtgcggtccatataggaaagtttatattggttgggcctgttcgagctgtactagttgggccggaatagtatcgtgagctacgcgcggcctataatggtatcacaccgacgtcgagcacgcagcatggctctcaggctccgaaagggctaatcggcggtcactcacgcgcgccctcccgtgcgcgactggacacgtgtcgcgcgcggagagggggcgcggacggcacgcgcagggagactatcgatttttccggttttttttctgtttctgtttggttttttccggttttctttcggtttctctttttttttgtgtttttaaagatatatgtttgcaaagtttatattcgtatgtatactaaattttgtattcgcacgtatacaaagtttgtattcgtgatttttttctctcgggttttaatatgtacatatacaaagtttgtaccgttttttttttgacaaattagtccttttgaaaacttattttgaaactaaccctcgtaaaaaacttcaaccaaaaataggtcgtgggctcaacgccaatgttaatggcgctaaggtccaagggatcagcgccacattcgttggcgttgaacccgtggccacgtggatccgaagccgttctgcattctgacgtggcgcgaggtcagcgctaactctattggcgctgaactcataacccagcgctaactctaaacaatcatcaatgctaatgtagcgcggtggtgtgccctctgtgcatgcaagcaagaggtagcaggttcgactagtttaccgtacttttgtcctgctagcaaatctttttttttgttcttttcttccggcacttcccctacattccgaaataatactgtaagaaaaaggagataataatatgagaaaaaagaacggaagtatactaatataaggcgtgcatgcatacatatcattaattagcacctctttttcactaaaatattattatttaaatcatccaccattaagatatctaattttattgggtgcatacattttatttattaggataatctaaactatgatatgataacaattatttcttggtatttgaattaagggtggttgtgacttatattttggaatgaagggagtatatatttgaatgtaccattggagtatatatgttagaaatagtaacgtgggaaaaaatgatggaagtattatatttatttttgaagtattggtccagaagaaaaggacggtaagaagtatactacatatttgaaggtaccattggagtatatatgtcggaaatagtaacgtgggaagaaagataatggaagtattatatttatttttgaagtatatcggtccggaagaaaaggacggtaaaaaagaagaagtatactacatatttgaatgtaccattggagtatatatgtcggaaatagtaacgtgggaagaaagataatggaagtattatatttatttttgaagtatatcggtccggaagaaaatgacggtaaaaaagttgcaataaaaatagataatttatgctgctcaagggagtcaaacttgttacctcaagcttgcatgcacagaggccacaccaccatgctacaatagagttggcgttgacctcatgccacatcgacaaatagatcagcttcggatccacgtggccacgggttcagcgccaacggatgtggcgttgaccctttggacctcagcgccattgacattggtgttgagctcatgatctatttttggttgaagttttttgcgagggttagtttcaaaataagtttttcaaaaggactatttgtcaaaaaaaaacggaagtttatatacacgtatgtaaagtttgtatatgcgtatgcaaagtttatatacgtgtatattttttatacgtcaatttgttgatacataaaaaaattatatatatgtatgtatatattttacatacatacatagaaattttatattgatacataaaaatacaaagtttctatgtgtatatataaaatatatacatacgtatatatacatgtagtagtactgttatagtaatagactaatagtagtagtgctagtagactagtagtagtactaatggactagtagtaggagcctgatcgcgcaggggttagggcgcgcgaccagtgggcctgtgggcggtgtccatggccgccggccaatctttgcacaaaccgtgacttcatgagggagatcgctatgttatggattcttcaggatcagcaccactagctctcgacatcatcaggcgcgggtcgcgcatgcagctcgtgctcgcccatctgccgtgtgccggcgagtagctagctagctagctgcctggctagctgggcagggtcgccgaaccttggaattggatctagctagctaccgctcaattggcagctatgagcttgtgattgtgtaaagacgatgtttcgtttttattttatttctggtcatttattccatgtgtacgatcgaggcgcgagtattttcgtgtaccaagtgatacacaaacagcgccgtacgtgttgacaacagctttaagctttttacagatccagctattgtacgtgtgacgtgtctcctcagtcatcagatcggcatgtagagcgcggtcgatcgagatcgtacgcagcttagagatggcttagccgcggcaccggtacggcggacagccgcactgctcgcggcgcggtgagcccatatgtctcctccatgtcgagctcgccggccgaccccgtcccgccgggcaagctccagtcgaagccgtggagcagcctggccagtgctagctccaccgcgagcatccccagctgcatgcccgggacacctcccgcaagctccagtcgaagccggagagtgattttcatcgacatgccgaacacgagctcgccgacgttgaccaccgcgccgctgttcttggtcacctcccgcaggaggctatcgaccccgtcgtggacagctgcccacgacgcggcccggcgccggttgaagagcctgttgatgcacagcttccgcagctggcgccacaagggcccgtagcaggggcggatcaaacgtgggtgcaagaagtcccccctacacctacaaaactcatggatacccccttcaatttttttttgccaagattggtaaaataggatgtgttaatagcattttagcatagtttaatattgagatgaatgtgtttatacggatgtactcgatatgtttagtcccccaactttttatttctggatctgtctctggcccgtagggggcgaacaccatgtcggcgcggtcgtatgtgaggtagtcgatggccgcggtggtcgggcggtcggcgaaggcgcggtcgtttacatggaggaccagccgggccatctctggcgtcgacacgaccacggtgcggaggcggccgaggcggaggtggaggaggccgccgtagcgcgaggcgagctgagccaggccacggtgggtcatgtcgctggtatgcaggatgttgccaacgaacggcagaccccgcggccccggcgggagcgggaggcatcgctcgccacagtgccatgacgagaccgtgtgatagaggagaagcattgttggtaggagcacaaggagaggctgccatgttggaagccaccagctctccattactgattgttatttgctagctagctctttgcctttctcgtgcctagatggattgatcctcgtccgaatgagaacgaagacagatggggagacgagagaagatgaaacagtggcctcgttggtcttacggaggatggatttccatggagcaattgagtgttcattcaagccgccaccaccctaggcgtctccctcctctactgcagcagctgcaacccaccctgaatagatacagaagagaagagaggatatttcgaggagacacatagcgaatgtgcatgaaggagctgaatgcaaatttgcatccaaggtgaacatccatgtgggaaacgtacaatggacctaccatgatacatcaaaaccaagtccaagatatacgatttacaagatcgtggacaaagtgatatcacgttgcaactttaaggaatggtgatgtaatttactttacatgaaagtatgtgtgtacatcatgtaggagaagtcccatatcacgtatctttatgtatctgagatatcccatatctaatataccaacatataaataggtagatgcatatgtcaggtgtatgcatgcatagcttgtatggacaaagaaatggattataaagcccccaactagagcatctgttgtttattgtatgcggtccacaacgttataaaagatattaaaaatgaataaatttatcctatgacaaattctttcacaaacaagcaatgttaccgacatatagaggaatatataaagaagaaaatcaactgtaaataaatatttttcttcatatgtccacgtaaatttaatcctatatttcttcatactttattactactttaggataacttatattgcctatgtttttttatatatatttcttatctgttttgacgagcgtcatcgccagaaaaaaaaaaagaattgttttcacatggatagcgtggttatgaacttcgatatataggtgtcgtctctgtcggaactcgggagagctctacgttggcctacttcctcgtttatcggaagaactctgttagtctggttgatcaagcgcactgtgtactgatgtttctaggcatgtttgtaagtggttatcacaataattgttcctttctccaaatctccgaaacgatcacatgagatattgagatgctttcagagtaaaatggcactgcaagttacctcccagaacaagtaatataccttgttagtttttttaataatagaaagaatttacatctaagctacagctcctgcctatccctgtggtaagacatataataaccgataaatttgttttattcaaataaggtgataagataaaatccctaacattcattgagttttctagacaataattctactgaatactatgttattgagtttagaccctgtacacacagtaatctgttgtaatgtttgaacctcctaattaaattttgctgggcgccccctgaattttgtttcgcacgaggcaggagtagctgccacctgaattaaaaaaccttcaagaacagtttgttgcaatgggaaatatagtgcgaggtcagcctatatagcacaattcaacggaaggataagctcaattgcagcaaaattaatctgaaagcaatgggacccctccaaatgcaaacacttcgactggctgttgctgcaaaataggatttggacagcagatcagctacatatatatcagataatggtcaaataactattcctgtcaactatgctataggaacctagaaacatctcaacgtctcttcaaggattatccctttgtacggtaggctagggaagctgaactgcaatgaaattgacctgacacatgatgaaaatgaatcactattgaactggtggatcatgagaacaactcaaggtgggaaagacaaagccaaagcaaaaaaatcaatccacatgctggtagaatgggagatatggtgcgagcggaactgaaaagtatttcgaaatcaagaaaaaaagccctgctgcagctactagacaaattcatgacgaagtcaagctatggagaatatgtggagaaacaaacattgcgagattatcggtataatagtacttttgatcgattatattaatagttttcctctctcttctttttcctcctctctttctttttcttttcttttacttttcttttcattctatccttcaccgttagtgattatgtaagtagtttctccctctacttatgctggctcggttttttttttaaaaaaagaaagatattgagtggcttaaagtggcataaatctccaacagtaagcacgttgtcgttttattcttttagataatggaagttgtcgttttctataatgatcaccctaaataaatctcttgcatcagatgatgattccctagaaaattaacttgccggctggtatgccgtgtggactgctatcctgccaactcgcttgcactgtgtcatcatgtatcggaacttgcacacggctgttcatgcatgcgaacttgcgtatgaagctgtggcgcatgtgcgacagtgacgtatgatctaatttatatattttaaaatattcgaaatataacaagattaaagtataaattaaataaatatctctactatttaaaaaaataagaggggcttccatcgtccgtcaaaaaaccgggcgaaaaaaaccaagtttgtctgatcaaaaaataaccgggcaaaaaaagtgcgaaaaaaaaccaaatatgtccgatccagaaaaaaaggcaaaaaaaccgggctagaaaaccaaaattgtccgataaaaaaaacgggcgaacaaaaacgtgggaaaaaaagaaaagaaaaaacaaaatagcgataaaaaaaagtccaactcggtcccgtaaaaaaatagagataaaaataaaaaaaagtccgactcctcgttgcgattccctctcataagaaaaaaaaagttatctgagtcccactcctctcggtttgagtccgagatactaggcaacacttttcttggtttcaatctataccgtgatattccatacatcttggtgaaaaaaattgatgtgctagattgaagatctgtttgtaaaaacggaacctacatgtcgataacattctatttttatatgatttcaatatttggggttgtacatttgcatttgagtccctataatttttatatttacatttgagtacctataatcttgcaataacatgcttttggtctttttaaaaaaaaaataaataaaagggatataacaaaggcagaaaggtgcataaaaagaaaaagaaaagccacacaaaaaagaaaaaaaacaaaaaaacaacaacaacaaaagtctatttcccctaagtggcgaaaaaaactgtagatgcaaacggaaaaaaaatccgattcctataaaaggcaaaaaaaaaagtggtgaaaaaaaacgctagatctcattcctttaaaaacagaaaaaaaaagtctaattcctgtaaaggcgaaaaaaatccgaaaaaaaattcgtctgattccctaagaaagtggcaaaaaaatggttcataaaaaataaaaagctagttcatataaaataaaaaatgcacgcgagaaaaaaaatagaaagggcgaaacaaagtccaatttctaatcagtataaatctcgtctctatctctaatctaatctaactatttaaaaataaaaaatgcacgagaaaataaaaatggtcaaaaaacgtgtgagaaaaaaagtcagaaaaaagcgcaaaaaaacatgatgaaaaggtttttccgtcttcttaaaaaaataaaaaaacgcgtaagaaaaattatttccattgtcggcaaaaactttttaaaacaacatgcgaggaaaagactgtctgaaaaaatgcgccatttctaaaaaaatggtttgaaaaaaccacggaagaaaaaaacactatctatataaaaaaatcactctgaaaaataggatccatgggctgcaggaat

SEQ ID NO: 9201 - DNA, 14114 bp, Oryza sativa
ttttgtcagaaaaataggcaaaaaaacacgcgagaaaagcaaaacaaaaaaggggagaaaaatatggttttcgtcattagtaaaaaaaaggaaaaaaacatgctagaaaaaaactgttagaaagaaatgcgctatttgtaaaaaaatggtttgagaaaatcgcgcaagaaaaaacaccgtttataaaaaaaagccgctcattaaaatacaaacattgtcattgacatgattatgcatgaaaaacttatattatcattagatttttttcacccgttgcaacgcacaggcatttttgctagtatattataatattgaagtataaattgatcgagtatgcatcataaaacttctctcaagctctcctgccacgcatgctggaagtagaggaggagcaggggagaggggaacgatgggaggtggaaggagcataggcatttttttttctagcttccctctcacttagatgtgaactccatatattttcttgatgactggacggtcatgtggatgtcgcgtcaataaaaactgttcttagaacagttgagtaagtcgttttgcatggttgtagtagttggaggagttagtatatccggttttgccgttgagtaatacaaaatagatgcaacttatattaagggagttatattggacttttctcctttgtgagcaatattgttaggaaggattgcaattgggccctttacataacctacataactggcccataaatagcccaagtccaaaagttctcctctcttaagtatagcagccttgacacagaatattttgtgttgctttcttgattctcattccaggatgagtggtactccctccgttttatattataagattttctagcattacccatattcatatagatgttaacgaatctagacagtattaatatgagcaatgctagaaaatcttataatttgaaacaaaatgagtactttgatttataccaatgaaattcgttgccaatggtgggcttttgcattgaccagcctataacaaagctggtccagcatctcaacgcaattgtgacgcatgaatcgtccaaggaaagtctgcactgggccaaaataattcagacatttcagtggcaccgccagctttgtcttgagctcgatcgaggagcatggtttcagcttgaccttttatcgcgtaatttaactcatgtcaccttgacgatgttctttaccacggctttctcacagtctgattgcttactgcaggtagtacgtgctcacttcgcaacggcgacatcctctttgcttgatgtgaaaggcaagtcaaatggaaggatcgattttgatggcatcgatcgcccataaaactcccactctagcgagcgcaccaccaggagcggagctagagcgaaacagagggtggtgccacttgcttaatttactctactttagattgagtttaagctgatacgagtgtctaagtttgtattgaggggagtgcatacatggtgaaaatagatgatgtatagctaaaagattttcttgaccgggttcctaggcacccccctactatatactagctccgcccctgcgcaccaccaccgcaaaaaggaagctacggaagaacagccaccactgtatacatccccatccccgtccttcctccttcgacgtaacaaggccatgatttgtcctgcaactgcaagcaacgagaccaaaagcggccggaatagctgggtggaaaaaggccgattttcttttttggtgtcgaactgatgtgcgtgattcaacaatcgccgtcgagtggcaaaagcacagtgcatgccaacgacgccacgcccgcgtcctgtgtctaatgcgctgatacgcgccatgcatcccttggcgacttggcgcctttctttcttttgctagagaaaaatctcttgcgatctgcatatctggcagcaatccagaaataataatgatgatattaaacggtataaaaatgtctataggtaaggtgcgtctgcgtgcacatgactgcgtccgtattttgcatcatgcctgtggaaatttaggaggtcgtcattctcggcactgatcacaacagctataagatcaaggttgttttcgcacggcgatgtcaaagctgcaaaatcagcctgtacgaaaaattgcgaaatcaacaattgaccacacacatctctgtagcatatcgcatcgccacaccggcaggcacaacgccttcagcgcagtaggaaagggacgtgagcatggtaagtggatatgtacgcatcaatttggcacctaagctccccggcctactactggtaactggtaagtggtaaccggttgcacctcacacggctcgacagcgaaaagattcaaaagcctaataagatcggtgccgactggatctttgacagccacgaacactactcgattgtgcccacgcaccgcagcccaccgcaaaggcccaaaccgaacggcctcgcgcggcgcgacgtcgcgtgctctcggcgcggcggtggcccgcgtggggcgccgcctccgacccgccgcgccattcctgtgagttccccatacggccataccccatacgcggtgaagggaacaccgaacacgtcaactcggagcccatgcatgcggacgcagatgcgtaggccctcgacgcctttaaagtttttaagcaaatctatggatatccaccgtcaatcacgtggtgggagccgtctagatgcatcgtctcttatcttagtttggcccgtcgaatctgacatcccgatgagtttgagctttcatcttcacaacatttgtcatccatgatgttttggctatcgttccggttggccagtttactctgctgccgggattgtattgacgatctcgaatatttatctgcatggttgtctggtcagtttcatcgtgcccctatgctgattttttttgtcgagtttgtcatcgagaattttcctgtccacggaaggacagaaaactcggcatcagattaccctcctgaagattgatcctgtatttttgtctacgccttctgaaactgacgacgaatttaatttctggaacgcactgttttgttgccaaatcgtggtcattcggttaacagttagcatcgtgtcagcgttgaagaacataatggaatacttgcaatcttgcacacagaagtttaacgcgcggggatagctacggaaaattcgcgagtagaacgaacatggagccaggtactgtattaagtagcccaaaaacctcgtgagaggcatctgttttgacgtacaaggaaagtatgaaccgacagccatacttacggccgcagtagtagatgtacacgtactgcgcgtacgtacgaccctgcctcttcactattcacgccatcgtttttattccacggccgtgcgctgctgatttacctcgcgacgagggcaactctgagctgagagacgactattattattactcctactactccgtggtccacggtccatagggccagctccagcccaaacccacaccgccgcgcggccgtcctctctgcgcctttaaaactgctttacgtcgggcggtgagccggcccaagacccggtccacctctcgcagcccgagcccacctgccgccaccgccgcgcagcgcgtgtccgtacccaaccaatccagtcacgccacgtattatccgtgacgcgtccagccggccgccaggtcggatgacgactcggcggcaggtacgcctcgcggaccgcgcccgttcggctgacacgcgggccgctgctgctcagatgcgttgcgtgttgaggcgacgtgctgggtccgggccacccacgtcggcttttttaactttgcccgcgccgcgagagaaggcatcgtcgtcgcgcccaaattgtctaaactgccccgctcggctcgtggcaccgcgcgcgaacggtggcccggttgggcgacccgagagccgatgcggtgtacccgccgctcggatgtatttttttttcctttcgtcaggaagggtattccggtaacttcgtgtgacaatggaaacgattagtcaattttggcgattcccgcgacccgctccagcatacgggcgtccgacgaagaagccacgcgacgcgagtgccgccgcggcaacgcgtggaagccgggccggcgaaggagggaaacatttgaactgtgctaatctctctaataatggctgcgaatttctactcaatactattctcatttacgctaacgtggtatttgaatcttctaaaaataaaagattaagtatttcacgtaaaacaagatgataataacttgtgattaattgagttttaattattataaacttgaaaaatatattaatttgaattttacaataactttcatatagaaatatttaacacaaaacgaaccgtttagcagtttaaaaagcatccaattaaaatcttaatcttcatccaacttttattgaagaaaagtatcagacctactctctctgtcccaaaaaagacaaaccctggtttccgtgtccaacatttgaccgtccgtcttatttaaaaaaattatgaaaaaaaataaaaagacaagtcacccacaaagtattaatcttgttttatcatctaacaataataaaaatatgaattataaaaaaaattatataagacggacaatcaaagttagacacagaaaactagagttcgttttttttttttttttttgacggagagagactttagcagactgttcggcaacatggttcggtcgctttcgatgttccctaaaacgatggatgaaattaaaacccaatactcgggctgcctgtaaggccgggatgcttcatctgaatgtaactttttgtttggtttacacaaagaggaaaatatgccgtcagtttcgtcacaacaaatggatttggaaaatcgccgaaataatatttgatatgttatacaaacaacccttttatgcgaagaatacaaacatccttttgtgggcatgcttgtttgaattacgacttcgaagtcgatctccaattttaaattatacagtaattttattattattgtttacttagcattagtattttaaccgttagtacaaaagtcttacattataactacttttcaataaaattttactataaaatataatcactttacgatttaagcagtatgacaccacacatatggaaacactctaagaacgtaaagaaaatactattaggcaacacccctataaatttaatatttttgggtagataatggggagaggaggcaaatgtgtgtatcagtgtatagaaatattgcactggagttacggtgggttatgggaatgaaaaatggcttcggaagttcagccttaacgaggggtttttgatttccagttggagcattggaggatgagcttaggttaagtttcccttagcaactagagaggaggcagaaggggatgacaaggcagaggagccatacgagagatgtcttgggtggctaagcgtcaactagtaaaacgacgaggacagcttgaggtgagcaggatcatcgaggaacgatatgaattcagctagtcaatgtgttggtggtggcgtgacggaatgacgcatgcaaagtgcctgaccaatgatctagagtgttttaaggtggcgatgggtcgatggcgaggccaacatttataggcgacgagggttaaaacacgggtcctatataagcgacgaggatgatggcgacgccgatagcatggaagcaatgctcaaggtgaactcttggccacggatagtcaattggcttggcatcggtgacagtgtacggtgggtcgatgtccgagttggtctaagtggaaaacacaaaggacatttacattcttttttcatgtgcgcatgtgccccttctctcgtcctctacttgaaaacattaattaaattaacgtgagcgatgtctaccatgaaattatcatgttttcaaaaatatgtttaattttgcaatatcatacaaccaaaaacatttatggcgttatatagcagttttttctttacgcagatcatgtgtttttggcttttaactgttggctcaaaacttccttcccaacatgcacattgtgtacttgttagttagaaaaatgcaaatcctatatttctatgtagggtgaaatggattggatattatccgatccgatccgctctgaaacgagtatatggtatgtgttctagaaatttagcggatgcatattatccgatatttctattgaattatccgataggccgtttgttgaataatactaagatttcttagtcagatactttcaccgtctatctcacacttatttagatgtatttctatattacacatatcatgtattcatgttgttagcacttaattacacaattattattatgatgggtcgtttattgattattgcatcgttgactttgcattgctaactcaatcgtttattacttgcatacacatataacatccgataaatttaatctatttctgatccatgtctgcgccgatcctgcactattttcgacagccgaaacaatccatatccgctcactatccatatctgcctcgaatccgtttaacaaatatgtttaggatatggtatgatcaccatacataatccatttcgttttcacccctatttttatggagacaatttgctgtgttcgcagaatactactattaaagcagccgattaatgtttgaatggtttttccaagccaatctgtaaatgcatataggtatttttagaaggatggacgtatatatacattgattaataccaaatcctcagcacatgaataattgaatacagcaacagagccctggcaaagattgaactggaagcaaacccacccatcccgagcaaaatccaatttgaacctttccacaatccgcactcacatttcaaaaaagacgccatttatgatttacctccaaaagaagagaggcatcagtgcctcctggccccaccaagtgtcccccccggccactaatccctcgcttacttttacccaaaccccatccgttcaatcgtccggcccagcccacccccgtcacgcacactaatcgcgaggcggcccggcgaggcggggcggggtagaccggaaacacgcaaacgctcccgcgcgcggcgcccaaagtctggctgtctgggggtggctacggttaccaccactgccccatttcacatttcacccctctcttttggcttcttcgaaaagagggcgtatacaaaaagggagagtgatatcagacagatgagattacgaagtggcaagataggatttaaaaaaggctaaaaaacaacttaaaaaatcaaagatagaaagcagtaagcaccaagggcagaaaaagaaaagaagaaaagaggaaagatttggaagggagggaaaaggaattggggaggagtaaaatgggagaaaggtgagggtcgaggggaaactggcgcatttgttgtgggcacggactttggcagccattcaatgctccaccaaacgctcatcccttcttccaccctttccttcccctcctccgccccccctctcgcctcctctcctcttcgcctcaaaagccgccgccaccgccgcccagggttccaacacctcccgctcctcctcagccatgccgtcctacgcgcaccaccacagttctctggtaaggaagggagcgttagcctcaggagacgataagaaaacgactcttttataattctttgatgggattttttatgggaagggggatgacgaggaggagaacgggcgtttcttgagcctgtgtttgcttggtttctggaattttgggaatttatggtttttgctgtgtgtgtatgtgggtgccttttggacggagaaggatgggaagatggacgcgctgaaaagtagttgccggtcggaggaggcggccgacgagggggcggccgcggcgccgtcggcgtgggggatggttgagagggacgggttctccgtcgaggacctgctcgacctcgaggagttctgcgaggcggaaaaggacgccgccgaggagaacgagcaggcgctggccctcgtcgccgcgccagaggaggaaaagtcgaaggacgactcccagccgtcgtccgtcgtaacgtacgagcttgtggcgcccccgccgccgcctccggagattgttgacctgccggtgaggtttctcgagactctcgttgaccgtgcctttcggcggaaaggctgcggctttcgcgatggttgtcttttttttccccctgtaattaatttcttgctgtgctgtatggtttctctgcaggcgcatgacgtcgaggagctagagtgggtgtcgcgtatcatggacgactccctttccgagttgcccccgccgccgcagcctcctgcgtccgtcgtggcgtcgctggccgcgcggccgccgcagcctcggcagctgcagcggcggcctcaggacggagcttaccgcgcgctgccacccgcgtcctatccggtgcggactccgaccatctgcgcgctgtcaacggaggcgctggtgccggtgaaggcgaaacgcagcaagcgctctcgggccacggcgtggtctctctcgggggcaccgcctttctcggactccacgtcatcctcgtccacaaccaccacctcctcgtgctcctcgtcggcttcgttctcgtcgttctcgccgctcctcaagtttgagtggcacccgctcggcggcacgtcggacctcccggacgatcaccttctgccgccggggaagaagtccaagcacggtaagaacggcaagaacaagcctaagaagcgtggccgcaagccgaagcagctcccaccacatccctcgggcgcggcggcgtcggcccccgcgccgggcgaccggcgctgtagccactgcggcgtgcagaagaccccgcagtggcgcgcggggccggagggcgccaagacgctctgcaacgcgtgcggcgtccgctacaagtccggccggctcctccccgagtaccgcccggcgtgcagccccaccttcgtgagcgccatccactccaactcccaccgcaaggtgctcgagatgaggcgcaagaaggaggtcggctccggactcctcaccgccgccgccgccgcagcgcccgccgtggcgtcgttctagctaaagcaagctagccaccccgcgcgcccccgcggtggctgtacatttttccagccgtattagtcctgtaccgtacctggatttttttcccctttcttttccagtattatcttagttccggttggattaattagagttaggtgcctttaggtcatgttaggtctaggaattcagctttccggtgctccagctcaaaagcttttactatagtttgttagggcactgctgctgtagcagcagtgcagccgcggcagcgctagcgcagaacttcatttccattctagcttacccgaaggagttttttttttctctgaggtagtacctgcatatgcttggttcatcaatgccggtgtgattatttctgaggcaaaaggaagaagaaaccaagaaccaaagcgccctttgcatggcgagaaggggaggaagacgaaagcaaaccgatcgccttgttttattccccaaggccaggagagaagagtgcagcacagcacagcagcagtgtgagcgatgacaggttggtgtgtgttgcgtgcacccttggttacatcgcgtgatggtgtcaactgtaacagcatgatatgcttagggggtgattagatggggctaaaacttgttagtctatgtcacatcggatgtttgacgttaatttagagtattaaacatagactaatttaaaaattaatttcataaatgagagcttatctgtgaggcgaattttttaagcctaattaatccataattattaaaagtttactatagcatcatattgtcaaagtcatgttgtaattagacttaaaagatttgtctcgcgaattagtctaaacttatgaaatgggttttgtaattagtggatgtttaatattttaaattagtgtttaaatatctgaggtgaataagtccctgaaaaccaaacagccccttagttaggaggatgagggttgagatagcgaggggtagaagcaatcggcatcagatatagatggagatgttgcatgtttgcagaagtttgtagtactcctgtgattgagatgaggcaggaatgaaactgggaggtagggtcctttgcaagttaatccaagtctagtcttgctgatgcaagtgtgtcctcccactctgccttggtggtgggctctctgtacctggaacagaactgtttgaaaaatggaacatctactgtacacctctacacctcttggggctctccttgcctttgctcaggtacatggcctcgcgtgcgttcccagtagtgtttgtttacgcacaagctttggtgcagcagctgcagcggtagcagtgctcgctcagaacctgagacactggcttctcgtgatcaagcgctactgctagtaccgtgctagacgaagatgatggcatgggagttttgacgggcgcgcggggcgagattttttttgtttgcaccgttgtttttgtggaagtgcagggtggtggtggtgactcactcgtttggacccagctgcattttccgacctaaccagagcggtaatggcgatggtggtggtggtggtggggcaccgagaagatatgtggtggtgaccggccgtggtgaccgcgacgcgccttttcttctactgccgcctcctctgctgccggctgcctcgctgccttgcccggcctgcgcgcgcagccgcgctccacgcacgcacgcgtggctcccacttccactcccacactaaacccgtgtcttgtcttaagcaaccacgcaattgttttcgttttgttccgcgccttcgtctcccctcccctccccactccccagcttggattctttgctcctcctcctttcagttccggctgatcgtacgggctaactttcctgctccgttttcgctgatgttctgttcccaactgactgcgtatctttgcttctcgagctgtctacgaaacaggcagggcaagcgtgatgagtgccttcacgaggacggggattgcgctgtctgagagataaccactacgccaccagaaaacctgtgtcgctcaccggttgatgacaggagatttctgtagccgtgcgtcggggttcagtttaagcagccggagtgcccgggaatttcgttccgaggcagcttgttttcggtttggggggtttttggacggatcgtgggcaagtcagactcgggccggcgcggataaggcagaagacgacggatcgaataatgcagctaagacgcaccgaatccatcccgctgtgagcctgtgactctattcttcctagttttttctttcttgtatcttaaacaaatttcactctcacagttcgtcacgtgagcccgacgggccccgcagcgtcggcgcgtccgggtctttgctcataaaaaacccctcaagttccctccacgatcctgcatttgaacatccgttaccgtaggcatgtgttggatgcgtagtaaggtagtaagggtcacagactatgatgaggacgtctgctctactctctccgtcttaaaatataagtatttttaacttcgatacagtcttcgatatgctattttgatcaataatatatataaaaataagatattttaaataaaaagagttttcatattataatagtttgtttaagataaatctaataacatcaattttatatgattgatcttttttttctataaatagttaaagtaaaaaagtatcacttgacactatgctaatattgcttatattttgggatggaggaagtgtattctcgccaagatagcatggaccgtttagattagtcttttccaaaacataacaattttaaaattaattataccgggttggacttggaatttagcattttattagtgtattccaaattcgaaattagtttactagaaagctgtaattgaagtaaagtatattcttattttaatttatgcgctataatttactagaaaattagtttactggaaaatttcaatatttataaaatcaataacagtagtctgtgcaactgcaacatatgggttagtaaccagtgccttatccatttgtgcttataatttcatcggttcttctcttgttgaattggcccttttatggatattatggatacacagacaagatgattgatgaacgatttaccctagcagttcgagacttcgagggcaatcttagtgtcccggtgaggttaagcctctaggtttaggagcggtatctggcactgtgtagcattgctaatgaggtgagacggtggcttgggtagtgaaaatgaatgaaatcgttaatcaggtgacatatgtgaggtcaagtgttcaactgttcggagtcggtgttaggcaatataattgtaactcctttgttcgtatagcgtatagcgacggtcggtccggtcctagttccttcgtcggttgtttgtttaggtgatgttggtgtgtagtggttctttttcctgactttagggcccctttgaatcacagggttgaaaaaatagaggaataggaaaaacacaggattctaataggaattgaagtataaaacaaaggattgcaaaacacaggaaaaacacaggaatagtcgtttgattggagcgcaggaaaaacgcaggaatcggatcagagagatagactcaaaggaaatttcccaagaggttagatgtaacatcttgaaaattcctaataataaaaatcactaaaatttcgaactttttaaaacttttgcatcatgctgggtgttatggttgtcattgcttgccaaatataaattgtaacaatggagaatcaaattaatggcgtacacctgaacaataaatatatgatacaagaatacattagtgcacaagaaagcaagccaaataaaatattaatttctattataaatcatagatcaaatattaaatattcgaaccatgttgatagctcgatgtcaggtttaactaatgagattgtaagattaaatctaatgtatgtggatccaatctcacatgaagtattataaattcacatgaaatgatgattaccactataatgatcctattaacaaatgagaatttcatgggaatatatatacattaatatttgaacacttgataaagtcactcatataaaataatggtcatataattaaattaagctttataaaattatgtgagtttttaattaaacaattagattaatattgtgccgagtctcaatttactatttagagaataaatagattgaacccatccgtgtaaaatatattgctatacaactaaactcgaccaatctgctaatgtattaatcatgacaagtcgttatattaaattcaatattacctcaaagttttcaaaaatatataagttcaccttagggtcaataacccaaattaatctaaaaagaattcatttatgcgataaataaataaatatgggtggtaataattttggataaattttcatgaggatttagtacttaaatttagttaacatttaactaagtaaaattagagtttataggattaaaattgtataggagataggctaaaatggggtttaattagggatagcactattcattgcacatgaggtgtttgatggagttcctagccaccctagccctcttcctccccactgccgcacctagccctgctgcgccgctgccttgcgccccgcgcgccatcgctatcgccgtcaccgcgcgccgcgcgccgtcatcgtcacgttgccgcaccctcgagccccgcgccccgtcgctgccgcgccgctcgcttgtcgccgtcggcctcgcgccccgagccgccgcgcgccccttccctccgcgcgtgctgtcgccgtcgccccgcgtcgcgccccgtgccgcgccgcctcgcgccccgcgcccctgccgcgccgcgcgcgtcgctgtcgcccgtcgccgtcgcctatctccgcgccgcttgtgtcgccgtcggctgtgccgcgccgagcccagcgccgcgccgagccccgtgccgctgccgcgccatcgcgtcactaccgtcgccattagcgcctcgagccccgcccgcgccgcgcactgtcgccgtcgtgcccgccgtcccgtcgccgcgcgttgccatcgccccgagccccacgacgccgcgccatcccgtcaccgtttaaagc

SEQ ID NO: 9202 - DNA, 31270 bp, Oryza sativa
  unsure (1)..(31270): unsure at all n locations
cctcttcttcttcttttttttccccttttcttcccctccaccgacgccgcattccgccgccgcgccgccgctgccgtgccccgagccccacgacgccgctgccgtgccccggcgcctcgccgccgccgtgccccggcgcctcgccgccgccgcgccgcacctcgccgccgtgtctccaccgccgtcgccgccggtccggtaagccctccctcctcccttcgtcgctggtagccgcgccgcgccgtgagagagggagagaagagagaaaacagagaagagagagagagagaaaagagaatggaggagagaggttagagtgggccccacgtgattagtaaatagtaatcctccccttgatctttattagttaagtcccttacatgtggggtccctatgattaaaatctatgaaaattcacttatatatgttgtgtccatggcaggccggtcccacaggttagtcaatgtaaattatggaataaaaataaatgagttaggaacagtactgtttcgcaattattcaaatttgaatatttaaactagcataactctctcattttaacttggatttgagtgaaacttgaacctaaattcatataaattcataagctttccaatggtatataattcactatttgataaaatatatttataaatattaaataattaatatcaagatgatgcataatagttaacttaaaaatgtgctaataaataaaattgatattgtaccgtaaagtagatgtcaaataattgtccttaacacgcttcctcactataaaacctatgtaaactagttaggagcattgtttcaaattaattaaagcataggaaatactagtgccatttattaatatatgtcaatatataattatactcatgacgtccaaattgtatagcctcatactttgtgagtaaaagttgaacacatgtagatgagtctttaaattgtttatgagaaataatagcagagcttgtatgattaaatcaccaatatgaaattaattaacgacattccctatacagtagtatatgtttaggttggaaatcgacccttaagttgttagacagtaactcactcataaatccacttaaaatcacatgtactatatagcttaaagtaaatagcagctatttaaataaattattcaatattaagatattgtgcactcacatatactgtacagtccattatagctatacgttgtagtattaaatcgcttgattgcatatattaaaattaaagaggatatatgacaaacatgtatggtggataaatactaattataaaccttgacctaatataacacaagttcaattgtagattaggattattcattgtaaaattatgtgatgggataatctgtaactataatatgattaacctaaacaactttaacatacaaagcatggataattattaaccttttataatttattgtgacaagtaaaatatgttcataattaaagtaaagcctccatcaactaaataataatacaaatgattcattatttgattgatcctaaatccatctaacaacagaacctctaatatataaccgtcctatttagatatatgcatatatagccataatccttcgatagctatttgatagactaaaccaccgattagccaaatatatatatgtatccaataaatgctatgttggttaactcctaaatagaccatgatgacaatagaaagattaagaaactttagcccttagcatgattggaatccattagcaaacacgaatataacattttgttgtgcacatttgattgttgtttgaatattggtttttctcgcttattatagaaattgtgtatcagttagtcgtgaggcaacgtctgcagcctccaggaagtgaaggttgatcaagaattatatcaagaataaggactatcctgagcagacaagtcattactattccttgaacatgttgataccaattgcaaaattattttgtttacaaataaaaattgcatgcaatgataaacatcctacttgcgattatgccatgccttgattattgtttacccccttattccttcgtaaccatgtttacgtatgagtccctagtcaattatgacaattgcttagaaatgctattttagaatcatgcatactcatatttatcaaatgttatatgcttgggcaattacctttgggaaggtaattgagatgcggcatgtggagacatgagcgccacattgccctgatgttgatgacatgatttgtggaaggagaaataaaattaaacaactgttttcggctggggcggacggaggatttgggtggtatctggaaaatgctagcaccgtccccggtcaattaaggaccgagccatgaagttaagcttgaaacgacccccgtacaaccgcacttctcgtatgggtatagacctagcagaatagatagctgagcggaggcagtatccatgcatagtggtttcttgatgtgtgaggcaggggctctacggtggggcagccattggtagaaccgcgaggcgggtgtctacagtggtgtcaccatcagtaggactgccatgtgagaatttaaacataattataacttaatgcatgtgtgagtctttccttcccgggtgcgccagaactcctctcactgggggccctttttaaagggggaaaaaaaaaaaaccgggtacgcctagagtgcatgaggatgtaaagttcatggagcgggtactgccaatgcgaggttgtcgaaaagttttgccgtgacacatctcatgtgttgggacgaggctcatgtgttgggaagtcgcggagtgcgggtaaagtgtacatccactgcagtgtgagtaaaccaaatctattcgagtagccgtgctcgcggttattgagcaccgggacgtgtattacacttggctagactctaaattcttaacttgtgtaggatgggttattgcatgatgattttatgctgatggagccacttcctaagaggagggaaggtggacgttctcagaaaaccatgacgactcaatggcgggaagctatcattgggatcacaatggatgctggatagaaccgtcgttgtttaatgtgaacactggtaataaaacttgatcagtctatgctaggtattaagcttgtgaaaagaattgtaaaactagctttatgcaaaagaacctgaggccattccttgaaataccctctatcatatgcattgttgttgtggtggcttgctgagtactgttggtactcacccttgctatttatatatcttttaggagagtgttgaagagaagcccttgtcggtacgcttgcgtaaccaacaagatgatcggagtgcggtcttgttctaggtcttgttccccagtcgactgcctgtggcatgttaaccgggcccttatattatttttttgtcttccgctgttgttctctgatagttgttggcctacctggccctaatgtaagtatttaactcttttagcttgaattcattcgtgatatgttgtgatccaactatgtatgtgtgtaccaactactgatccagggattggtacggataaacacagaagatttccgatttccaaaaatcgggggtctacattagagctcttgctacatttcctccaaaatccacatgcaatgtgccattccataggaatttcataggatttagaaagtttcgatcctttaaatcaaagggccaaacatgaaaatttcctataggagttatatcctatgaaattcctatataaatcctttgattcaaagggggcccttagcctttcaaggttttagtcttgaatttttattgctctattcaaagaaacaatatgcatgcatatttgtcttgtgctattcgttttaaaaaaattccatgttccacgatggatgaagtttctacgagtagatgcttggcatttgacatctcttaaccacaatatggcagtgttggagatgaagactatggttggtttgttgaggctttacaccacacttttgtgaatgaagttttatagcttgataggagtaagcgcgagcaacatgattttttttttctaaatgtaattctctaagtgctaagcctcgggtactgttcttttcggcttatcgattagtatgcattatcttggacacgcttcataagttgttaaacaatacgatttatttgcaagcattcttcttattatttatttgaaaatgttttaaaaccaacttcttaattttctaatactggccttaaataattatcataaactcagtttcaaccacaatccattatatatatcaaatggaacaccaaggaccacattttagtgagaaaatagaatattttccactttaaaacttgtcgccttcaaatactagcactttttttttgttacgaggggtcctaaaatgacgagttgcgacatgaaagcatgaaaatgtacatctcttttttatatatatccatgcgacgctgaattgctgaaacaaggagattcgaattgcagagctcctggattttgtctcttgtgccaatcaacttctgaagaacaaggctgtcagaatagggatagtaggtaggagtaggatcgtttttatcataactgtatcgaattgtagaatcggattttaggatcatgatcatatcaggttaaagtacatattttcacatataatttgttagacattatattaaaaaccgaagcccataacattgatttttgataaatttaattttttgaaaacttgaatagacttattaacattattttcaattaaatgaaacttaaataatatatacatatcgtaaaaccaggatcctatataagattctaacgatcccgtaaaatcgtgtggaactcgcactaatttaaaatagtatgaaaagtaggatacatggtaagatcattatcttaacagcttgccgaagaaaagagagggacgataatctctttatctagcagtgactttcggactggctatattatttggtcgtccaaacgttgttagtatacatgacaacgctggattgctggaagcaattaatcgccttgttgcagaggattcaccaagcagccgttcaacctgctttccatctcaaccgtccaaaaccaagtctttatttggtaatcagggaaatggaaaggaaaaggagcaccgaaagtcaatggaagctctagcctgcagtgtactgagcgttgcggttgaattgaattgagcttagcttgcaaacctctataattgtctgctccgtcatgcctactacgtggtggtcacatggaggctcagataataatatcaacttcaaaaatgagtaagcagcagcattatatatgtatacagtatacccagatgttcatgttcctacctactagtagtactgatcaatcagccaaacaacaactaccagatacatgtagcagctcattctccagttctatacagttgataattcataagtggaaaggtttgagctattggagaacaacatcatgtgtgatgattcctatgctcgtttcagcttccatccatccatcaaaactcaacgatggctgtgtttagttcagcgcaaagtttagattttggttgaaattagagatgatgtgactgaaaagttacatgtgtatgacatattgatgtgatggaaaatgactgaagtttggatccaaactttggatctaaacacagccatgaagtacagtatatggctggctggctgctgtatggcctccagcccttcctttccatttattcctcgtttgcaattcattccgtctggccgtttgggtgctaaacccagcagtagcatggcaaattctggccaagggacagagcaacagaaactaacagggaattggttattgcaggacgcatccctctccctctattcccaaatgagttcctcctgtccatgtgggcgcgatggaatgataggtgctacgcgaaagcgaggcacttgcttacgagggccgtaatgattagcgggttagcatgcactcgaacggcgaaacacgcagttcctcactcgctcgcggccaggtatttttggagcggcgtgctagccgtagcctcccgtttctttctttccaatttttttttgctgggtttgcatgatggatcatggcggaaagatgggtacggattgcttcctctcgctctctctttttttgcctgtggtgtcttgctgcctgtactatctgctgtgcctgttacttttgaccactttaatttacgcacgcactgtcaccacacagtggccaggagtatctagggaggtatatagggagggccgggggagactggctttacagtgtgagcaatctttcccttggaatacaatcattttgatcaaaatctgacgaagaacttgctaattctatcctggcatgtgtgtttctcaactttctctccgtcaggtgtctggctgattactgatatgggcgaattcgagaggacagttatccagcttgaggatgtttcagaatttcagaatatcaagtggcagtttaccaacgttgctacttcccccctttcacaatgtaagtcattttagtattttccacattcatattgatgtgtctagattcattcgcatcaatatgaacgtggaaaatgctaaaatgacttacattgtgaaacggaaggagtatctgtaagtgggtctagattcattcgcatcaatataaatgtgaaaaatgataaaatgacttacattgtgaaacggagggagtatctgtaagtgggtcgggtcggagaggtgacaggagtgacaccgacggcgaaggcggctatctccctcgtcgactcgtcgtccctccacctcgcgcgctctcgctgcctcggccacttgacgaagagaaggggtcaatcgcagatcacaccgtgcagtatataactgatttccgtttacccactggaggagataagcgatcgattggatcggtaggtcaccagcaaatcagcgatgaagtcactccatgaggcgaggcgtatgtgctgcatgacacatcggcacggagtggttgctgtgggtgatgcaactctttttaggttttactcgtgtcatcaatttcattttccgttcggggaggtatgcatgcgtgttccggagaagacgcatgatatgcataaagacgtcgctgttcactgttttgtagtagtttgtaccgtcttctgcttcgtctgtactctgtatatattggagctcaaaatattcccgggctctgaatacaccaagctgcggcctgcgagcactgcagactcatgctacattgtattaggatttgaaaatacaagataaagaagtaatcaaactgggtgtttggtctagtggtatgattctcgcttcgggtgcgagaggtcgcgagttcgattctcgcaacaccccctcgatcagtgatcatggtgttttttgctgttgtcgcattgctttcattaattcggtcagtttgtgaggcccaaagcacacaaccatttcgataaggctctgccgactggccactgtcccaagtggaccatccgacactgattaaacctgcaagaagtggtgggtgctaaactgataatctaatgcactgctaactctgcaacatgtcgatactagtacttcgttttgcacctttggcgttttcactttcacttttacaccgattccgtctgctcttcttgaacggggtggtccagtcaatggtaattggtaaatctaagcattcaggaaaggattaccgcccttagttagaagttggaacaccttctcgccagcagtttcgtctgcttgcttacaggaaacgggccggattctggtggaggcatgcgtgagccatacagaatcggtctgttcagggcatcgttgatctgccttgacaaagctttgatttccacgccatcttgttcccatcagcatctggaacacggaacagccacagcccacaagttacgagcatgaaaggttaggttagtctgtttaattttcttccagaatccgatggtttggtagcttcaggttgaccgtttcacctccagtagcattctcttttggattggccattgtgtatacacagggataaaaaagaaggttacgaactgcctcagtaaatactttactccctttggaaaccagggttcaactatgtaaggccctctagtgccaattcagtctaccgaaatgtcttacaaactataccattcaaaacttgtaaataacacgaagtgtagtctatacacatgaatcagaaagcatcacgtggaagctataagtgggggcaaagaagacgaataaaatgttttcaccatttganattcaaaacaacacacatttatcctcgaactcctagaaaatatgtggaaccttgctagctagaactcgctctcgtctttcgatataaccatgtgggaaccatcctgcttttcccttgcattcgccttctgcccaaccattggttgatatctgtgttcggacaagaccacattagattactgacagctcaattatgatatgttagctgccaggaacttgtatttagaaacatcggaacaatatcggcaactcaattgaagattacaaaacatggacagcagaggtatattaccttccggacaataacaatgtctccagctgacaagttaagctcagactcactttcagccttgaaggaatcaagggcctgcatcataacgaccaaacaatttatgtaagaagcataacatcggtaaattcatgttcatttggcagatggtgcaatagattttgcatgaaaagaatgccagacctctcctaggaagaaatctacagatgtcactgaatcatcgacagaggaggatgcaaacatgccattgacttcgtcataagatggtggtggctgtgccatgtaattttctgctgatggggtcggaggtgcttcaatcttttgacgctctgataccatctaaaccaatcaaaaaataatcattaacttgatgaagataggacttctgcacacttgacagtgtgtgggctgtgtcaacaggccatgttttaaaaaaaatgtaaatagtgctggagtatacatacttcttgttccaggtggtcaaggatctccagaactctctgatggtaggctctttcggcttcaaccttcagagcaagactgattagcagctatatataattttcagataaatgcaatagcatgatgcaccagaaaatgtaacgttaacgggtatagctcatggttaccatcgcaataaggcgctgtaatgtcaatctttgttgctgagcctcaacggcagccattgctgcaacagcttccttccctaatcctaccatgcttgacttaagttcttcaagtttgtattcagcagcttccagctttgttatcacatctccattcggagctgactctcttactctgttttgccgtcttgaaacttcaacagcctaggaaagcgaacagaaaaaaataagctaaacagttcagtttaaaccaaaaggtcaatgcacagaaaaggaacacaaattacttatgttttggaatgactcaactaatcacatgatctgagaagatagtaggatcttagataacaaagtctgcgtgcaactgaaggcaacttggcaatgtcactggtattattgctttgcaacttgcaagtgaccatattttagagtttcaagttatggagattctatagataaataaggtcgacaagatctggccgtacacataatatagtgtgatgctttccaaaatattgtgatgttgagaaattttgggatagtcctggttctcagagaattcatagcatttttcctttcccaataacagtttctccactatgcatctgtaagccttgcggtacaaggaattaggaatgtgtggaagtagaatcataaaatacacaaactatttttttaattgtatagcttaggttgctcgtcaatggatattgtttcaaatatgctgtaagtacatctgagagcaatatcctgggatgttatataaccttgaagagacttaagtaaaagttatacactacttcacctgggcttcagcttcttgcctcattcggtcatatctttgggctagatgtctcgcatcttctaaaggcgcacccatgaccattgctcgcagtggctctgccacctacaatccaacaatctcttactgaagttatgcgttctattcacatttatcaataccataagaatggacctcattgttctgcacatagtaacaactagttgcacaggtaaactactagtatgctaatcatacatgtcataaggtaaaaaatgtcgatcaacatgaagtcatgaacagacctgtgtaccaaatgctctcaacatgttcccacgttccttttccatcagagaacgagccttcccatagtacatagcagccttggataaagtgttatcacttgtacatgtgtttccagtgccatatttctggctatcgtcggacaatttatttcctataaatttaggttgcaactaatcaacatacagtaatgtaaacactgagtaattaatattgtgtcaagctaaaattattctgataagctaatatatagttggagaaacatacctatgtcaacttgtttagatccagtgactatgtatccctccacaccccggacaatgtccctttgaaaatgctggccaaaagatgccaatgtttatcaaaataatctaggtagaaaggaaagagatactgtttctctaataaatttgtcttgctcatactttagcagcacgagttgataagtaaagtttttccagcctctggtgtagattaacttctgattcatctgtaaacgcattttctgaatttccataggcagctccaaatggcttaaacacgccctgcaatggtgtagacaggtacaatgttacatggttcataccaagattaaaaagagctgacttttcgatgcagttaaataccaagaaaatatcccacaacatataaagataatgcagtatatattccatgtgaaggcagatatgtagctggcatttaacagccctagagtttccagttactttgcaaatcgcagacattagtaataacaactcctaacattggaacatccgttttcaaagactatatattccaggcaaaactcatagcaaggaaatagtagtataggcctacagtacgaaaccagaacacctgaatagataccagatattgttccctactttgttgtgtagactgctaatcttagctgtcttcctaaggcagtgtaactcctttcggccaaccctcctatgtttgtgcaagatggatgaaaataatcaaggcggtattactcaaaacagcaaattcgggtaggtcatgtttacatggttctatatttcgaacaggaatcacgagcaacgcttttaaatagaaaagccacaggttgctaatagcttaaccagattgatcaaccctgtcgtaaaatcataacctgatgtttctcatctcagggattgcaaacacgcgcatcgcggtcccaaccctcacaattgtttttttcgagagcaaaagcttggacctccccctcacaattcatttcaccactcgccagcatgaatgaaaatcaacctgagacgcctaaccatagacgagtacggtagcctctcaaaacccatcagcatagacatcaaatcaaacttatatagagaccggatcgaacaagacagacacctgagagggatcgacatcgacccaccccggttgcgcaatcacaaactcggatcgatcgagaaccgtactaacacaggagttcaaagagatcgagggggatgggagagcgtcacctggcgggagacctgctccttgagcctggaggcctgcttccacagcgcctccatggcgccccgtctccgcctctccggacgcaaaaagccgcggcgcgctgaccgggagaggggaggacggccgggcctgccgcgtcggtagcctctccccgttttccccttttttccccctcctttttcttcgtttggttctcaggctggacgacgacgacgaggggttggggaaggacggctcgctagtcgctcctccgatgttagtttctttctcgtggtggttggcttggctcgcgcacggccgacggtggcgcacgcacgaaccgcgtcctcttccgcctccctggcctataaacggcgctgtcgtcgcgggcccaccagtcggtggaggtggcgggacgagccctacgctgacgcggctgggcgtcatggctgcgttgaggacgacgtcccccggtgtggcactgtggcccgttccaaagaggaaaagaagtactcgtgtggcccattgaccgatactctatgtggcgaaagataccattgaccaataatgggccagatatttgcgaactggacctcaccacagctagaaggaaaggaaaagcgagaaaggaagggttaggtataaaacgggcctaccacctccacggagcacactttcgaaaggaaaaagtacacataaggtcccttatcttgttgctgagttataaaatcgccctaaaccggaaaatcagacatatgacatctctcaacttataaaaccggatcactttatatccttaggcagtattgactctggttgactgcaattttatccgatgtggcagctgagtcaatgtgggacccacatgttagtgaaacacaactttttcttcccctttcccctctcttccctcatctctttccaatgcgtgagtggtgccggtggttgcggcggagagagctcacgctgcgggagaggaaagggttgcggcggcaggtgcatgccgtcgtcgacgcggcatgttcgtgggaggcgacgcacggtaagcctgtggagcaagagcctaggtatagtagcaggaggagcccaaggggaagcggaggagggaaaggggaggatagaggaagttcgtcatcatcatcgccgacaaggtgggggtgatggtggtgcatgtggtggaaaaggtcacgggcggaggaagccttgaccggcgacgtggtgtgcccgctaccgacaccctgctccacaccacttactcctgtggcgcgagctctctctgtcgcgaccaccgatacaggagtgtcgtggtgtactgcttggcgaggaacatgtaggaggaggcggtaggcgacgaagagagagaagcggggaggctggtggtgagcgatggagagggaggaggcggggccggtgaactcgcctgctctgcccggcgccgaatggcgaggagaagagaaaacaagaagaaagaaaggagaggagaaaatgggaatgaggatgacatgtgggtctcacaagtgtcccatcatttatttattagttttctagtgtaaatgatatgtgggtcccatggttttcattctttttctcgtattgaattgttacgtaagcgccatgtcaatgtcacataggatgaaaactagtcaaaggagccacgtagacgctacgtcagccaaaaccggaggataataccgctgagggacgtagtttatattagttttgtaagtttggggatgtgttgtacctgaatttgctgtttaaggatgattttgcaattcagtgataagatgaggggctttttgctttccgaaagtctttgtttcctggcccaggcctctctctgagcaatcaatccggataggcacgaaaatctttgtcatctcgcgcgctttgccagcaggcagtagaacacttgcattggctaaaacagatcaggattctattgaaagacagagggtatgtctagattgtagtcaaaataaaccttaccaaattttaaaaatattaaaattttggtaagatggcaatattactaaaatttattgtcaaaattttggcagaatttcttatatatttatcaaatttagtaacaaactaaacatagttttttttgacaactttataaaaagaatgatatggttgaaaatggcatcaatctgaacagcccaaaatcaagaggaaagttctgatcgtttcaacgaggaagagcccaaaatcaagaggaaagttctgatcgtttcaacgaggaagaggacaaaagcaggcttttcccccaataatctgggagtaaaagcaggcttttctcccaagatgcagatcagatcgcaccaataattagcgcgcgaatattcctatcgtcccgcgccgtgaaagcgtcgccgcagcctcctgcaagctgtggcgccagccagccaggcatcagcagcgccgcctcgggtcggactcggacgtgagatcgcctcggcaccgttgcagctggccagccagctaccaccgacggcctaccagatcgatcccctccgaaatcgcggtcgcgtcgccgtcatcccgctcacgtacgccgccgccgtatcgctgtcgccggcaataaagcgcggggccggcgcttgcccatgccctctccgaaagggcccggtgatacagcgatgcctgcatccgcatggcacgcgcggcaactacccactccctccggctaccacatacgatccgtgccaatctctcgtcgcactacagtcagcggcggcgttcgttaattacttcgttttcctggagcgaaaacgttttccgtggcgcaggttgcagcccttgtggctgtcgctcggggtattcggaaattggagcccttttcatgcatcgcttctgaaaaaccgataaataaaacgatgccgggggatgtggccatcgtgtgcgtataatggactggtggcgacgtgcaagtaaaacgacggcttgactttctgactttatccaatggcgtgtgattattgttaatcaccctcctgagtcctgaccaagaggtaatcgtggtactacatgcagtactagcgctactgttgccaagaagttttcagtgcagaggcaaatacggatcgattggattattctttagccgggtggacgaaccgagtgatttgtcaaggcgctcaaggtgcctttttaacccaataaaaaaatctgtactttctgatcttcaattaagatatggatcggagtaagttggatcaacagcaatgtgaacggatcgtgccgtatctccatgcttgcggcccggcactgctggacggctggtaagatgcacgcagattatctacttatctgatgatgccaggaggatgcgatctccacgcccatgacgccagccgagaaaagtgcatacggccaaggccgcccttttcgcgctggtctcgaatgaacaactcggatgatgagaaacccctgcgcgttttcttattgtttccgctgtgcaggttgccggggctgatctgacctctccgcaaatattaatccgtgtctccatcgaatggggaattatagaacttgaagtgtgatgcgcagcgacagtgacatgtacccagctatacctgcaatcgacctgtggcgggtgtacacgccatttcgtttttcactttcttcatgcacactgtggcaaatctcacgttgttgctacatcgattaccaattagttaaagaagaaaactagtgaaatttagacagacttttgcaaaatttgatcgaactgtttttctatttgtaccggcttgataagtttgatataataaccatgataatcaaactactacgttaaatttgtcaaccctgttcttccttcctagcgaccttcttcttgttgaatggtcgcatatgtagatttagccccccaaatctagcggatctatgccagagaggagggtacatatcctaataaaatttcggtaattgaggtcacccgtgacatcaaatggaaaggaatttcgggggatcagttgggggttagattattaggatgcaagcaaagcaataataggggaccatagcattgttcaagaatcgtacgccttttgaatttggatttgttattatcagcaaaaacggccttacttttcaatttcccaactgttgcagctgccattggagcacttggcacttgcagtgttccgatgtgcagcgcaaagtattctaaactgcacgatctaggaatgcgctgtcgccatgttcttgcgtagctgagtatttattcataggaatggcagggtgcgtactgtttttcttaaataaataaataacagtaaaggtacagaagaattggacaattttgtagagcacatgtacagcaaggggaaaaatattttgatctcgcagaaatatcctctcgtttgtttaaaaacgttcatccaaacggttatgaaaatttttgacaacactcacacaacatatctatacaactccacaaaatcttaggttcaaactcatctcatactccgacatatatatatatatatataaaaagataaattcagcgtatgaataataggctgaatttaaacttaatttttagtggaccgatggatatctctatactctacattgtcaattttcttttagaatttttcacaactatttacatcaagtttgaaagaaaaaggtatacgaggggacatccccttgagggattagaatccactccccttgcaaggttgctaagcctgcgaccatacatatgtatcatgtatccattttaattgtacttaattcggttagagattgagaattttagaatatgcaaatgtttttatcagcagaattccatagataaaaatatggcatttatgttcatgcatataactttaaggtatgggaagtcctggccttagcttgaaaagccaattgttataaagtttacatcacaaatacctgcatgaatgaatcctaaaggtaagacaccaacaaactttccgttggaggtaggccatgaggaccttcggccaacttgctaaaacaacaacagtaacaagtgaaggagcttggggaaggggcatacgacgaagcctaggccatggagcaaggccacaccacgaagcgaagcaccgggtggcgaaacccctagtggcaaagcgggttcattaggtggtgaagcaagttcggctaggatatgctaatactaggagaagcctaataaacaacctaggaggaccctgataaggtccatgggccggctggttgggccaaaagataaatgttacccttataaacatccccgccagagggacaaccatgtaaattcactagcatacaaaaaccctaggttgtaaacgcattaatagatcccaatggttttttaatagaggatccgatttttcaattaatatatttttactgttttccttttcctaccgctccgagtgaagcctacctttcaacaaaaatgtttgtcattcaacaacagttttgatgaaatgacattgttcgggaattaatcctatcactaaatctctgccttgatggtggcgttgccggtgctctccagtggcgatggccctagtggtgacaccaagagcggttgctgtttgtgatagtgctttctagtgttctattgtggacgggcaattgctctaggcgcggtggttgttagatcgttggtttccttgtccagatctagttacgtggattggaggtgattgcagcaaggaggggctttggcaggacagcgatgagctcagtggtgatgctagcggcaaccagggagggaggaaggcgaggagcagacgaagggctcgctggaggtgccagaaatggttagggagcaatgttttatctagggccaaagtaccattggattggagatgtttgtgcccggatctattcgtgcaacgtgaagtggcattggatggaactcttcttctttgtcccccttagatggtgtgagcgagcaaatgcactagcgttctagagctgttgagtccaatgaatgaatccggtagttagtaggggcaaggcgacagaggaatcgagatcaaagcatcgattatgagaggttgtaggagatcgagatgtttctcaagatcatctcaatgcgattttgtgaagtggtactcctcgctcttttgcaactgggcccataccgaacttagtgtgctaccttgtatagtacgtgcatataagatttaattggagtgttgttaaaaaaatgtcattctattaagccataggacacaacatgtgcaaatgtcccctattaaataatgtctcttgaatttagatccactccaacaaacaaactcacaaacatatgattaatactattcggttcggtggtacaaaatcagcaacatgggccttgttcatgcatatatgatgcgataaaagaaaagttcagcgttgatcggctcgtatttcttcttcttcccttcgctataggacacgttattttcatataaattatgaatgaagtctgaaggttgaaggatagaacttacatattactaacaagtggttaggtcccgttcttttttccaaccagagttggatgaagattaagattttcgtggcacgcttttcaaactactaacggtacgtttcgtgcgaaacatttctatatgaaagttgctctaaaatatcgtattaatctatttttcaagtttgtaataattaaaactcaatcaatcatacgttaataccacctcgttttgcgtaaaaaaaacttaatcttcatcttcatctttatctttaggagaaaagaacaacatctaaaccatgtcgatgtggaaagtttgtgaagaaatcatatttttgaaagtgttaactgaagaatgcaaattgcagaagagggatcaagttggagccttggaagacgatgtccttgttggtgatcatgaccttggagcgcccatgcggccatgtctgacctctgatcaccatcaacagcccatttcatgcccatcatggcatgatccacgaccacaatcctggaacgtctaatcaaattgatcattaagccgcacaaggcttgaactttcttcagtccattcaaccgaaaggtgagataatgcgacgtgggaatggtaatgcgtgacttcttctctacagaagttcagaggaaactggcgatcacagcaactcagctttacaaattcatcatcctctctcagttgcacttgttgcacaagacagagttatcaattaatattgtgtgcactaactcctgggatgtaatttatttcttaagatattgtgtacactaactataataaaacattttgcattacctggctatgtggcatgatccttgcaaattattgacaaaagcatgcgttgagaaaaaaaaaatctcagcacgagctcgtcgtgacgtgagtacggcaccaggtgtgaaaggtaacatttttactgtcagctgtcaatactactgtaaacacactgttactgcacgtggaaacgagcttaattggacagatttagctcgggtgaagatgatcagaccttgatagaatcagcgcatgtggtcccgaaaacgagtgcgcttttccttttcaacatttttttctcgatatgaaagcatgatggagcctgattttttcttatttattggatatataattgatctcgacagaacgacctttttgcccgcttctcctgcaatatttattcgccatattgtgccgaagaaacgatttactagacagtaacttgtcctacaaaatgtgctagttgttcttttcttagtacagagaaaaagtattgcttagagcaccagatgcacatacaacatggagttgattagtcctggcaataattaaggttacttctctcacaagccctgatcactaccatgtagtatagtcatcttccaatcagcacgaacacgattcataagactttcacaaatcagggttaggttgatttgcaagggacaccgccttttcagctttattttcctttcacctcggcctaaaaccggccgtgccactgccgccgcccaatatataaacacatctactctctcgtgcactacaactaccactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggtatgcacgcggcgagaggctgctgctctttttcctcgggttgcttctgttgcttgctgcaactctgaagcgtgtggactctcgtcacttcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcaggtcagttcatccactgttaacgatccaaactttccatggcaacgaaaacctgaatacgtattcagtccggttcatgcatgaaaccctgaaaaaccaatccacacacgttcttgtgagcaccatgaacgaagcacaggcaaagcacggcgcgccaaactctgttcaggccctgccggccgtcgtgggcacataagccaatctgttcacaatatcgtgagcggacaaattttaccatgcaggtagtttgtagtcatgctcacacagctagcaataacaaaaaatatatgtaattgctggaccagggtgtcaggataatatcctgtggagaccacaaaaataaaatactaagcgataaatccatgagggtggattttaaactttgaaggggacgttcactcattgtttgtatgtcgctcaaatagttataaaaaaatttgagaagatgtactaatatgtgatatatcacttcataaacatacaagttaaaattcaatttatatatattgtaacgaaaaaaataaatttaattgtatttatacgttaactagctagctgtagtttaatatattttttcgttatgagatatataaattgaatttgaattcacatgtttatgaagtgatatgccacaagcaacaaaaagatattttcttaagagtttagaataatttcccgtaaacctgcatatcatattcatcctcccctcacgagcagattgttccctgctttccctatttgaaaatttcccgtactctgtctgcatgttcaaaacagtaaggtcgctagaagcttgtgcttggactcatgtggcaattggcatttcgctgctttccttcgtgcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctctgcatcttctgtactgcaaatcagattttgtgactcttccattaggttatgaagttttcaggatgttgcagcgcaagctgaacgtgcggcgatcaccgttactgagcaagcattcgtatctgtttaagcgacccgtcaacagaagtgcttcactaaggagcttttcatattgtagccaaaataaatctaaccaaattttagtaagttgacaatattactaaaattttgatcggatttcttatgaatttacaaagtttttttaaaaaatatatgcacatttttaacaactttaaaaaattagtatggtttgaaatgatcaatctaaacatcccctaaattttgagtagatggtaataatcacttccagttagcagcaagctcaagactgaaagcttaagcactcggcatcacgagcggatcgactttgggctacgctaatcacaccctgttggaaaaagtgcatgtgaggtccctcatcttgtcattgaatttcaaaatgatccctcaaccaaaaaaactatcatccctcgactgacaaaacatggtcactctgggtctttaggcggcattgactttggttctgtcctagtcagcgtaggacccacgcggaccccacatatcagtgacacctcaccttcttcttccccttaccacctctcccccatcatcacggcgcgagcagcggccggcgcgtgcgactgtcgccgtctcgtcccatcccactgtcgcgtcactctttcctcctcttcggctccctcctcttccccctccggtccacctctttctctctctttctcttcccctccatcgtcgggcaccattgccgcccccctgtgtcgtcatcgttggcggtagggatgagctacttcggtagctactccacctacctcgaaaccatcttctccgtcgtgctcccgccgctcgactcgattgcctgactaatttctgccattgttttcatgcagtcagagctcgtcatcccatcggcgctaacaacgttgttctacgtctccaacatcgtctaatttgccaaggtcatcatcttgagacgctgttgtagtcaatgggcatcgacgggaagcggacgtactacatcctcaccgtagtacaaaaaacggaccggcccagcggttgaaccgagaaaaacggaaccatcactctcaccaggtcagtttgttttaaggaccgcacatgcaatggaaccggtgcaaaccggatgaaccggatggtttttgaggaaaaacggcggccctggctattttgaaccgccggttcgtgaagcagatggctagattctaaggcccacttggattgttgcggcccaattatcttttatttgcctaaaatgaggaaaaagtgcatcacatagggatcaatccctggttgatggaatagaagcgcatcaaccacaccaccaagctaagttggtaaccttgtttacgtcggattatgtatgataaatatactttccggttcaacaatcgaatcggtcgacccagcggtccaaccagtgacctagtgaaccaggagctcaagcggttcggtgcccggttcggttttgtctacgatttgttagtgagtgcagctaactgctaattttcagtggatggatgtgagccatgttgatggatttatggagttttttttacatatagagatcgattagtggtgttgcatttttttttgccttaaacgttacttactgtctttcttcgagtttgcctgctttttgccaccatatctcctccatctttcaaccaggagactcaagactagaggcaaaagaaccgcagtatcgacctcttccactctccacagtctgcacctaccttcgccgactcaatcaccatcgccggaggaaaaattcccggaaccctaatccagttgccactcacttggctcctaaattcatcgcacacatcgccaatcctaccaaattgaaggtaaaaatgaattatccatgcaaggtacttcatttcccctctccggccccaatgattctgctatcagaatgccaccggtgctccctcctgctgccacctctgttcgggtgccaccggaccacacggtgcgttgttgcctcacaatttcccgtgcccatccaccgccacctcgagctccgccatagtcccctcgaactcctaggctgccgtgcccctgcttgaactcgccgaagcgccgccgcctgcttctaccccatgcacgaacggaggaaagagggagatgagggatcagggttggccgctgacatgtagggcacacgtgggtccaatgctgactcagcctccacgtcggacaaaactatggtcaataccgcctaaggactcagagtgacctagttttataagttgaaggatgtcatatatctgttttttgggttgagggacgattttataattcgacgacaagatgagggacattgatgtactttttcccactctgtttgatccatttgaggggaagaggggccaaggttgcaaaatgaacggaacccaattgcccaaagactgctcgttatcccatagaacgctctgttatgggctcagtggtgatgggccgttcgctgaaatatggtgggctcaaagatgatgtctccatttatttctcttttgcgtgtacaacaacatacaacaacatggtaaagaactgatttttattttttttgcgaggagtgaagaacatggtggatatgcaagcagcaaacgaggtaactctttttttactgtgcatcctacagatctttttaacatcacggagctcactccgtggtccaagaaagagcatcaattacatttcccccattgttcatcgttcatctcattgaaacgaagtcataaacagtcccgcctacagaaatgtttccttttggacactgtcccgcctacagaaatgtctcggccaagtttcctcatcaccccagtggaccccacgcgtcagcgtgctccagtccactcgattcaaaacttccctccatatctggcaaccatgcgcgtcatccggtgttggcgatgttgcagaggggaggaacccttcgtgaccaatccgggatggctttccaaatcgtgatcgcactggcacagtgccaccagaaaacgagcaactcattgccaatggatgaatggagtagtatgttaatacgagtagtagtacccgctatctttggcgtttaattcgaggctaatgctgccgttcgtgtcacatcagcgaccggattcatctgctgatcctgtcgtcttcctcgtaccctctctgctgctccttcctcttccctttgtcgcctacgcgaacctggtgcgaggtgccccgttgagaaaaaaattgggttcgaatttttctctggttcgcttgtgattttgtgggggctaaagaatcaatccttcggggctcggagcgatggacgtggaccagctgatcctgttcgtctttgtgtgctgtttgtcctcgaggtttgctggtgagctctgtgatattcaagtcatgtttgtttcccgtgctgtttcttggacatcgccgtcgtgtttgccctccgagtgttgttcttaggtttgattgattgaactacggtcggtgatttgttttctctatgttttgacagatgcgtatgatccggtagatccgaatgggaacatcataatcaactgggattttcagagcatcgagaacgtctacacggtgcgcatgcctgctagtgagtttagtactgccgttaatttttcactgtttgggatcatcccagtagtagatatgcagtcgaataaaagattcagaatttcagacgtaccatcgttgcaactatcctttttatctcgattctaacttttccccattatttcctccggtgaaacttatcattagtacagccgaaatacgatattctgacaaaaaaaatttgacgttcgcaaccgccaacaccacgaatcaatcgatatatcctgtgcttatgcaggtcatggtgagcgtccacaatcaccagctgtaccgccacatcgagcagcccgggtggcggctgagctggaggtgggctggcaacgagatcatctggggcatgacgggcgcggaggcgacggagcagggcgactgccaccggatccgtggcgccacccggccgcattgctgcgagaagcaaccggtcatcgtggacctgccccccggcacgccgtacaacaaccaggtctccagctgctgccggggcggcgtgctgtcgtcgctcacgcagaacaaccggacgtccaccgcggcgttccagatggtggtcggcggcttcaggcgcgccacgtaccacgacggcgacaggggccccgcgctgccgtcacgcttcggcgtcggagtgcccgggtactcctgcagcaacgccaccaaggtgaacgcgaccaggtcaccgatcggcaggcaccggcacgtccagtctctgcgtaaggcttctcccctttctttcttatcgcggcgcgtgcgttgagcgggagttctgagcgattcttgctgccgcgcgcgcgggcgccgtgtgcagtgacatggcaggtcacctgcacgtactcgcagttcatggaggccgcgtcgccgacgtgctgcgtctccctctcgtcgttctacaacagcacgatcgtgccgtgtccgcgttgcagctgcggctgcccacgatcccccacggcgccgcaatgcatcaggcaaaaccccccgcgcaccctcgtttcccacaccgcttaaatcctgtgctatatatcccactcactcatctgcatttttggttggtttaattttccagcgagggcgagaagccggagctgccggccggcgacggtgaggcggtcgcgccggtcttccggtgcaccgaccacatgtgcccagtccgggtgcactggcacgtgaagatcagctaccgtgagtactggagggtgaaggtgacgatcaccaactacaaccaggtcaagaactacagcgactggaacctggtggtgcagcacccgaacctccggagcctgacgcagctgttcagcttcaactaccagcctctcatcgagtacggcaccctgagtaggtatcactcactttagcatgatctccgttcgaattggatgaacagagtgaaccacagaagttgttgtttgattttgcagacgacacggggatgttctgggggatccagtactacaacgagatgatgctgcaggacggtaatgtgcagacggagatgatactgaagaaggacaagagcgacttcaccttctccggtggatgggcgttcccgaggagggtgtacttcgacggccacgagtgcgtcatgccaccgccggatcagtaccccttgctgcccaacggaggcccggactcgcgcgtctcggcggcgcaattgatcgccagctcgtgcttgttgttgccattcattttccttatcatgtaaaatattatttcgccatcgtaattgttcgagtaggaaagagaaatacaggtgcaatcgtgcaaacttgcagagcctaaactttgtgtaaaattactaagggctggggtctaaaggactgggctgaattctatgtatgtgtgtatataccgttttgggaggaattccgtaaagactttcccttcccaggcctcgtttagatgaagcccggtaaataacaatttgtattttttttgaactccctatctatttgtcgacaaattcttgggccaaaatcacccagatttttttttgcctttggattagcatccaaaggacagggaaaaaaggtcataaacatattttttctgtccggacaaaatcaaaagacaacatgggctgtaaatcaagcccacatagaaaatacaaaaaaaaaatttaaatcccatgattcaaagtgagcagcccaaaaacacaggacaactttataacagcccaaaaataacaaaaaaaaaccattacaaggggacttgcaaaccaaaaaggtcacaaaaagacaaaaaaaaggcagagatcacacagatcacgctacttcacacaaaaggaaatccacagatcaatcaggagaaatcgagcacgccatggacagctacgagaaagagaaaaagaaaaagaagcagattctaaccaagaacatggaggtcaagaagatcaaatcaacaacaaataatctcccaggtaagttccactttacctttttgttgttgatttcaccggatatgccatacagtatcaaaatcaaacaaaaacaactcagatttgaaaactcttagggaaattgcatgaaattttggattcctttacatcaagcagtactgagtagggaaacatgacttttgattcaaaaagatccttctaataagctataagtttcatattgaaataaggggaaacatagggcaccagaagaacatacatcatacagtgcacatatctctaacttttgcatcccaaaacatattctgttgatcacaactagtatgtccttcaatgaacatgatccctgtaccgccaaaatgaggagcaaaaagaacaaattttactacacttccagcaacaaaagaacccaagatttatgaatgctcagaggataagaataatttctctgctaacaaaacttaccttcacccacgttgacatcaatttcctgtacaacagttcaaaaaaaacaaatgattgatttcctagatagcaagcacagcagaagacaattcaaaaaaggaacacaaaacaaaatataaggaacaaatatttcatttactgaccattgctgtcatcccacaatccaagcagctccaaggcccttgctcccagaatcaacacatgcaagagcaacaaaagccaaaacaaagttgctaaaaagtacacatataacccagtcaatatcacacagagaacaatagaccaaaaaaatgaaaatgtcatgtggacacatctaaaaattatagataagaatatcttgcacatctgaaattagagacaaaaattcctcaacagttgctatctcagataacttgtgagataacgggcaccacactaaacctaaaaattccatgctaagcaatggaagtaaactagagacagtatgtcaagcttctatcaaggaagaagcctcaggtcaatctatattctaccaagagaaatagagataacagaaaaaaaaacagtacaaaactaggcctacattactaactagcaaaaaaaaaatatatcaggcacatatctaagaaaataaagatgcctagggttccccaaactacaagtctctgataaaaccaatatcaataattaacaatctaactaccaatagtcagttacagtgcgaaataataaaaattacaactgtaactaaggtatatttccactgtaagtggtgtgagttgcactgtaagtgtgttttaggactgcatgaaacctaaaatattgacttcatctgttaaatcaaagattcaaaactgaaaatacaatttgaaaactaaactaaatccccagatgaaagaagtgggcatcaaataccataactaaatcaaaaaagatacaaggtttaagatcagccattcaaatgcctcaagagatatattttttgtgggtaatttcctaatagaaaacatatattgaagctgacatccacataaatgcaaccaataaaaaaacatggagctatacatccataaatttttctgcaagaaaaagtttgacgatcatagaatttacctggctagttctccttttctgttttaatgaaaggaataagtagacacataagagttatgtcccgggcagcacttgttaagcaaaaacaaagcagaatctatgcaagacaaagaaagaaagttaatgttggttgcatacattaacagacaacataaatgaagcggcctcacacttgcaatggcacaagaaggcaagctaatttcagtaaaaacatctaattaattcaaaaatggatgataaccctacactgcattgactggaaaaaaaatctacaacataaggggaagcaatacaaactcactattgtttttatgaaactaaaagtacacatattctaacttatgcatgcacaactgacaaaaaagagtccctagggttcccaaactacaagtgtcctagttttcacacaaatcagtaatatacccaaggtcaatcaattacaaaatctaactaccaacagtcagttacagtgagagataacagaaattacaactgtaacttaggtatatttccactgtaactggactgtaaatggtgacgagttgtactgtaagtatgttttaagttagaattactgtaatttcagactgcatgaaatccaaaaatatttaagttaggtagtcagattacctagaacatataaaactaacatgctttttaaatatttctattacatgcaccaaccatacttgatttaaattacatgcaggggctgatagaacaaagtctcaagtaacaggaaatacaactgaagaattaagaagaaagaagacagttgaaggttagaaaatcatgcttacctattattgtgcatcatatctgatcttcatagaaaatttcatctagcacaaatttatgtatgtaaaaaattagtcatgaagcatgacaaaaattacagtgataattaaccaaaaaattagaactgtatattcagttacagtgagaaataacaaaaattacaactgtaactgcagtgcatatggactgtaactggactatgactggaatcatgcataactttgtccaaaaatccaatactcatgcaacaacatcaacattattccctactataacatgatctaaatcatattataaattacctaaatgatggcctatcttcaaccagaaaatcatgtctactatcaatgaaattgagaactgaaatactatttcaaaacttaacaaaattacataagattagaacagtcagttataattgcaaatgtaactgaggtatagttccactgtaacttcactgagttgtactgtaattatgttttaagttaaaattattgtaattacattttgtaatgcttttatttacattttgcaggaacaatctcagctgtagaatcaactaaggacatcaagttggacaccaagaaaaaagaaccactacagatgaaaagtacataaacaactataaatagatactatattgttcccaattaactcaaaatagaaatcaaactattttgacctattgaacaaattatattaatgaacctttcatactaccaaacataacactgtagtttctcatgaaaacttcaattttctccagttgcaggtcatgaagaagtacaagatgaaaaaagaagaagccaagaatcagataagagcaatattatggcaaaacatattaaagaaaccaaaagtcagaccactgaagttgttccaggtcagaatggcattgttattactatattcatgcaaatctttcaagatactat

SEQ ID NO: 9203 - DNA, 877 bp, Oryza sativa
tgtaactacagtgtatatggactgtaattggactataaggggaatacattaagcaaaatcaacatcatatgaagaattagaggctaaggataatgcagtagtatgtgaaagcaaaactaatagagtgggacttattcagattcaaaaatataaatcaagcagtatttagcctcaaaaatggtgtcaaaacaataaaaaaagcctttcattttgtcaacatcatatgatttttttttgcaaaactcaaattttgactaatgatgctttcattttcagttctaggatctcattacctccaggattttggaaaaaggcaaaaaatcagcaacaattggatcagagattggcaaaaataaagcacaaatactttatgatcaatacacatttcttaacgaaaatgaaagactggtaagtacaatcatgttttccaaaaatgaagaatatatttatttctttgtcgaataaatgtaaacaggtgaaggggggacaaatgagctatactaacctcatgcaacacataattctaagtccacgtgtcagcttgcaagcaaatgaagtatcggaggtgtacaacttgggaattttcaaaaagtaaataacaatttctgcaagcatcggaggtgtacaacttgggaattttcaaaaagtttcaagatgaattaatggagacattaaatcttgaaatgtcagctatacaacatggaaagacatacaaggtatatgcagctgcaaatctaatatactggtggttcacaaaccagacagaaaaatgttttcacatttacttttactatgcagattatattgctatatatagactatgcactgttcagcattcagtacagttaaagatttgtctcatttaatgctctcccca

SEQ ID NO: 9204 - DNA, 670 bp, Oryza sativa
attgattgcgccgtctggttttggcgtcttgtttgtcttgctcactttcttgggtggctctgctgtggcaggcgggctgggcgtatgctcgaccatgtcgaggctccgcttgtaacattgtactaccagcttagcgttcccttgaatagtgattgttcccttcagtcctgtcatcttgagcacttgatacgcatagtgagatgcggcaatgaacttcgcgagtgcagttctcccgatgatggcattgtatgctgtatcgaattcagcgacatcaaaggtgatttgttccgtttggaagttgtttgcttggctgaaagtcacaggcaacgtaattttacccaatggtttggacgatgactgaggagtgattccatggaagggttgatcggtgggcatcaactcgcttcgtaggatccccattgcgtccaaagtgctggcgaagagaatgttgattgagctgccgcagtcgatcaagactcatgcgatctttatattacgaatagtgggttcgaccatgatcggatatcgccctgggatgatagcagtcttggggtggttctcttctgagaattctatcttctgctcggaccacttcatcttgggcgcagccccctgccacgtcgaacagacttcacgttccgctttcttgtaatctcgctttgaggagtat

SEQ ID NO: 9205 - DNA, 888 bp, Oryza sativa
tagctgcttctcataattctaggaatcaagactttttgcatttagtgtataaaagttatagcaagtttttctaaaatgctatctaggccagggtttacgattccgacaggcccttccgtttcgggcaccggcggaattcgggatttcgcgaaatccggtgaaaaaccggtaaatttcgaacaaatttcataaccaaaatttgaatacaaattccctgagtttgccgataagttctcaaaaccagtcggttttggcgaaattcagatcgaaatcatcgaaatttcgatcagtaactgggcctagtacatgtattctggcccatgtaagtgttttcctttttttttaaattctttattcttttattttctgagctaagttttagtaaacacataatacatcattttttaaaaaatttatatcctaataggttatatgaatatcatagtatttataagattttttttcttttttttcttttttatcaattcaaatttgaatttggatgaaactcttcgaaatcttatatggtttctacttttgagcctcatcgaaacgtcgaaatttcgcgaaatccaaccagatttcgtcggaatcgtaaaccctgatataggcaatattagatgttggggttggttttcataacaaaaacatgaggtaggagttaggccccatttgtttggtccattggcttcagcaactctcttgttattcgttagcatcttttttcgaagagcgtgttttatgaaaataaattgtatatataattttttaaaaaaaaatcgaacaaatccatcttttaagtttattataattaatattcatttagttatacgctagtgatttatcccatttttcaagtcttcaaccgtttgtacacctaatttaaac

SEQ ID NO: 9206 - DNA, 731 bp, Oryza sativa
tggaatcttcttttcacctgacttgaaccagggtgcaccttttagctgacgcagactaggttgcggtagtttaatgatgcttccgttccagaacttctcacgattcatatcttcggcgtcaacctcacacaagttatcaacttcatgtcatgtgtcgtaacctgcttgtcattactaggataccatgcttgtcatcatgagaataccatgcttggcgtttccttccagcttaccaccatatgctttagactatgatatcccgcttactaaggataccatgattgacaacttgccattaactgtctcatattagctttcctggtctccggtgctaggtacttctgctattcgatgcaagggtcaaccactcttactataagttatgcttcccaagagaaccaatttatcccacttgacatgctttgacgtcttcccgaatgactttgctgctggacttgttattgtctgatcgtgatcctgccagatctgaagcttcgttgttagatgtgattttgatctgacctctatagattatcttcaaacatatcacttgttccataactgggaatggctctcacgaacaagcagctcggattcactttccttacatttagtttacttcccactattctctttatgttgttatcatttagcattcaacgtattcctttacaccttcagccttgatgtgttctttctcgatggatcgattgctaggaaagtgcgttgaa

SEQ ID NO: 9207 - DNA, 1046 bp, Oryza sativa
caaaaggatcctttttatgtgtgagcatgaggagagtcagacaaagagtattacttgttccatattagttttacctagggcaggtcttttttgttgaagaacttgtccagatgtttggtcagaagggcaatgttttacagttccaggtttataatgcccaaaccacctttcttctttggctggcatactaggtcccatgtagccaaggagtggatcttagtgtttggatcatttgacttcctccaaagacagtgtcttcttgctctgtctatgtgttgaatcactttttttgaagcttaagagtgcacatgtagaaattagggggagcatatagaacaaaatttaccattgttagtctctgaccatgattgagaaaagcagctatagatgggagccatctctccactctgtcaaccagaggggcaaagtcaataatctttggttttgtggtccccattagtaaacctagataagtgaagggcatctccccacttgtgcagccaaaggttctagcaagaacttccattttttgactgtcaacatttatcattcccatttcggaggctattctgatttatttctagggatggaactttctgagacaaaccgatatcgatgtgccatttcagagtttaataaaataacagacatttatcattattacattcaattgtgtgcatataatattccaatgactaaatcccttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcattaccttattgctaacagacagtag

SEQ ID NO: 9208 - DNA, 846 bp, Oryza sativa
aatactaggaagttacacatgcaacaaatcgatctattgctcaacaattgcggagaaacggaaggctaatctggatggccgagccaaggaatacaaagggcgttctcctcactcagcataaccgagggatattctctgaggacttgtggcttgtccaggggaggcccgatgtgatcacagcggagggttgacgcccacggccacactcttcatgtgtgctggaacgcatgttgcgttgccattgacccacaagtcaaaagtaactaaggcaaaaacaaaagttgttaggtgtggtgaggagaagagggaacaaagagatagggaaaatcttgactcatttgtaagggaggacgtcatcttttttatgcccgaagaagatctcgaggtggaaatgattgctaagagctttatctcccagcgggaatggctagaacgcaaccagggatgatggagacacggtgtggagtgatggtctgaggatgttctcgaagtcatcgggtcaaggtggaggtggccaagcccagggtgtgctagcgcgttctaacgccagcacgtgtcgagggcggtggtgtgactgccatatgggtctagggggtgctgggtggatgccaaatgagccatggggcctgtgaggtccaattggaagtgagggatgaggggaaaccaatgcttttgctaaatcagagaatacttgcaatgagatgttttccagcataggttttatacatataattttagacttgcaggtggtagggctcattgtttttaatctttactctctcataatcatctttcaaatatcagcagggctcattggtagcaactctaactcgttaccattatatg

SEQ ID NO: 9209 - DNA, 321 bp, Oryza sativa
tctgggtacggagtaaagcgtgttctggtagcagcgagcaagccagtgcctgatattttcttataggattaaaccaagctttctatagacacagtttctcgctaggaaatcctctctaccattttcctatctttgcttcgtgtccttggttgaacctagagaagagttgaacacacatgttccttgtggaaatcgataccttggaatactcccgggtgaagcgctacatcggtatatccgtgcgcttgcggattttatatgtgaccttaagaaataccaatagtcgagcttaccaataactcgttgacgagtcttgacaaa

SEQ ID NO: 9210 - DNA, 873 bp, Oryza sativa
tgtttaacttaattcttctgcacttttttactgtcttcgatgcataatcatcatattcactgtcactgaatttatgtgcttcattttagcgacatggggaggagctaagttatctgatgtccttcagctcattggtgtgccatatcatactgaaattactccatcaggaggaaagcatgttgagttcactagtgtagatcagtgccctgtgagtttcttgagacttcatttatgaaaaaaaaaaatatatatatgacagctttagttattttttctataacatctttttcaaaatattattaggaggaaaaaggtggcccttacaaagcatcgatttctttaggccatgcaacaaatcctgcagcagatgtactggttgcatatgaaatgaatggtgaggtaggaccataggagataataataggttatatcttatataccatccttacatccatctatcaggatatttggttatttcatatatctgtgcatttttctaatcatatccctattatgtgtttttgttacaaaggtgctcaagcgtgatcatggataccctctccgtgtcgtagttccaggtgtgattggtgctcgttcagtcaaatggttggacagaattgacataattgaggaagagtgtcaggtatgcattatctaacttcttgtcaatatgtaaatatattttcagtttgccaaaaagatttttgaaactcgttcattttcagggtttctttatgcaaaaggattacaaaatgttccctccatctgttgattgggacaatattgtgtggtcaaccaggaagccccaaatggactacccagttcaggtgttaattcttaaccgtcttgtttccacacagtaagagcaagagc

SEQ ID NO: 9211 - DNA, 671 bp, Oryza sativa
aaaagaaagccaattaaactgtgttgggttaaaaagccaatgagacagtagttggggataggagtttggatacgccttttacagatcaagataaggattgttggatgaaacccataagggtacccgccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaagacagcaagccaaaggacctcatcgtccccagaagcgtccgcaatccacattaaagaataccacctgttagagataagctgaaagatgattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagt

SEQ ID NO: 9212 - DNA, 937 bp, Oryza sativa
agaagcggcagtaaggtttttgggaagcgcttcacgcgactgctccctgtttgtccgcgacggctcgccttcctcttcgttcgcgtgctgcgcgccttcgtcgacgctcgcaaccgcgagtagttcctgccgagcaaccggtctttccgccaccttggtacgtgttcgacatgttgcgcatatttgatctgtttatgttttactgcttagtttacatgtgtagatctaatgatgcgttaatgctagtatacatctgtaatgtcatgatttatttatggaatatattaaatcattatatgcctatattctcaacaatccaaaaaccttattataggcgctatgattttactatggctggttttgccgatgcactgaggccggataaatttaccggtgtgcactttaagagatggcagatcagggtcactctgtggctgacagctatgaaatgcttctgggtgagtactggcaagcctatgggcgttcttaatgctgaccaggagaaagaattcgatgaggccactactctctttgtgggatgcattcttagcgtgcttggcgatcgtctggtcgaggtgtatatgcatatgaccgacgctaaagagttgtgggatgcactgaatactaaattcggtgctactgatgctagcaatgtgtcacgtcctgataaattcatcccgaaattaaaaatcattttctaaaaggaataatagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaaatcctaaaaagtccttttttccccctccccct

SEQ ID NO: 9213 - DNA, 2153 bp, Oryza sativa
ttcgccgcatccccggcgacctcgtccacccctccgtttcgctcgccgaccgccggagcaccgtcgaccccgtccacccgagccgcgccgccgccttcctccgctccggtcgccgtttccgtcgtcgccatcgacccggggtgagccgtggaccgccgcttcttttcccccttcccttcccctccctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcagctgacgcgtgggacccacggcgccggccggtgtgagcccgggtgcgcccggtccaccgtggaccgtggggctgccgcgtgggccccacccccgtggaaccggtccgcgcgcccctcccctcggctgacgcaataaatccattttaaattaaaaattaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacactgcagcttcggaggatccgctcttcgtggaagttgaagccggcgtttgggaaagcgagcaaggcaagtcacatcatccttgaacatattgaatcccagtttataaaattattttaatttaaattaatgcattatcgctttatttaaattcccgcgttaccactgttttatttagccatgcctatttacctttgttatgaccttattattgttgttattgttattattaccttgttcaccctagaataaacaaaaccccaactagtgggtactctattcatggttccactagtatgaatttaggtagatgcttcgctgattaataggacaacattaggtggttttataactttagacttggggaatattcatatctcttggacactatggaatggttggcttatggtggaattggacatacacctctcttcctctttcaaaacccctaaaacctgtttttcggtggggtttgggtgcatgccagttgtgggaagtagcaccccggccactataaggactaagctcgggcctctgttgcaaagcactaccgtactaccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctgggggcttagtcctgcctacctgtcccgggggttccggccgtaggtggggttgggtcggtactcttgtttatggctaggatgggttgggaactatgacacgtcttccgtccgtataccgtggtggtatgtggcacatggttacatgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggtcgtgagggttcacggccttgattaataacactgtgtaactctaggatcgtctttataaaatggctttgggcaactaagtgacttttaaatgctgttttctgcaaaacttaacccctatattattatccccttgtactcccttgcaataattatgcatctccggtgtggcttgctgagtactgtggttgtacttattcttgctcaatctttcccctcttcagtaagagaagctttggagaagatgtcttaggtggagtcctggcttataccccagttgagcgcctgtgaagatggagccgtaggcccgctagtccgctgctgtttatttttg

SEQ ID NO: 9214 - DNA, 656 bp, Oryza sativa
gatttaatatctatttaaccaccaaagaatggttcaatcaatatttcacaaacacctgccattctcactccgaaaacctgtaaactactccaggaaaccataaaataagcatgacaacaatcaacagtgccaccacaaatccaaagaacaaatatagactttagctttcctgcaagagacattctgagtaaacccatagaaattccaactcttaacatcagcaaaacaaattcagtaaccacaaattaagcatgatgccaacagcattgccaatcgaaagaacaaaacctaggcaagatgactgcgttcttacaaggaaaattctacataaaaccctagtagaaaggatcatccttctacttcaaatctgtctctccacagtacacaccactagcactacaatcagccctcattcctaaaacaacaaattagcatcatcacaataataaaagtaaagcttgattatcctagaaaatcacaaacaaacctggaggagcggtgtcgtgcaggcagacataaaccgggaggcctccctgcgcaaaaaataataataaaaaatcataaaaatcagagggcttttcacaagaacccttctaacatgccaagaaaaaggctggtccattttaggggtgggggggaacgaacgcaccatgctg

SEQ ID NO: 9215 - DNA, 674 bp, Oryza sativa
agatttacctggggtatgacatcagggaatagatctgtcataaacatcgaagccgattgatgaaacaagtgcagcttccattcaccccaccatcagttgaagtttctgctgttaaatcctaccaactcaatattgtcaatgctgcccagaggggctcctgggaggttaagtagtcgatccaccattagagttgatgtgatttctcctcggcactagatcttgtcggcaaagaataagccgattgggagttggcctagtccaaattgtctagctgagctcattgggtggtagaactcataagaaacttggatatttcttccctgatgaatgccgacaggaaggatgcatgggctgattgcagctgtaagaacttccctggatttttgatacttttcgtgattgatatcttcaaatctaaagtctgatggaagttcaagatctgctgagtcctcataagggaaccaaacccgggcgtctttctgaaagccttcatagaagctgcagaaccaatccttgagtagctcagccgatagctttgctccaggatcggttggtgaggatgcatattctccgtatgatgtgcatctgcgatgagtgcgttcttttccatcaactcctacaatcggctctgggaatgggaactcagcttctgtcacagatggccgattgacaac

SEQ ID NO: 9216 - DNA, 2351 bp, Oryza sativa
ctactccagctaggaatagagtactggatagctactgcgtgaatatgtacgcgtcgatcgtcttgtgatgactaccaggtcgtctgttgactgatcgatctatagatagatagatacagtttgtttttgacggtcaatgtatacgtgcaaaacgccgaagaagctagtggactggtggttaaacttgaacaagcacgttgcttaattaattactccgtccgttcacatatggtatcctcatcatcccgtaatgtatgaaactactgcagaaaggatcttcacaaacggccaaagctagttttcatatcagggagctccactcagaatgtttttttttacttttttagacttttttatgttttagttttattattagaccactcccaaaagtattttcgaaaactgaatcttttgattaggcgtgccagcgatgtcctgccacgtcatcagtggtggcgtgacaagaggctggcgtggctggtatgatagagttatttggccacaccaaggggctggcgtggccaaattaatacttttggaaatggtctattaataaaattaaaatataaaagtctaaaaaataaaaaaaaattcctccactctcaagtaataggtgtgagttgtctacgaaaatcggtattttaacgtgcgagcatcacatccggatgtaacaaataattttcacagatggacatcctaaggaggtcattataaagacccgatttttccaagtagccaaataaggaagcaattatttttttcaaaaaataaaaaaaataaaagaattccaaaaccctagccaggtcatcgtgaggccaccgccgcagtccacacgcctcagctcctccgcctccattttaactacgctgcccttccgcctcctctccgtcgcgctagagccgcgagcaatggatccgccctccccccctccccccgggttgggggggaggggagatcagccgctcttaagcctaccgacggtgctgtggtcgtggactcgtggtcactgctcttggtgccacggtcaccactaccgccccaagcccgaagtccgccatcgccattcagagaggcaaggaggctagtcgacccattgggagagagagaagagtagagaggaaaagtagcagtgagtgaggggagtgagagtgggagtgggagtgcgaaggaggaaataaaagagaggaagagagggaatgcaaaggggagaggaaaagaacaaagatattaggatgggggagcgtgcaacaggtaggaggagaagagaaacccccttgtgaaaatcaatttcgtagacatatctcttaatcaagagatctgtctatcaaaatagctattttctcaaaggagcctagtaagaaactcgtctgcgaaaatcggttttgacaaacaggccttgatcgaacatcatcaatgaatttttcatatggatcacctttcaaaataaagagaggtgtccgaaaaaatacctttatagttgttgcaacgtgtcaaacagaaagaaacaaggaacagagggagtatgaagaatcattctaagttaatacgaaagtataacaacatctccaccatcaaattagttttatattaaataaaatattaagtatatttttatgatatatttattttacgtcgaaaatatttctatattttcttcaaacctgattaaatttgaaaataaaaaattgaaaatgtcttataatatataaaacagatagagtatgagttacggagacgtctaaataacaaattctagagttctaacaaactcgatcggtggaacgtgacatgttctagagctcagactattcgtcgcgacatatattttaatcttttttaccgcattgctatttgccagcgagatcgatcggactatacatcttccgagccatagctagaggtgctggttcggcaagtatgtttacatgcatgcttatgatgaatgcgtcgtattatatataaacacgagcctatacgtacgtatgtatacacgttagtattcacactgcaagtgtggacatattttagtatttcactactagagaaaccatcgtccaaaatccataatagtcccgatttgaataggaaccgggactaaagatgatttttaatcccgattaaaaactttttgatctttcatcccggttggtaacactaatcgagattaaagatcatttttagtcctggtttaaaaagttgttgggatgagtcagggctccgaatatctttaatcccggttggtataaacaactgggactaaaatatcttttgtcccggtagcttatacaaaccaataagttcaccccgatatgcgcgcatcgttcttgatcagtcgctgtcaatcttatccc

SEQ ID NO: 9217 - DNA, 971 bp, Oryza sativa
ctgcgttttttggtgggacttcctaactcttcgtgtgcaacagtagcggcggcctgggggttctgttgctcttctcggatctcttgcctaatcttggccctcatcaactcgggcttttcgtcgaattcagatgtcagctcagctcttatcgacgcctggatcttggcttcaaggcttgtatctttctccgccttgttggaagtccgcttcttgtactgccacgcgtagtctggaaatccatacttccagggcacagaagacccaacgccctgtgtgcgtccacggtgttccttgttgcccaacgctttcgtggggaggtcgtcctctcgtctttgagagcaggcctcttgcgaggcttgttgctcggcaaccaactctttctgcattacaatttagtggggttaaatagactgcacgataggaaacaatgtgaacatctagtttgactagacacttactatagcttcgtatagtccttgatcttctgcatttggcatgaagattgtgccatcatcattcttctggtacctggccctggcccagttcctagcccgagggtgtgggatatcgccaaacacgagcggtgtgcacgattcttccgcttcttcatcctcacgctgccattcctcttccttaccggcttatccggcggtgccaagctagtgcggatgttggttcctggtctagagcaagcgatatgccttgcttctagctcttgactctagggtcgacttcttcacatggaatttctctcttggatctggattcgccgggttgtagatgaactcgcctactagcttagtcttgaagttcttctaagcattgcccataaccttgaaagcagcccgcctgagacggtcctcatgctccgcaggataatcaaaactctccttgaacgttagccaagcaatgtccttctctgcggcgggcacgaacttgatgtcatcttgtagaatactgaatttctgcct

SEQ ID NO: 9218 - DNA, 1599 bp, Oryza sativa
cacaggtgctgattcacatgattttccatataggatcgagcatatttctgagcaatcaaagatataaagatcaaaaaaataccctgttccccaaacccaacaactacgtaaatgcatgtccctctcaaaacctcaaattaaaattgactcacccctaaaagttttccagccccctcagtgggccccactacacacgatcagcatgaagtgaacacatgctttcacacaccatagtctctctatatacatctctctctatatatatacgcactaacaccaatagctaatgatgcatgtaaaatacataaccctcacttgatcatcatcaccaataattccccatttgcaacacacaccatggatttggagagctgcagctacgtgctgccattgctgacgtgctgcctcttcttgctctactccataacctgctatgccttggcggcggcggccggcggcggcggttcttgcggcggctccgacgatcacgccgctccccggagctacccgctggtcggctgcctgctcgacttctaccgcaaccgccggcggcttctggcgtggtacacgggcctcctcgcggcgtcgccgtcgcagaccatcgtcgtcgaccgcctcggcgcgcgccgcaccgtggtcacggcgaacccggtgaacgtcgagcacgtcctcagggcgaacttcgggaactaccccaaggggaaggcgttcacggacgtgctcggcgatctgctcggcggcggcatcttcaacgccgacggcgagcggtggttcgcgcagcggaagctggtgagccacgagttcagcgcccgcgtgatgagggaggcggtgggcgtcgcgctggagcgggaggcgcgcgcgaggctcctgccggcgctcgacgcggcggcggagggtggcggcggcgtggtcgtcgtcgacgtgcaggagctgctcaggcagttcgcgttcaacgtgatctgcagggtggcgctcggcggcggcggcggcgaggtggcattggcattgccgctgtcgaggctggccgcggcgttcgacgccgccgcggcgatcagcgccaggcgtggcgcggcgccggtggccgccgcgtggaaggtgaagcgcgcgctgggcgtcggctcggagcggcggctcagggaggaggtgaaggtgatacgcgacgcgatcatggagttcgtccgtgacagcagcagccgccggcggcgggagcagctgctggcggcggcgcgcggccgcgacgacctggtgtcgcggatggccgcggcggggtaccccgacgaggcgatctgcgacatggtggtgagcttcatcatggccggccgcgacacgacgtcgtcggcgctgacgtggttcttctggctcatgacgcgccaccgcgacgtggagcgggaggtcctggacgaggtcgacgcgtgcatgggcgacggcggcgatggcggtggcctcgccggcgtggacctcgagggctcgcgcagggcgcgggtgctccacgccgcgctctgcgagacgatgcggctgtacccgccggtggcgtgggactcgaagcacgcggcggaggacgacgtgctcccggacggcacgcgcgtggggcgcggcgac

SEQ ID NO: 9219 - DNA, 896 bp, Oryza sativa
ttcttaataggttcttaatagatgacgctgttaacattcgaatatacgtttgactaattatctttttaaaaattttttaatgtaagtgtataagatatgaatcatgcttaaagtatttgtgaaatatattgtatatggtagttagatattaatatttgagtcataatatcttatactgcgaatatttgactcattgtggattccttcagttcttccatatctgtaatttttctttatcttcttcccatgtactcctatatgtacctgcctccgcaggcttaatacaataagtcaaatattcacagtattcctttcttcctataatattcaatatggtatcagagtgggcgatctagcgccgctcgaacgcttccgccactgctgcccctcctccccggcgaggagtagcgatctccaagggcggccatcatttttcctttattttttccatcgtctgcaccgttgcctggaggaattgattagagtcataatagaatatgattgatttgtgtgtggactccttcatatatgtaatcttttcttatcttctcccaacatacttctatatataccggccctataaaggcttaataaaatgggtcaaatattcgtggtatttctctcttcctatactattcaacaggataaaataactcacaataaaatagataataattaagtaactttttaataagatgaatgatcaaaagtgtgttaaaaaatcaacagtgccatctatatttaaaaattgagggagtacttattgtatatctatacaaatattctccattgttttgatttgaatagatatatgtacctatggtgactttaagttgaatagatatatgcattattttgattaaatttaacgaaatttctactttttattttctgaa

SEQ ID NO: 9220 - DNA, 1350 bp, Oryza sativa
ctgctaaaccaaaggaaggggcttctttggcatatacccatggacaattcagggcatagtgtcctcgttctctacaatcgtgacaaaaggggacatcctcttctggcattggaagctcattgacctgggtggcaaatgctcgatcaaacacatactgattttggtcttgacttccaaccaatggtagctgtgaactaagcagcatgcttggaatggaccaagggtgtgcccttgttaactctcttgaggccagtggtggattgagttggaaacttaagttactagaggcatacccgctgacattctttcctttttctctgttaaacatctgtgatagggattgaggtgagagaggaaacaagccaggaaagaatagaccagaactagggacaggaccttaaaggaactaactcttcttgttgatgtgttgtttgtttcacttattctgcaagttgattaagcaaacaacctagcatggttacatcacacaccactgatgcaaaccacgcgctacacacacaagcaaaggagcacacgactaacgaaacactagagggtggcttaggttctgcgacgggttctccaagatcttcactcctgcttcacagctggcttcattgcttccttcgcttcgctagcggaccctgcggtcttccggaccttcggcgaacaattgacgacatcttcttcttcgtaaaactaaccatctagtactagctgaaatttgaagaaggaagaaagagtaaacattttgcaaatagcacaggggaaaggaggaaaaagggactttcgcaaatagtttcgtttataaaatatgtccttaggttttatccacttggcttatcctacagtcgagatggctctgataccagcttgtcgcgaccgagaaaattgccttttcccgaacgctagtgtattaatccccgtcccaggaaaagccggggtacaccacacaaacatgatataaaagacacatctttattatatcgataatatttacattattacaaaggcacctcaggcctgacaaacaaaaataaacagcagcggacttgcgggcctacggctccatcttcacaggcgctcaactggggtataagccaggactccacctaagacttcttctcctaagcttctcttactgaaggggggggaaaagattgagcaagaatgagtacaaccacagcactcagcaagccacaccggcagatgcatgattaatgcaagggggtacaaggggtaaaaatataggggttaagctttgcagaaaacagcatttaaaagtcacttagttgcccaaagccattttataagacgatcctagagttacacagtattaattaatcaagg

SEQ ID NO: 9221 - DNA, 1451 bp, Oryza sativa
tcatctgctccacctagacatcaccatcgtgtacaccgactggtatggcggcacgtcttccagcttaagggtggacgtggtccaggtatacccacgggcctcgttggcccgtcccacgattttggcatcaatgggcagatgggtcggtccaaacaaaaacaatcagctctacagggtacccgggtcggcttcattaggacactgaacaggctgagcgcgacaccccttcctctggcggtggtggcgcgagcgccccttcctctcaccgtctcacggcggcggcgaggcgcccatcaagcgcggaggcggcgaggttcagcttcctctcatggtggcgccgctccatcgtgcctgtcggtcccccttccccactagcaccagcgtcaccgctggccgagccgcgcctcttcactaccatcctgtcgtccaccaacctccttgactccctacttgctaccctcctttgccacctctccctgcgcctatctccgccatctccttcatggcgatggcgacacgacctcatctagcctcgatggcggtctccatgtcaacagttcctcctgtgtctggagatggtatgttccaactagccaacaactcctcttttattgatttcaatccaagaaagcatgtttttcttcttaatttcgatctactgtttccttgccaagtattggcggattgctagctaataattctgtaattcttttgtaacgtgggaataagttcatacaaattgaattttcagtttcagcagaaatttttacagttcagttttagcagaacacttagttcagtttcatcagagagtttcacttcagtttcagaagaaattttaagttcagtttcagcagagattttatttcagttggctgatttcttgacaaatgtgcagaccagagctctgcacaatttcttcctcccacccttctgttccttttttatgctccttctgtgttttctatattcggcctggagtcctcatgttgaatacaagtgttatcttggtatgagattctaaagttttgtgtattacatctgtgatttgtatggattgacagagttgtgtgtattccatgtttgaaattgaatattcggcacttggtagaatctgatgatgctttgttgttcatcacgtgttaattacaaaaatcaatgatagcacatactgatgggccgacccattctacccaatggatccaatggacaatgggtcgacccactcggtattgttataaaccatttgggtaacatggtctaagtatgggtcgacctgtcccggaccacacccacccatgttccagctttgtggatgcacgagctcattttttttctttctttctacatatgcagtggctggctggttgctgccgtgccgactgctactgtagtgcaccagtagcatttcatttgaggcttttcagctgcctgagcattataaagaatcc

SEQ ID NO: 9222 - DNA, 1925 bp, Oryza sativa
ttcaacaacctcttcctgaactgatgtctattatacactcacgtgcaccatcctctaaatcagatgcagcctatttttggacctttagacttcagcacccaaactttcttcctcggtgaactacctcttccttgtacaacagattgattcttgctagacggtcatccttgccatgtgactgttttgcaaaattcaatcgacttacattaatagccgattgtattttctgataagtattacaatcactagtagaatgatcaaacaaattatgccacttacaaaacttggcatatttatgaatattttggttgtttatatagtactattttaacttggcaattctactagggaattatttttataattctatatatttagctcttctcttatgtcagttatattacctaatagatataattaaatattactaaataattcatataaagtctaaaagatgtaaactcgtgtttatgcttcaactcaattatattgaatgcacgtgttggaaacttagactataaaatcaatactcctcatcgaaaaatacatgtacgaggacaaacttgttattcatccctactagtttatccaatattcctcgtatttgccattcattcttcaattgccagtggccgataaaaactgccaatctataactgtatagttagaacacccactaaaacataatgtataccatactaaccaactatataggcgcatgcaaggataccaattacatctaaaactcaagatataagtatgctaaatctcattccacatatcattttcacatctcaactccatataccatttgtacaacatcatatagattcatgcatatatattccacagtaaagcgcgggatgttgtccattatatataaaaagttacaccacacttatttatttggaatgatcacaattaatcacaaacaacccaagcgagcacacacaattttgtctagtttcacaacaataaatatacatgatatagactagccaacggacgtctgctcattgaagaatgagtaacaagttcaaggatagacctcgatgattgacctgaagcccatgactggcatgatcttgtagctactaaatccagcttcaacgaaaagtttcttccactcctgttcatctcgctcaacgccattgacaaacatgatgagcgcgtcaaacaagatctgcacatctctgtgcttttggtcagatgggccaactccgaccactatatccatgattatcacctttccaccggcgtctctagatgggatggcttttttgcagttccgaagtatcttcacacagtcattgtcactccaatcatgcataatccactaaatatagaggaaacacatatatatgtatcaataaaatctgtatgtacatgtatacttctattgataggacactttaagaatattccaattttgataaatggtgaaatagggaatatttttagccataaacattagtgggaccaaactgtaatgtcttaaaataaaatttagagtcgatatcaattacaaattgctgattactattggactagtcatcaaccttaatttgcacccacaagggaaacatagttttgtaagataaatttagagaatttcagtgtagggatatatggaattaattgcggatatgtattttgagagtttagggatctagatgacacaccccttcatatatgtgtcaattagtgataaaataatttacaacaaattaaatgactgattaactccgtagatagaagagatagaaatatacatagatagcaactacatagaaaaaaagttggctaaagtccagttaaacatgtggttcgatatttttagacaaaaaaaccaaaatatacttgagagaatttcgagccaaaccaatctatgtaccttgaggaagacagcattggctgctggaata

SEQ ID NO: 9223 - DNA, 765 bp, Oryza sativa
aggaggcggaacaccggcgtgagcgtgtacatgggcgcctagtcggcttcggctccggcatctccgggcgccggcttctggacggcgaagatgccagagagagtgagcacgcgcatgaggcggcgcaggcactggatcttggaggggtggagcgtgaccctggtggctatctgggccatggtggcggcgccgccgtggtggtggatggcgtcggcgatgccgaggtccaaggcggccttgagagccatggacttgatgacggagaaggtgttgccgtagagctcgctcagagcatcgagcgagctggtggcatgttgcccgttgctctgaatgggcgccatggcactaccaattaattttgtcttccttttagtttggaatgggtttatgcacaagatgcactataaatagaggtctcaaattactgtatcaatgcaactcgttctggaaacatagaactactatactaggttatcagagaaaatgaggaaaaatgtactagtttcagggattccaaaattccaaaaacaaccagcacaatatcctatgcaattatgtaaccaatttttaatttaaattatgacatttggcaaaaatgtaaatgcacattaaagtatttgctgttgtttctattatttattgtgttgcttccatttgtcaatatagatgaaatgaaacaaacatgtccgctagaaggatctcgcggcatcatctcgctggagactttgcgtattaggatcatccaaacggacatcaaaacatttt

SEQ ID NO: 9224 - DNA, 1450 bp, Oryza sativa
ccacgggggaaatcaaggccgacaacgccatcaaattcatcagagggatattctgcaggttcggattgccccaccgtatcataacagacaatggctcccagttcatcagtgccgatttccaggattactgcatcaggctgggagtcaagatctgcttcgcctcggtttctcaccctcaaagcaatggacaagtctagagggcaaacggcatagtactacaaggaatcaagacccgcgtctacgacaggctcatgtcacacgacaagaagtgggtcgaagaacttccatcagtactatgggccgtgcgtaccacaccgacaacttccaacaaggagacattcttcttcctcgtgtacggctcagaggccatgctccccaccgagctacgacatcaaagtacatgagtacagaagtacttcgatgaggatcaggaggagcagcgatacgacgatgtaaatctattcaaggaacattgcgaacgagttgccgtttgagcagccagctaccaacaagccctttgccgttaccacgagaagcgcatccgagcacgcacactttcgatcggcgactacgtcctccgacgggttcaaagccaagcagggcgcaacaagctctcacccaaatgggaaggaccgtacacgatcacacaagttctgcggccaggcgcattcaaaatcgcagacagcgatggtcgcgagttggcaaattcctggaacattgatcaattacgtaaattctatgtataagtcaatagtatccatacttgtaagacatcttacagcctcaataaagcctatttttcaggtatagactacaatcaaagtgttccttcccgatgatcccttacccagatgacacctagcgttgaaacctatcctcatgtccctttacgccgtcttgacaaggcctccgaggaacctaagggaacttcggctggggacgcccagagccgataaggtcttgtcggatcctgtagagacgaaagaccatgtaagatctggtcgtgtaagagttctcgccgtgtgtattaaccaagccgtgtaatcggaaataaactttccaacttcacggctgggggctaggatcagtgcttgttcaaccaaggcaggtcaaaggtccaagagccttatcttccgagaagaattctccgatgacaaggctgggggctagggagagtgtataactcaaacgactgatcaaagtcgcgaagtgagaagacactcatacacactacatccagagtaagaaagcttagttagatattccacaagtatttcttacaatcccatcaaaatccataactatattacacttttttcctaagacatttgacacaggacatgggaactaccaggaaggccaacgccaatccatcgactggaagaccttctccgtcagcggcgccatcgacttcgccaggccatctatctccacaggggttcaccgagaa

SEQ ID NO: 9225 - DNA, 696 bp, Oryza sativa
atccaggtccttccttataaacttgtttttggacatgagtctattttgccatgggaagttagaatcggctctagaagaacggaattacaaaatgatttaacagccgatgagtattacaaccttatggctgatgagagggaagatctggttcagttacgattgcgagcccttgcaaacgttaccaaggataaagagcgtgttgctcggcattacaataagaaagtggtacccacagatttttcggaaggggaacttgtatggaagttgattttgccgattagaactcgggatagcaaattcggcaagtggtcgtcgaattgggaaggaccgtttcaaattgtgtctaaaggagcttacatgttgcaaggactcgatggagaagtttatggcagagcactaaatggtgaatacttgaagaaatattacccaagtgtttgggttaatgcatgattggctgatgttgccgatacataatagccgatgagttttcgtcatcttgagatggtcgatatagttatatcgcccttagttatttttccatattgtaatcggttgtggtttgccgatatacagccgatatacaatggctgatattattatatcgcccttagttgtttttataattttatcaatgcttttgacattgtaaaattaagggggcacatatgtacacaaaatgaaaatgaaaatttttta

SEQ ID NO: 9226 - DNA, 233 bp, Oryza sativa
tacaaatttgtcttgctttttcagcagagcgaagaaaggttgtcctcgctctcccatcctagcgacgaacctgcttagtgctgccatgcatccggttagcttctgtacttctttgagtcttgtaggcgactccatgtcctcgattgctttgatcttctcgggatttgcttctattcctttgctagagacgaggaagccgagtagcttgcccgatggtactccgaacgtgcact

SEQ ID NO: 9227 - DNA, 766 bp, Oryza sativa
cttttgaacatttacttatgaaccaaaaaagaatagcactcatttattttgagatcactcatctaattccttttcttgctaaatcaaacttttgtcccttgttgcaggatgaactgatcgcccgcttaattgagtcctcggagtgatctgaactgcgatcggaacctcattttgttggatgttgtaccgtagtgacgatcatacaccatgcaagtgaacttctatcgcagacctcatgtaagcatatatttcatacagtgccgaaatgaaagatctggctgatagtttccacattgcaccttgttcgatggagctccttcaacgtttgcacgacgtgttgtgtttaacactagtgttacccagggcaccaagtctgtctacgtccgattccctcttggtgaatctgaatctcctattctgacacttcgtttcgcatcgtgtcggtgcctgggtacacctgtgcaccctcacctcgtttgtactccgtagctttctgggtgagaaaggctatttagaccattcccaacccaagacactagacatagtttttataaactccgcgtcattatcatcaagaaactagtactaggcactattcttccaatgcaaacacaactattccatacatacttatcccacacaatgtcttggatgttgtgtagaaattatgtctcatgcaagatatggttttcttctctttcttcattattcgccacatcatttttcgtcctaggtggcagcttatataatgctatggacatcatcc

SEQ ID NO: 9228 - DNA, 2095 bp, Oryza sativa
agatggagggagcagtacaatctatagtggattattggcaatttggcactcaaggggggaataccggatcggagggggcatggcgccgccgcctggcttgcaagatgaagcccgtcgtgcagcgctgcggacactggacagtgctccacgcctcgattcacgggcgcgcgcgcgcgtggcctctactccgtcgaccgggcacacccacagcatcatcgatgatcgataaaacagtgcccggacgtttccccgctgttacactaccgcacgcccccggtcacgtaaccctgctgcactcgcagagtcgcagggcaccggcacgccacagcccacacccatactccgcccctgctgccagcctagctactctcacgcgttgcccgccccgtccaggctgctacacccacaccacccgcccgcggcctcgcccgcgcgtgcatgtgccgcgcgcgcgcgaggcgtccaaactacgtcttctcgcgtaaaagaaccgagacacgcatgaggcctgaggcgcgcggtggcgcacagctcgtgcgagcgcgttggggctttgcgggctatcctagatcggtgccgcctgatcgatgcccacggtctcgttggtgactatgtaagacaactagacgtgtctagaaaagcgagcttagctcctctcgccggccgagccaatctggccacgccttgctccacaactcgccggaccgaccaagcgcaaacggccggactgattgagctcgcaaacgtcagacgagcgctgcaccactacggacgtacgcgcacactagctttaggatatgatcggtgcgaaactgcatgctattcatttcattcctagagaaggatggatggaactagaagcgctatgtataaatctatattataatgtattcgtagatgaaattctagctaaaactactgctgcccagcttgcgattctcggcaccgtagtgctgattggtggatcgagcacgcaaacaatttctcggcatcgcgctgctattattgaatccgtctgacgtttcagacatgcgtacgtgtacgtggtgtactccgtgttggtttatgctcaactgaatatctttctttaaccaaacctgttatcgcagtgacgtcgacgtggttgaattatagctatacggccggttcttaattaactactctgtcatatttaccttgaggtcgtatggaattttgctggggaaatattcatatacaaggtgcttgaattggaagacacaatataaaagttcgagacaatacaagtccttccaataaacttattaattaagtactcttcaccaaatcacgcacatgatgacatgaaggcatccaactgaagcatttcctccaacctttttctatcattcctttggaagttccaatacgttttccctccatgtccctctcaatctaactaaaggatcattttcctttcagcttcctccaatttcctagtggagcacccaataacctcttttctctgatccatatgtgctaattttattgatgtgtaccactaatacccaacaaagcagcattttctcgttcatatgcactttttcctacctcttacattgcatatcaaacttatgagcacaggcacttttgctgttatagtgcatcatttgtggttcttttgcacttttaaaaagaaaagagttagcacctagatgtggtgcggtggtggtatgctctgctcaatcacatccatttctgcaccatatagaagatatttcctagcttagctagatatacatttataggcatgctaatgttgttatgtcgttctcactccacaggatgcatgtttacaaagaaaaaagttcgcacctataggtggttcattaatttccatgcagtacttaatttataggattattaactattgtttgtatattttaaccaacaaagatcatttccatctagctttctaaagaaagcccagtactgtaagtgtgtaacttactttttattcattcgacgcactgaggcaaaaagatagttttgggaaactattttaacagctcgagtggatgtccacccgtttattacatgtcatctaaaagggtatgaaaaaattgaaaaaatatga

SEQ ID NO: 9229 - DNA, 610 bp, Oryza sativa
ttaagatggtggttacagcgttgtccgcaacagtagaatcgcacactaactaggcctaaatctagcagccgccccgcaagcagagcaggtactctactcattccaatgttgactatcgcgggtacttcccgagaacgcctaagcatatcccgcagggggcagcatcgcgagctactgccagatcacaatatcacatcagtgagctaggcgctagcagccaagtagcagaaaccccgtaatgctcaagccacagcaagggagggagcaagaaaaacaaggtgaaggcgacgagtctacctaccctagaggccgaggcggaggcgcgcttctggaagcgggagccgccctgcagtgcccgccacggcgcgacggccgagcttggaggcggccgccatggcggtcgatatatgtgtcggttaactatcgagggggaggacgagtagggggttcccgtcttcctaagatgcgccgtggaggttccgttccgtgagcagcagcggcggccggcagcccgccctccccacgacggcacgatctggcaggtttttgggcgatatcgtagaggacggtggcttttccttttggccccctcccttcctttcctcgtttt

SEQ ID NO: 9230 - DNA, 672 bp, Oryza sativa
ggagtatcacccaggatttggtttgttcattttaaggaatgaacttcaattatgatacaattacatacactcgccttttatggaatattttcaaactttataagtaatattgaatgatgtggaactaagatggtaacccaaaagcccatctggatcttctctgattagaagtgtaaacactgtatatgacttatctagtgaagttccattttgccatcttcagggaatacacaaaaacacttcatgcttctcaatttgaagatcctcgtttcactcatgtatcctctaataaggtatgcagtacaacagtatgtatcctctaataaggtatgcggtactgcaaagtaatataatgtttggaatttggactctaggtgagaaaccaagaggttattcattgagaaaaaatatggcattaaattagcagggcatataatggtgtaagccaactttcttttcagaaaaagaaaaacagaaacaggggaattaatgcattgagtcatacatagtacctggaaaggcaaattctgcaataatttggaattttgtatatcctgccatattattgaacttagtattcttaccaatttgtggagaaaatacttctttgtaggattattttccatctgagtcgatgaatgcaacagggctgcaggaatagatgcagtcact

SEQ ID NO: 9231 - DNA, 28123 bp, Oryza sativa
  unsure (1)..(28123): unsure at all n locations
tgcttgctgcttacagtaaactctgcaataatctggctgacccccttattctcgaccaaacatagaattaacagcctgaaatggggggaaataatgacacaccaagctcaaaacatagttatcgggtgagaaaaaaggaagataccagataggaacagacccatgaattttcagatgaagtgtgcatgctagattgtttgatttcctaatgactcgagcataaaatagacttaagaatacaaagcagacgattggacaaatacatgatattagtacagacccatgtagtcgaagtgttgaaacttgaaattttgtcctacaaggtttgggtgtaatatttgaagttttgaactcacagggaattgtcaaaaagaaggatgtgctatagacttatagtaaaagcaaacaaagttggaccaataaaagattcaggtgtaaacttaatagaattgatagattgttcatgaataacctttcaatatttgaacacataatgttatgatcttccttagagcctcctttgtgagacaaagcaggaacaagagcttgaatgacttcagttggaggtcctttgacaaaaaacgaatcatatatttccttccttgcagaggcacggatctgacgtaaccacttcaaggcaacatctggacaaccaaagtgtgagaatgggattataactgaaggaactttgcaactgacctaactgtgatgaacaatcaagaagttttgagtgtatagtaatcaaattgtagagatcgataaacaatacaaatgaagtatgacttgtatgactggcagataacattataagcaaacaggagagttgtacatgtaaagaatatcaatggtacaaagtatatatgcagtgatagattcaagagtaaacttacggccaagcaaaatcttagatatagtaggaaatgctggaccatggtaaaaagcatgcctccaagatccccgttcatcattgctgaggcttacgccattaattatctgaaagtacagaaaataattctccctgttacatcatggcctaaaaggatggaactccaattggctatttggctgaatcatattgaaggaagcatgtgtctttgaatatccatactaatttatctctcaagcatgaaacatgatcttctgtattctgaatgcattatcaaatgacacaggttttacaaaatgtgtgctgctacagctcacctagcaaggtcctgcaattcgattacccattgtgtgaccaaagttataggtttatcaactggaaaattctgtggatgcttatcaatccagtttcagagtaattccttccagagatcaatttcctcaaatatatgcaccacaattatgacattacagcggctgaaacattgtccacataaccaatagttcactatgatatcttaatgctccatttctattttttgtggcagaattactgctccatttcggcatacagtcctttgtgattgcaggtcaaaacaaaaactcaagacttccccattttttttatcacagaccccttccatgattattagaaatcacacatcattgtttatgccagaaccaaaaatagcaaatgataaaactactagtaatttttctcagatggacgaaataaaaggcctaaaattagcacagagcttcacctggctcctgaagggttcgtccacggtacctacaagagaggccatcagacaccccaagtgacggcgaatgagataaatgggaatagggagcatgtcggattaggattcggagcctcaccggctacggcagcggagtcgacggggaagacgagggcggcgacggcgtggatcgcgcggacgacctcgccggcgctcgacgcggcggcgaccgcgtcggccgcctccgccaccttgtccagtgctaggtcttcgaggcgcgcgccaccatggccgccgccctgggagcccgcagccctcgccgcggagctgcttgggttgctcgccatgggagggtgaagggaaacacacgacgaacctaagagagagcgcttgagaaggggaggttttggagcaagagtaattagggggttttgtttggaggagaaataacagttttacccggcttgactgccgttggctaagataaaattttggggtatgtttgagaatatcaaaatttgcaaatgaacttttgttagagaagatgtgtttgagataccaaaaaaataattgaaggaattaagaatgtcgaatgtcaattgtacttttattcatgataccagtagtatattactcctattatttctaagtttttttataaggatagaattggagctgctaagagcaagtttaatagtatagccaactactagctctaaatcatctatagtcaatctactccttccttcccaaattgattttatacaccaaaaccaaggataatttaaatcacatcaatcaatacaacatacacacattctcccaccatgcatcgattaaaacctcatgccacttacaccatagcatgcacacattcttccatgctgtattaactgtattctgctgaaatccgtgtccatgcagttatatgatgatcaatttaagaatttttagattcttttacatgatgatcaatttgggaaggattgagtaatagtaattcatacaatagttaactagaaacatataccacactattaatatctggtcccacatgtcatactcacattgcctcttggagtccgtactacagctgactataaatctgtagcccactgcacttctctatcctcttttatctttttaaaatatgtctatagctggcttagagcaggtacaatagcataccattagttagctataaacatatttttatgagataaaaaatgaaaaagaatagcagcgggctacagatctgtagccagctgcagcacggactccaaaacacagtgtgtgtatgactggggccatatattaatagtatagtaagcaactattgtatgaatgagctattagattggctatggatgaattggagctagtagtggactatactattaaacttactcttatagtatgctattgtacctgctataaaactaacttgcttcttttcctcgatacagcaattaactaacttttctcagtagtcgaattatgcatcaaaagcggaaggagcgagtataaccaactgccaaatacgaagcatgagtgcatgattctctataagattcgaaaacaagctcgaactttcgaacgctttcattacaaccaagaaacatttcgatttcatattattgacatcatgtgacggagcgtggggctcctcaccgggagaccgcgcaggtccccctttgccggttcggccgggggccctgggtgaggttctaagctcctagtctgtggaatgttcgcgaaagtggaaacacacaagacacgggtgatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacagtagcccccggcgttatgccagggcgatcaccctcctcgagggaagcggtcgggcgtgacgccacttacttaggcctggtgacaagtggggctggtctctacagttgggcagaaacccaacggtcgcaaatcacgcacatcggcaatggtaactcgactgtcaataatgagcggcctcttcaagactgccacattactcgagtagcacacgaatcgggacgagccggttcgttttgcctggagatatggtgatggcacttcggtcggcgagtgcaattaacgcgcgcacgatatgttccatctcgactgccacagccgcatattcacctcatgcgccgcaagcgggcgaatgggattagtggaagcgtgggcgcgagaaacgagggagcgagatagtgggcgcgagaagcgaggagccgggcacagcgttggcaagggtataaagacaccgaggaagagatttgcttccttcctctcgccattattccccttgtcttcgccgcttgtgccctaactccttgtttcctgtgccctaccctcgccacacgcgctcgctctcaaacatctcttcttccggcgtcatggcacggggctctgctccactcgatggtagcgtgctgccgctttcccgcatcgtgagcgagaggcaggccgggctgccgcgccgcttcctgccggaatctgccaccggccaggagatagttacgctgggcgagggacgcccggcgccacgctacccggggcggaccgttttcttcctccctttcgcaatggcagggctggttccgctattttcttctttcttcatggatgttctggagttttacgatctccagatggcgcacctcacccccaacgcggtaatgacattggccatcttcgcgcacttgtgcgagatgttcatcggggtgcgcccatcccttcggttgttccggtggttcttcaccgtacagccggtgtcgccgccgtcggtggttggtggctgctacttccagccgcgggggccggtgctgaaccgctagattccctgcgtcctccgcaagaagtgggatgactggaagagcgactggttctacacccccctcgccgacgaagcgcgcctccgacttccgaaccagcccccggcgcaggcctccagctggcgggcgccggtagatctgggagatggctacgacgccgtcctcgaccgcctggcgggcctgcgatcccaggggctcacaggggccatggtgtacggcgactaccttcgtcgccggatcgcaccactccagcggcgcgcccggggtgcctgggagtacaccgggtccgaggactgtatgaggacccaccggggggtcaaatgggactgggtccctgaagacttcaaggtaatgatccaacgggtgctgaatctcagctccgcggaggcatcgctcatcccccaaggagtcctccccctctgcagcgatccagatcgcgccaccatcctgaccatcatgaaggcggtcggggcctcagaggagcaggctcctcgaggccatgatggcgcgggcgggagctgcaggggagaacaatctaccccaggagggggtcgtgcttccgggctccgtgacgggggctcggggggctgccgccctgccgacgcccgagggaagaggaagcaagagggttcctcctccccatctcctccccgagggggcggggcggcgcgtgtcagcagcaggcgcccggagggggccgcgccgacgccgcagcccgagggggagcggaagaagatacggcttcgcaagatgggggggacagaaccatcccggggaaaccttatttcccctccaaggtagtcgtttaaccgaccccctcgcaggttcgtcccacgcccattgtggctgtattcattctcccaacgcgagttttcactcacccatcttgtttgtcttctggtctttcttctgtttcagcgagatctcgtcgcgtccctcccgccattccaagtccggccagtctgaggccgaggatacggcgaccgcggaggcccggaggcgagaatctgaccggcgagaagccacggatcgcctacgggaagccgaggaggccgcccgggaggccgtccgggctcgccaggctgaagaagccgctcgggaggaagccagacttcgccaagccgaggcggcgacaacttccgaggcagctcgcgacgaggccgcgggcacatcgcttgggcccactccctcgggcaacactcaggacaagccaggtccgggggacgtccccgagcccggcacgtccatcggcgggccgggccgcgcggcatcctcaccgaggcggctctcccccacgccttccgttgccccactgagcgcagagccccttttgcaggccttggccgtcgcaaacaccacggtgttggacgggttaagtgcccagatggaggccctgcaagcagagcgggcggagctcgacgccgcatgggcgcgcgtcgaagaggggcgacactcggtggaggccatggtggaggtgagccgcaaggcacaccgccggcatgcctcagagctcgaagcccgtcggaaggtgctggaggagatcgccagggaggtggaggaggagcggggggctgccctcatcgccactaccgtgatgaacgaggcgcaggacgacctccgccttcaatacgggagctgggaggcggagctagggaagaagctcgacgccgcccagggggtccttgacgctgccgctgcccgagaacggcgggcggcggagaccgaggtggcatcccggcggcgcgaagaagcccttgaggcccgtgccatggcgctggaagagcgtgcctgcgtcgtggagagggacctggcggaccgcgaggccgccgttgccattcgggaggtcacactggcggcgcacgaagccgcctgtgccgaagaagagtccgcactccgcctccgcgaggatgcgctcaccgagcgggagcgagccctcgaggaggccgaggccgcagcgcaaaggctggcggagagcgcgtccctccgcgaagctgcgcaagaggaacaagcgcgtcgcaatctggaaggtgcccgcgccgagagggccgcactgaaccaacgggccgctgaactcgaggcgcaggcaagggagctggatgcaagggcgcgtagcggtggggcggccacgggcgacagcgacttagccgcccgcctcgcagctgccgaacacaccatcgcggatctgcagggcgcgctgaattcgtccaccggggaggtcgaggcccttcgtctggcaggcgagatagggcccagcatgcttcgcgacgccgtgtcccgtttagaccgcgccgggcggcaggcgggtctctggggcgggcggactgcgaagtacgccgccaaccaggggggcctcgctcagcgcctctcggagatggccgggactctccaacggctccccgaggagctcgagaggacgattaagtcatcctcgagggacctcgcccgaggagcggtggagctcgtactggcgagttaccaggccagggaccccgacttctccccatggatggcgctggacgagttccctcccgggactgaggacggcgcgcgcgcgcgggtccaggacgccgccaaccatatcgttcacagcttcgagggttcggcccctcggctcgcgttcgccctcagctccgacgaggagggcgatgacggcggtgtgggcgacagtggcgacgaggctggcgactcgggtgcatcggagtgagcctccaggtccccgccaatctttaaatagttttttcttcttttctttcttccgaagccttcgggcctcctttttgtatagattaacttactctgcaatcaaaataaagaaatttctgtgtcaatttcattttactgtgtgtatgagaacgaggatgatctgtgccatggttcttttgtgtcttagctcgaacaagggctcgtgcccaggtcccagtcctcaaatggctcgggtcggggctagtgcctggggagatccacgtgtcgagactggccaggccgggagcgtggtgaccgagggttatgggtgacccggttgtgggtttttgccgattcccccccggagttaaccacgccccggggcacggctcggttctgggccccttttggcgattttagccgactcgagcccccgagggcaggatcgagcacgagtgacctatttcaagtcaagattcttcaaaaggaaacaacagcacagacacagcctttaggaaatcgaaaatgcttttattgaaatacagatagaagagaaataagaatatgcatgtgtggtagcccccggccaaccctgcacgcccgaggggggtacggggttggcccgagcccgaaacctgacacccgaaccctattaggggtagaagcgacgaaggtgttcgatgttccacgggttaggcagctctgtgccgtcgcccgcggctagccgaacggagcccggccgggggacgctgatcactcgatacggaccctcccacattggtgagagcttgctcaatccagcacgcgtttggacgcggcgtaggacgaggtcgttgacgcagagtgatcgggcccggatgcggcgctgatggtagcgccgtaggctctgctggtagcgcgcggctcggagggccgcgcgccgccttcgctcctccaagtagtcgaggtcatctctgcgaagctgatcttgatcagcctcgcagtacatggtggcccgaggggacctcagggtgagctcggatgggagaaccgcttccgcgccgtagacgaggaagaaaggcgtttccccggttgctcggcttggtgtggttcggttcgcccagagcaccgctggcaactcctcgatccacgaatcgccgtgcttcttgaggatgttgaaggtcttggttttaaggcctctgaggatttccgcattggcgcgctccacttggccattgcttctggggtgggcgggggaggcgaagcagagcttgatgcccatgtcttcgcagtgatcgccgaaaagttcactagtgaattgggtgccattatccgtaataatacggttaggcaccccaaaccgggctgtaatgcccttaatgaacttaagtgcggagtgcttatcgatcttgacgaccggataagcctcgggccacttagtgaacttgtcgatcgcgacatacagatactcaaacccgcccggggcctgcctaaacggtcccaggatatcgagcccccagacagcaaatggccatgaaagtggtatgatctgcagggcctgggccggctgatggatttgcttggcgtggaattgacacgctctgcatcgccggaccaggtcgaccgcatcattgagagctgtcggccaatagaaaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcactcccctcgggtcccgaggcctggactccgacgggcctcgggggccggtcaggcgcgtccgtctcccctaaggggtcgggtcgcgccgacggctgggcaagcctttcttcaaaggcgcccggtggggtctgggctcgcgaggaagcgagccgtgagagttcgtcggcaatcgtgttatcccgtctgggcacgtgccgaagctctatcccgtcgaaatggcgctccatacgccgtacttggcgtacgtaagcatccatctgcgggtcagagcaccggtactccatacagacctggttaacaccaggaggcggcggatccccagtccagctgccaccctaagtcccgcaaggagtccctcgtactctgccatattattggtcgcccgaaaatcgaggcgaaccaggtatctgaggatttctccgctcggcgaggtcaacgtgacccccgcaccggcgccctgaagagacagggagccgtcgaactgcatcacccagcgggcggtgtgaggcagctgcgaggggcccgagctggcctcggggagtgagacgggttcgggagccggggtccactctgccacaaaatcggcgagagcttggctcttgatagcgtgacgtggttcaaagtgcaaatcgaactcagaaagttcaattgcccatttcaccacccgtcctataccctctcgattatgcaagatttggccgagggggtaagacgtaaccaccgtgacccgatgcgcctggaaataatggcgcagtttcctcgaagccatcagaatagcataaagcatcttctgggcctgagggtatcgggtcttggcgtcccggagggcctcactaacaaagtagacgggccgctgcacctttcggtggggccgatcctcttcgccaggggccgcatccctggggcgctcttcgtccaagcggcctcgcggggcgcactcgtcttctgtgccgacgacctcggggtcggaggacgacaggcgcggccttcccacagtggcctcggggccgtcctgggggtcgggggctcctggcatcgtcggacaagcgggcaaagggccaactctggtcgtcgggggccttaggccaccgttcggctcgggggcctcttctccctgctctctcccgggtcgagtcggcacagggttaacctcggggtcagagggcgataggtgcggccttcccgcagtggcccccgggccatcctgggggtcgggggcacctggcaccgtctgacaagcgggcagagggccagctccggtcgtcgggggccttgggccaccgttcggctcgggggcctctcctccctgctctctcccgggccaagccagcacagggtggggatgcgcggaatgaggattgtcctcatcgcgctccacaaccaacgccgcactaactacttgcggggtcgccgctaagtagagtagcaagggttcatctggctccggggcgatcaaaactgggggagagctgagatacgccttcaactgagtgagggcacgttcagcttcctccgtccaagtgaacggcccggagcgtttgaggagcttaaataagggtagcgccttctctcccagcctcgatatgaaccgacttagggcggccatgcaaccggtgacgcattgcacatccctaagcttgctgggggcgcatccgctctatagctcgtatcttctcggggttggcctcgatgcctcgggcagagaccaagaacccgagaagcttgcccgcaggtacaccgtacacgcacttatcggggttcagctttatgcgggcggagcggagactctcgaaagtttccgccagatctgaaagtaaagtttcttggtcgcgcgtcttcacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaatgtagttttttcctcatcctccctagccatgcgaatctgatggtaaccagagtatgcatctagaaaacacaaaaggtcgcaccccgctgtggagtcgacaatctgatctatgcgaggcagggggtaagggtccttaggacatgccttgttaaggtcggtgtagtcgatgcacatccgaagtttgccattcgccttgggaacgaccaccgggttcgccagccactccggatggatgacctcgcggatgaatccggcctccagaagtcgcgccacctcctcgcggatgaaggcttgacgttccggggcctgccgccgcactttctgccggatcggccttgcgcccggccgtacggcgagacggtgctcaatcacctccctggggaccccgggcatatccgccggtctccatgcgaagacgtcagcgtttgcccgcaggaaggagacgagcgcgtcttcctatttgccatccagaagaccaccgattcgtgtagtcttggacgggccgtcacccagggcaacctccttgaccgggacctcgtcgcatgtgatcatccgctgcctcggggcggcgggaacggaggtgccaagcctctcgtcgccaccctcgggcttggacgcagcggcgaggtgatccgcgcgctgctccatacaagcaagcgcgactttgaggtcgccatggacagagatggggccaccggggcccggcatcttcatctgaaggtaagcgtaatggaccgccgccatgaacttcaccaacgcgggcctccctaggaccgcgttgtagggcagacttaggtccgccacatcgaagtttacccgctccgtgcggaagttgacggatccaccgaaggtgaccggtaggtcgatatgacctaacggccatgtgtgccccggcgtcacaccgataatcggctgggacggccagagcaccatccccggggccttgatggcgtcaaaggccgcgggggaaaggatgttgagggctgccccccccccccccccccgtctatgaggacacgccccaacttcacgttgcaaacggtgggggaaaccaccatcgcgatctgtcctccccgggcaacacacggtgggtggtcggtctggtcgaaggtgagggcaacctccgaccaccgcgcccgacgcgtcgcctcatgagtgggggccgcggccagaagctctcgcttcatggccttaaggctccggcgagaaacgtgagcacacgctcccccatcgacagtggcaatggtggccccaggctcctgaaagcctaggtcatcatcgccgccatcgatgtcctcgacgggggccttctgcttggcctcacttcgccgattgccggagggtaccgccggggacttaccctctcggcgctcctgcctcctctcctcctcccactttctcgtccgctcagccaaacttttgactgcgcggcagtccgcgaggtcgtggagggaggtgttgtggacgatgcaccacttgccggttgggcgctccctgctgggagcgccggcctccttctttttgtcgctcgcaggcctcccctttcgggtggcccgcgaagcgccctcgacagtgaggacatgaccctcgtcgtcggaatgggctgacctcttcttcctcctcctgtcacgtcgccctgtctgagcagcggacccgggggcggccgaagttgccacaccggaaccggaggggttccaggtccaggcctcctccttacgagccactcggtccgcgagctgaaaaagctccgcggtagtctggggctccttggaggcgatcttttcgagcatgcggttgtgccgcacacccccctgaacgcgtagatcaccgcgtgtgcagggatgcatggtatggtgttgcggacttgacagaaccgctgaatgtatgagcgaagtgactcatcatcccttcgctgtactgcgtgtaagtccgcttcttcacctgggcgcggatatgtgccttgaaagttcatggtaaactgttggcacaaatcctcccaagagtggaccgacgcgggtggcaagttcattagccaaccccgcgcctgtctcttcagggccatgggaaagaaattcgccatgaccctgtcatcacccccggcggcctcgatcccggtcgtgtagacctggagaaactcggcggggttgacgctcccgtcatatttttcggcgatggtgggccggaaccttgggggccaacggacgttccgaaggctcgctacaaaggctctacagccgacaccaccaaccgggggcacggagggctgatccccgcgtccgtgttgaggtgacactccggacgaggaggcaccctccgttgcgtgggtagcacgtcgaccattacgccggcgctcgataccgatgcgggcatctggccctccacgctgatcttcccgggtcagaggtgctgacgagggagtggcagccgaacggcgagcaacagccgccgctcgccgcgccctccgccttgacgacacggagccggtggtagcagcgccagaggtcttggtggctgtcacgaccggaaataacccaacgggcattccttacgtgcgtgcatgaatccttgtcccaggaggcaaggtacaccaaaagttgatacaaatcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccaaagccttcatcttcaaggagctcctcttctgggcttgggaaaaattgagcaagactgagtacaaccaccgtactcaacaagacacacccacaaatgcagaataaatgcaagggagtacaagggaattataatataaagggttagggttgcagtaaacagcatttaaagacatttagttgctcagggctattttgtaaacacgatcttagaactatacaatattattaatcaaggccgtgaacccacacgaacctgccttaacccaaggcctatgatgattcagaccgaactggcaacccgaccctgggtcccagctcgtcccaagtcaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacggacggaagacgtgacatagtttccaacccatcctagccttagacaagagtaccgacccaatcccgcctacggccggaacccccgggacaggcaggcaggactgagcccctagcagcagggcaccaaccctctgccatatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccattttaggggattttgaatagagggggcggtgtgaagccaattccacaataatccaacaattccatagtgtccaggtgatatgaatatttcccaagtctaaagttataaaaccacctaatgttacctaattaaattgcgaagcatctacctaaatttaaactagggataccacgagtagagtgtccactagttgaggttttgtttactctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatatgacttgccttgctcgctttcccaaccgatggcttcgacttccacgaagagcggatcttccgaagctgcagcgtctacacgaccaacggaaaagaaaaggcttttacactactaaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaatctcatttattgcgtcagccgagggagagggcgcgcggaccgggtccacgggagtggggcccacgcgtcagcctctcggtccacggtggaccgggagcacgcggctggcggcggtcggcgccgtgggtcccacgcgtcagccgcacccgcgggctcgggcggctgacggccgggtcccacctggcagccgcgagggcgcgcccgaaggcggcctcgccggcacggccgaaggtagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaagaaggcggcggcgcggttcgggacgacgaggacgacggtgctccggcggtcggcgagcgaaacggaggcgcggacgaggtcgacgggaacgcggcgaagccgatggaggtgacgccgagtggggaggaagtccggagcgacggcggcggcgaaccggagcacggcggcgacggcggagagaaagtgcgacggtgcgggctcgattccgacggggagagtgagcggcgagtggcggaaacggaggagcggagctcggggattgattttatagcgacgggagagagagagggcggccggagagaaaggaaaccggccgcggagttctcgggctccattgaagacgccggcgacgattgcgggattcaaatcggacgaatccgagggagagagagagggaaaagagggggaatcgggagagggaatcacggggagtaattcgcccctctttatggcgcgcggggaaggcgggatgcggcggaatcggcggcggcggcggcgctagggcacgggcggcggcgggcgcggcgcggggttggggatgacaggtgggccccacccgtcagcgagggtggcgggcgggcctgcctgtcagcggcgcgcgctcggggaggagccgatgggccggaggggaggagagagagagagggagggagagaagtgggccgagccggcccaagaaggaaaaggggggggaaagaagacttttagggatttttctttttataaaccttttcaactttgtttatttcttttcaattattatttgtgctctgaaaattccactaaaatttatttacgcattttaggcttttaggaaatatacaaaaatcctccaagcctcatttgacttttatctttgcacattttaattgttggaggctttcacatgaattttaattattctttgcacaatttcgaggatgtattttagagtcgatttgggacgtgacagtggcggaggaccgcccaccaacacctaggtgctgccgtgccgtcatgaccaagttggctacgtcgtccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacctggcgcgtcagatgacggagcgtggggctcctcaccgggagaccgcgcaggtccccctttgccggttcggccgagggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagctggagaaccagagagctcaaactctagaaacccctttcctcctttttgcctctcgtgggatcttctcctggatcctccgggagtctccaatctctcctcccctggtcctctggtccggatcccctccctaagtgggcaaggtcctccttttatatctcaaggggataccacatgcaccacttctacctatttctctttttggtggggacccatcctcttttcactaaaacttggctcgcctttccttcataaatgggcggagatttgtaatggttgccgtccgaatgaccttctgatgggacggcccatacctacctccactttcgccggaagcaggtgcgacgtgggaacatggctgtctgccgacgacatgaccagtgtcagaccggtcacaaatcggtcattcttgtccaccacgcgtcagtttatcaatctgcatgttcacccttcttcatacaatgtcttgcttgtaacggttgggatgaagcctagcatatatctgaccgggaccaacgtgtcatctccaggagctagcacgctggctccggctagggacaagtgcctggaggctcttatcctgacgggatggggcgaggcgtgtgtcagaccgcctgttgccacctaacccacgatctgaccggtctgtgaccggtcacagaccggataaacgagcgcgctgcactgcgttacatgcggcgtgacgcgctcgttcaaaccgcaataaatgcggttaggtgagccccgccgtgctcacctaacctatacacgcggcgcaaaacccacaaggggtcggggcgcctcggccctcggggccgaaacgggagcggtccgatccctcggggagacaaagagaggggcggcctcatcaccttcgggcccgacccccccgagggggtcaggccacgtgggtgattgctcctgcccaaacctctagtcatgatactcccggtcccatgtcaccgacatcatgcttcccgaagaaaccatgatgaatttatcatggttacaacagaaacatccacatctacataatggtagtactagtattgttctattctgcacgtattacattctgtgtgcggaactcaacacgtactgctcgagtacaatttctgagcagaggacagggaaatgaaaagaatgcctaccaggtatagttaagttaagggtgtgtttagttcacgtcaaaattggaagtttggttgaaattgaaacgatatgacggaaaagttgtaagtttgtgtgtgtaggaacgttttgatgtgatgaaaaagttgaaagtttgaagaaaaagtttagaactaaacaagggttaagaagaaataaaataaaactatgaatatatctgctagtattgtacagttatgctacgagatgttgaattcaaatctcacatactattatttttttttacttagtatgcatctttactacatgttgtttcaattggtactaattaaacatcaaaaagtttagtctcgattactagtctcgaacaggtattaaagatcgtttctcgtgcatgagcaataaaaactgatataacaagaggaagctccacgagaaaagcaaagaagacggaaagagaatctcatatcacctgtgccatggattgatgtcacaaaatcgccgttgttcgctctgaatcgcccgttgacaacctgatttatcgatcagggctgtcgagagggatttatatgcgagctcaacattgtttcgattttccgattaccgcggacggaaatttgtccaccgcgtgtggatccggtaacgggcttcatcggggcttgcttcgatggacggtcaataggagcgggagtatgtactccctaggagtacccattttcatatatatactgtactcgaaaaattggctttgagttgaacctgactcttattttgttcttctggattttaatattttgtaaactattttctcaaagataatttaccaagttgagctatcattcatagcaagatctctcgctgcaacacccagggtccttttagagaaaattgcaatattgggacaacaaacattagggcttcgctgtcttgacactccgagtggatgacaaatgggtccatatgtgtctatgaaatatgtgtccagtatcattatagcaaaggtcaatgtttgcagtgtcattattgcaaatctcccgtcatttttaccccgtttcatagaaaaatattatatcttatgaaattaaatcttataaaattaatagacgagatatagctacattggtgtacatctttaatgcatgccatccaattttagattaccatattactttcgaacgaatggagtaagaaatgctcatctggttggcatcaatattttaggcgactggtgatatggaagatgttctccggggttgattacagccgtagttcctcgttccatgtcgtagacacacagcgctttcccattgaaccccgagtagtagatacagttccctctcaagcctgttgtccgtgcatcaagtgacgctccaaaacagcctatctgaacgaagaacactctgccacctagcgaatccaccttcacccacgctgatctttgctcctgcgtcgtcgccatgctcagcctgtaaacgccaacaccagcgacaatccgatcacatccaatcgggtgagagaagagaatggagtgcagctccccgttcgattccacaaagatgctggtacgtttcatgtacaccgccggcctcctgtcgtcgtcgtctacggcggtcacggtgaacgccggctccagtgagaactcgaggacggcgacatggtcgatgagatcggtgtagaactcgccgtccatcgccgtgagctggcgtaacgccaggatgacgatgccgcggtgctcgtggtgaggcggcccaggctggaggtactggtgctgatgcctcttcacccagtggttgtcgccggggcggcaataccagagcaccgtgtcggcgtggtcgatgacgagcacgacgcagctggccgggtccatgggaccgcagcacgagaggaggcacctccggcgatggctgctgccttcggcggcgaggacggtgccgtcgtggtcggggggcagcccgacacggcggccggtgaaagggtcccacaggaaagtgcacggcgagccgcggcgcgccatgagcagccagccctgcgccgtggtccaccaccggtggcctctcatcatgtcgtcgacgccgccgtcgcccaccctccttggcagcagtgctctcgccggcacgctgtacagggacgtggcgtcgccgtggccgaacagaagcagaggagcaagcttgggatccagtactgctgcagatgcatcgcctgcctcctccatgattttgatggccgactgtcccacaggtaggatacggccggtcaattgaaaacgaacgaatttggcggtgctttataaacgaggagaggctttgagcagtgcaattactggcatataggaaagagaagcgaagaaatctgcacgcctacgacctacgattactagtaccaattaggacatgaattcctacacgacatcaaaattcaaacaaattatagtactagtactttgggccggtaaatcagtaaaaggaaacagtaatctgggccggggataaagagggatcaccacatatgcatctatggagattggatagcaaccaacaaaaaccaaccgtgccgggtatacaaactacaagcagaagcggaagccgacctatatatgagtccggaggaaacacgtcaagaaagcagagctccgtagcagcacaaaacgcagcgcgccaagcaggccattgcggtgcacgaaccctcgagattcgccaagcagatagatggaggccactgcgacggcggcgcagggactacgggactggtcgtctctcccgttggacatgctcgtgctcgtcctggatcggctcgggtggtcgacccacccgagcttcgcattgacgtgccggcactggcgctccgccgtgtcgcccttctacccggcgtggatcacgcctctcctcctgagcgccgccgacatcggcgtcacgaacgtcaggtactacagcccctactaccacaggtgtttcgagatcgccgacacgctcctcaaggtgcccaaaattgcggctaggatctgctgctccagtggacaacacctcacgctgtgtctacctagattgatcctccaagccgatctcgtagccggcaccatgtatgagctgccagagatgcctttctattcattcgagtttattgtctacgatgagcacgcgcggaggatgtattgcgtcaacacgacgtacgcgctacagctcgcccgtgcgacccaacaagacgacggcgagtgggggccctgggaattaacggactttgacgtggaaggaccgcaacttctggcggcgccgatcagcaacccggtgctccatggtggtttgttgtatgttcttggtgaagacgggaagatggcggtgtatgatccatgcaaccacgacaataattttacagttcccgataaacctaagggctttggaatcaaacaccaagttgatagccacctgtttgagtccgaccaaggcgcgctcatggctgtcctcgtcggctacagtggtgcgcctatccatgtcgtcaagctcaacgaagagacgatggagtgggagaagatgcggtcattggaaggacatgcgttgttcaccgggacatacacgacaatgttgaggaagactaagcttagattgatgcaaaacaaggtgttcctcccgaggctgtatgactggcctgagactatccatgtcgacattgttacacgtgatggcgaaacagcatttgtaccaaagtcatccagttcgtctaacaccaaggagatcacctcggacataaatatttggttctacgagtttgggcagcaagacgcaagagagttttggggatcggagagagtagattatagtatttgggttgattttagtactaattgacacaaattgacgttgttagctcttatattttcatatagtgaatcatctcacaatgaagttactcttctttcaggccaaaatcaaaatcgacgcaaatgaaatttgatataatatttctttgttggttgaaacatggcgctattaatattatgcactcagccaatgcaatttttgcatgaattgatattgatatttgtgcacagtaatttatgaggatttaagggaataataaaattataggcttggatgattttctcggaaaatttgaatttttttgggagggaaggatttagggtttgggtgattcacaaggatttaggcaagttttgaatttcaaaattcgaaccttgggatttgtaatggaactttgggatgaagtttttgggatatcaaggagagacccaccgagatcttttggcacacttaagtccttgaggatacagaaagatctaaaatttttgcaattaggatttcgttttatacaaaataagttagaaaaataattcattcgactgtgagttgctgaagatatggtggtgttatcggaagacttgaccgaatagccatcactgctaaatggtggcatggatctacttaatccacaaatagactttcccattaaaccaaccatatgactgattactcccttcatttcaccaacatccattatccaatgcatgaatcgatttaaaaccaaaacgtatcacatagagctagaagaatgaggaaaacttcaccaaaagcaaagtagttaacgtacaggtgcaagtagttaacgtacagtatcaatgatactggttggtgacgttggctttcatcatatacttggttatcttcttcttcgccttcttgtcttccgactcacacgtcttagcgtgagccagaagtgggtttctcgccctggccgaagaaggttcaagaagaatcttcttgtagccttttccgcagatccaacacttctttgggtcgaattcctcctgctgacgcacggccacctgatggcccgttgcagtggcatcgagggcgacctcgtcggactcgatgactgcgccgagagaaggtttgggagcgccgtcgtcagcgtcggcattggcgctggagttgggatcgaccttgtcgtcggctgcgacagtgccagtgggatcgacctcatccgtgacggtgttgttggcgctgggagtggggacgagctcgccgctctcagccctggcactgccgctggtgtcagccgtggcgctggagtcggccatgacgccctcgtcgcttgtgtcgctggcaccagccggcgcagcactggtgctggcaatgttagagacggcagtgccaaatccagcgggatccaccagctggtactggaaggcgccgggcttgaactgaaccaggatgacggtagtgttctcgcccgatgccaagccgaactcaacaacctcctcacagatgacacgcagctctgcaccctcctgcatagcaatattaattggtcacagcattattggtaacagcagttttaacagcgaaagaatcgaagtcaaagcagatggcagtttgtcagccaggcatgcatattcagtgctaaactaacaaatggttttgtgaggtttagggcttacacagtttttttttaaaagaaaagagaaaatcaggatatttacattgcttgattgaagtcatttcctagaacagatagcatgattaacaccactaagatatcttgtcctgccaagaagacaaactgagggaaagaaaagactcaccaccgataaacggtcatgtatgtaagaaaccacgtccgcactgtccacgcaagacctgcagggggaaaatatacagtagtcaatgcaattagtatggaactatgagtgaaactatatatgaaccaaataggaggaaaaaaaaaaaagagaatgccaatgagtactggtgacataaaaatgatccaatagttattgacaggtattttttgctgaagagttaccacttaccagagaccttgacttgcaataacaagaaactccatgtcatcagttatgtcatcctgacattgaaagggcaattttccatcagatcccaacccggcaaaactgaacttcatattctaccaaacggacctatttacacttagttacacttacagcgaggatgtccggatcacataccagcatttgtttttcacgatctaaatctttgttcttcttgaaagcaaagtcacctgaaatgtaagtaggtaaaacgccaatcacagtgtaatgtgcttctttttgtgctattacatgcaatcaatgaaaaacagatccagacaagactataccaattgatcttgagattgttacacctcccccaaaatcaccgaggacccattgttccttgactacataattccccattacttgttcacacctaagtccaagagatctccctcctgcattttgaactctctctctttcagactcagttcttgtgcatggtttgtgatcgaaggataaatcaatagcctattgacaaaatggaaacaagcacaaatgttaggcaccacaatgaacgagcttgcaaattaggtattaaccagaaattcaatagggaaacaatcactataccaggccaccctgtcttgagagtacgcaacgagaatcaccaacatgtccaacaatcatttggttacctctgatgacaaccacacatgctgtgctcccttcatacgctggcccagtatatgtcgcctgggaaaacaacaaccaaactgaagtatataacacagaatcacaacattgttagaaggaaaaggctaccaaaaaatagctcaagaaagccaacaggtatagaaaaacatttctgaaaaccaaaccaatgtatgaaagaaataaccatcgaagggatatcgcaaacaatacctcaatttggatagcatagtatgataagaaccaaggtgcaatgagaacttaagaacctgttggcctccaactcagtaaaccagccaattgatatgtaactaattgaaccttttttaataggagcaattagtcgagattagggttaaacatatctcctccaactccaaagtacatcacaagaaagaacaacagtctcgatatcaaacacattcttccatttcctttttcatagatacaatatgcacactgtccaacaaatacaattttgagtaacttcttcacgatatgaatatttgaggatgctaggggttaaaagattactacctgtgggaaaggcttagcacagacaccagccttgagaaaatacatacatccattatcatgaggaataactaactctctccaagcatcggactgttgcaggttctcatccatgctgcagcaatcacacgaacaatgatatcccacatttccaagtgcagctataaacaaaattatgtaaagtaggccaaaataaccttaaaaacacattgtccagtgcattaatcagatcgttgtgatagtcttcatgattgcatagctcaatgtgaaattgttttgcgcaatacaatgctacttcagctcctgagatagaaaaaaacaattcagtatggcgtctcgctcaatacgatggatcaagattacttctattgcatagaagcttataaatcaaaacactgttgtgaacattagtagcagaacaacacttgaataggcatcattaaaaaaaaactaacctgttaatctgtaattatcctctaaattatcatcaccatttatattactagtaactcatattcatgcagtgttttatctctcatgaattaaaatttctttttatgtagttcatgttatccttgcaagcatgccacacgaatgtgattactgattagctaacttgttcattatccataactgtagcatcatatttatttgaaaattgacaggtaaatgtttcaacatataccacaaagttttcaaaacatgcgcagagataaacaaagtgatacacacagacaaacatagcatgacataacagttacgccaacaatttggagggtttgaaattaaaaaaaaaatgagaatgaaagcaaacctccatggccatcataaacaccaaagaaagacgtggacgtggcatcatcaagatttagaatagctgcatgctagagaatatagagggcatatgtcaatcacagtattttacacaattacttaaagatcagtaagaaaattttgcagaactgtccctttttttgtcatacaaaaggctgcaagtttactcacagcatcttccattttctcaccccatccttgcatagacgacacaacatacttaattctgtcattctcttcttcaaaagtgaacttcgattctacaggaaggctgttacccatagcggaacttgctttgctgaaaatttaacatgaatacaaatataaaataacattattaacaaaaacggggaaagacacttaaacaataatacagatcaattaaatgccagaaagctaggttacatatgaaataaagtgaagtagaatcatcaaacttgatatggcactacttatctagctcaaagcacagggtgtaattggtgctttcattcagggcccttaaatgcttaaatgcatttttgagatatataacatggaagtatcaatcttcagttgcagtgctgcattattttacacctaaatcttattttattactgcgaacaaaatacacacaaggttttctacaaacgcgatatnnnnnnnnnnnnnnnnnnnnnnnnnnnnnnnnnnnnnnnnnnn

SEQ ID NO: 9232 - DNA, 1193 bp, Oryza sativa
aacggagaccaaccatgaagcttcggtgctcgtcgacctcctcatccaactccgagaaaaccacgcctcaaatgcatcaagcaacaacatcacgggtacgggaagcgaagaacacgaaaaaagaggaccagaccgcggtaaacaggaaccaaccaagacgcagggtgctgctcgattcagcgaagacaagaacgagagaaaccgcgacaccaaacactccaagcaaacaaacaccaccaccaatggagcaagatcgaagaagagtagggagaagaatctcacggcgctttcggagaagaagtagggtttagggatggaggcggcggatgaaaccacagaggagaggaggatgaagtgggagagagatctcacctctcacctttgccgctgctcttgagacgcgagagagagagagatgcggaaaagtggttgtgctgcgaagcgcaaaaagttgtgcttaaatacctggaccggacgaatctcctccgtcggatcgtccctcgcggctgatccaacgctcgaggagtggccccatcctgtggctggtggtccccacggatacctcgcccctgcatgactcgtccaattctcttttactcatcatcatcaactattagtcagttcatcaatctgggtacaattttcatcaattctctttaatctggatcaggacaacttccatacaatctccacacgaatcgacaaaaattctagcattttcaaatcccagattaaaaaaccctgtaatatgacaatatcaagcctaatcagaattagctgacctggaatttctaatattacatggcaagataatatatgcttatttacaacttaatctagtacatcgatcacatcatgttggcaaatggtatgatgatgttatcaagcttagaaggtagcgacctgctgctgctgctgctggccttgctgtgatccgccgattccagtgctcgtgatgtctgaagggccatctcagaatgaagccgcaggcaggtcatagccatcttgaagacaaacatgccaatgggaggagttagatgacagtgtgaaaagttactgagtttccagcttatactgaattggtttctcttttaagtaaaaactggtttccagcttataagtaaaaatatgtcctgtttttcgttacaaattgctgaaaagagctgggtcactgaatttgtatacgggctgca

SEQ ID NO: 9233 - DNA, 1560 bp, Oryza sativa
tcttttcaattattatttgtgctctgaaaattccactaaatttatttacgcattttaggcttttaggaaatatacaaaattcctccaagcctcatttgacttttatctttgcacattttaattgttggaggctttcacatgaattttaattattctttgcacaatttcgaggatgtattttagagtcgatttgggacgtgacaaacctaccccccttaaacggaatctcgaccccgagattcggaagaactggcgaagagatcgggatgggctgccttcagctcgtcttcacgctcccaagtagctttttcttcggcgtgattgctccactggaccttgcaaaaacggattacccggttcctggtcctgcgctccatggtgtccaggattttcactggcctctccacgtaggtcaaatcttcgcgaacttcaatttgctctgagtcggcctgctcggatggcactcgaaggcatttcttgagttgcgacacatggaacacatcatgcacgttgcccaaggaggcgggcagctccaactggtaagcgacttctccgcgtcgagcaatgatacggaaaggacccacataccgaggtgcaagcttccctttcgtctgaaacctgtgtacacctcgcaatggcgtgactcgaagatacacaaaatcatccactgcgaattccaggtcacggcgacggttatctgcataacttttctgccgtgactgtgccacctttagattatcccgaatgattctgactttagcttcagcttctctcaggatatcagtcccgaacacttggctttccccaacttggtcccacaggagcggtgttcggcatttgcgcccgtacaacgcttcatatggtgccatttgtatgctggcttgatagctgttattgtaggagaactcggcataggggagactcttatcccaggtcttcccgaaatctagtacacatgcgcggagcatatcttctaggatttgatttagacgctcggtctgtccatctgtctgcgggtgataggcggtgctgaaattcaatcgagtacccaactcttcttggagcttcttccaaaagtgagaggtgaattggcttcccctatcagatacgattttcttgggaacgccgtggagactcacgatcctagcgaagtagagctccgctagtttgttccctccataggtggtcttcacaggaataaatcgagctaccttggttaatcgatccacaactacccatatagaatcatatccaccttgggtctttggaagtccagtgatgaaatccatcccaatttcatcccatttccattcgggtacttggagtggttggagaagtccggccggtcgttggtgctctgccttgacacgctggcacacatcacacagggccacaaactctgcaatttcccgcttcatgctaacccaccagtatttctccttcaagtctaagtacatctttgtactgcccgggtggatggaataaggactttcgtgagcttcctgaagtatcagctgtttaagttctctgttatctgggacgcatacccgatttccattc

SEQ ID NO: 9234 - DNA, 957 bp, Oryza sativa
caaccgggggcacggaggtctgatccccgcgtccgtgttgaggtgacactccggacgaggaggcaccctccgttgcgtgggtagcacgtcgaccattacgccggcgctcgataccgatgcgggcatctggccccccacgctgatcttcccgggtcagaggtgctgacgagggagtggcagccgaacggcgagcaacagccgccgctcgccgcgccctccgccttgacgacacggagccggtggtagcagcgccagaggtcttggtggcggaggaccgcccaccaacacctaggtgctgccgtgccgtcatgaccaagttggctacgtcatccagccaacgttgggctggagactccgggtcagggacgacgggcgggtgacgtaggagcgcgcccgcagcttggagcgcgccctggggcgtgctaccgtcgccgtagacgaggaggcgacgctccccatctcggcgcccttctccatcacccgtggatgtcgaagtcgcggatccttcgaccctctcgagcgcctcctcccgcctaggactttggcgtggagggggcggtggagtacgagctcgacggcgtgggttcggctccccgtcgtcaccgctaacactcggagagagcttgtgcgcttttgcttgtttagccattgggctgaacaggaaaagcttggcgcacacgaaagagtatgagagcttagaaaaacacacgcagaaccccctacatggcgcgtcagatgacggagcgtggggctcctcaccgggagaccgcgcaggtccccctttgccggttcggccgggggccctgggtgaggttctaagctcctagtctgtggaatgttcgcgaaagtggaaacacacaagacacgggcaatgtatacaggttcgggccgctgagaagcgtaataccctactcctgtgttctggtagatctgtgtacgaagaagctacaaagagct

SEQ ID NO: 9235 - DNA, 198 bp, Oryza sativa
tgctagaccactaagtccttggggtctgagacctaccgtcctaatacgcactcgatttctaacatttcttcttgcagccaaatgggacggggctctgatgctctcgatggtgacgtgctggcgatacccgcaacctaaacaatatgcttgccgagctgccgcgcactttcctgagggaatctgccaccggcctaaaga

SEQ ID NO: 9236 - DNA, 776 bp, Oryza sativa
aagtgaagtctgtaggttggcagaggccagcactggttctgcagaatgtgtgatccattattgatatttgcatggggcacattaccgtacggcctgtgagagcctataccgtgcacatttcatggataatttatatgagaaattgcctagccaaatccccaagcatgtcgtcaccactggccttgagggaaaacttagtggaaggatgcttagcgcaccttggtgagtaagagcattgcgaacacagtggtgtagaaaagctagtggcaggccattatgactgtgggtgagtcactgaattgaatgggagcagcatccaggggttgctgatataaagaaaagactgatgataggaggtgatctgattctcgaagcttagggggtttagtagataaactgggtacttcagggtagttaaaatgtattttttttcctagtctattatttttgtcttagcaatgctgtaccatcagcagttctctattaaatcctgataacagagagcaatctcatcatatgtccgtttcacaaagactgttgttctagcattcaatttttttatcaaaatgtttgtcattctcatgttccatgcatttttatcaaaatgtttgcattggggatgccaacagtcaggagcataaggggttcaagctctgaaccacacaatttatgatagctttgggacacgtttgggatgaactaaatgagggtaaccatgtcattttccacaacttctttgtctgatatttgctagatcaagaatcttgggctgcagg

SEQ ID NO: 9237 - DNA, 3924 bp, Oryza sativa
tcctgcagcccgttgcaaatagcaagtctgccaagctgtgagtgatcatgaacacttacccttactgtaattgcattgtttctgttttaattttctgtgttaattacgttgcaatcactcagatatggtagcgtcaaccacatagatgagaggtttcggcacagataccaggtttgttgttcaatatctttagtgtagttcatcataatgttactcatggtgttttaattgcttttttaccttttttttaaaaaaagaactgtgatattgactaacttcccaggtaaatcccaatgtggtgcaattatttgagaacaatgggcttcaggttgtaggcacagacaagaccggagaaattgtgcaggtacaagctgaagaacccagcttgcttgaacaaatttcaacttttcacttttccattattcatgcatgctgatgttattgtttgtccaattttctagatcgtcgaaatacccaatcatcgatttttcgttggcgttcaatttcaccccgagtttatgtcgagaccttcgaaaccttccgcactttttgtcggtaagctacttaaacctctgtaaacgacccaagggaagttgatatatatctttcttttgaaaaaaaaaaaagttagcgatgtaatatcaacataccgctttctcgagtaccgtcaaaatttctctttgacaatctgatcaacatgtataccgacctgcaggactaatcgctgcatcgtgtgggcaactggatggtgtgctgcaagatgcggcttgtaaccatgagccacagcagaatcagcgtgcagagaagcgtcctgctgctagtgatctaggagattgaacctgccgcagcaagcggcaagtgacggcgtgctctgattcaaatgaccctgatgaagcaccggatgtcaaaagctgttaattgtagttgccgtttcttgatatcattgttagtaagaattttgtaaaaagaaaaaaaataagtatgtgtagcagtgttcttataatggaaatgggggagaataatcctctcttttttaaaaaaaaaggaaaaaaaaagtaaaggtgtgcaacacatgaatacatgatgcattgcatcgtcaccagtagttcttcatgtcgagatacggactaggggtttttttgtccgaccttttctccgctcttcacaaaaaatctgggttttttgggaggtccgtggatgtttagaaaaaaaaaagtaagctcttctaggttaatcagcatatctactggaattcaagctaatgcaaccatcggattcttcaataaatatgtgtgctaaataggaactgttttacatttgctagcatcggaaggctacatgttactgctataattgacaataacgatcgcaacagactttgcagacaaaatgaagtcgctgtgataaccttatggtcctcactaatcctttgttcagtattttcaccgttatctggtcaggctcaataaagtcatccagaagttcagtttcatcagcaccgccactgttactagatcagaagttaatttttatagttgaaaccagtgcatcccttaataagatactcttactgtgtatttagtcatgaagacaatgaggaacaagcaatttgtttaattgtttgttgaaatcatcagtttgtcagattgagacacatactacaagttattcattggccgtcaagtgctttaattggaagtaaatttcaaactctttgggagatttctttggaactggatcggctgaaggacctgtggaggcgataccgaggcactgaggcagtgctggcccttggcgtagccctcccaatccatggcggcctccccctggcccctgggtaggttttaggcgcctggtggtggtggatcggtgccggtgggggatttgccgggtcggcgaaagaatgccgaccaaatttcattaagattgagagtaaaatacatgtattccgatattaaactgtcgagtcaaggcaaaagccttgaaacaaagtgagaaaaagaaaaggggaaaactatgccggtggggggattcagcgagttgaatgcggacaaggcggtttaataaccggaatcagggtacggttatgtatgggttatcccgatcaatcgtattcgtgtccaattccaaatggacaatgcgtgcctacttaaattaagtaaggcgcgtttaataaccaattaagacaaggggatatactacaggacatacagatcaatcatggcggcagtcttctgcggggacatgatcccggtaaagttgtggtgggagatcctgctcagggcaccaaccaaagacgtcgcccggtcaagctgcgtgtcaacgcagtggcgcggcatcgtcagcgacccctcctttcggaagctccaccatgacaggcatgccgtgcccaacctcaacgacggcatctccgacactttgctcgtcgccacgtctgacgtcgacggtgaaagcgtctccagcgtcttcccggctgcactggtctctccggcggtgacgggccaggcgcccatctgccgggtcaacaacccatacggctacagcctcaccaacgtctgcaatggattcctctgcttcgcctcctggagcagagccaaggtcatcgtgtgcaaccccgtcaccggcgagaagctggcgctccccagggctcctcaccttggactcgagaagcgtcgacgttactcgcggccggtcacgttcgccttggggttcagcccgaccaccggtgcgtacaagctgttccgctttgccgaccgcaggatggacgtgtacacgcttgccgctgctggcggttggcgccaacacccgtttcctcacccgtaccgcgtggtacaaaatacgccaactattgttgtaggtggtaagatatgcatgctgacagccaacccggcgtcgcatcagcacccaaacgatgttggcaaacccggtccggtgatggttgtcgatgtcgcaagcgaggagtaccgcacgtacaacccagcggactatgggtgcctgtgggccgacatggcagtgagcggctttgagctgcacggacggctatgcctggccatcaggtctgatacggaaatccatttctggaaaatgcctgttgaagaaatatccatgcgtgcttggctcgatggtgatacccacacgttgtgctacggagtggacaataagttgtactccaggtatgtcggcacaaccatgacgatgacaacatcgctggcggcacggtgtctttctccgaccgaggttatgtcatgggactgcaaaatccgtctccctacgactccaccgtggttagtgtcgtgcaactggaacatctacacgggataccgccccagcctgctctcgcctctcacctttgcgtcccagcaagataacaacgacgatgatgaagatgaaggcgacgagtcccgtccattcgtccgcagattgttgtgtgcactacgacaccagaaatcgcagaaacgccgcatgtctccaacatcaaccgatcataccaacggcaagagagtttgctatagaaatccatgcatatgctaatgtaaatatgtaattccccgatcctcgttgacaatattcacatagaaattgtattttaagcagtacaaacaatacataaacttatttatgtggtggattcaatcaatcctttccggcccaaaaaatatggcccacgtagaccacatccccttttaggcggcccatcgagctagcggccagaccgtacttgtaccgtctatttgaatttttttcatttttaaatttttttcttttaatatttacagaaataatctatggcgcaaaaaattacaaaaataaacagtagagggcggcaagctgacgtggcagacggcggctgccgccatctgcaaaaattacatttagccccttgccgccctctgtaagggttgcaaggggctaaatgcaattttc

SEQ ID NO: 9238 - DNA, 7672 bp, Oryza sativa
  unsure (1)..(7672): unsure at all n locations
cagccaaaaagtattaggcccgggttggctttttttgcatgggagccccttgccggttttcgtcgaaaaaaaaaaccctccctctcccgtcaccgcccgtccctcccctatttgcaacgtcaccgcccgtccctcccctatttgcaacgtgcgcttgcccctcccctatttgcaacgtcagcttgccgcccgtctgccattaccgcctgtccctcccccgtttgccacgtcagcttacctctcccgtcaccgcccgtctgccgtcaccgcccgtccctcccctatttgcaacgtcagcttgccgcccatctgccgttaccgcccgtccctcacccgtttgccacgtcagcttgccgccctaatggagggcagtagggtctatttttgtaattttttgcgctgatggattatttctgtaaatattaaaagaaaaaaaattaaaaatgaaaaaaattcccgtcgctttcaactcgcagcgctgatacctggccgtctccgggggatcggtgaccactacggcgtcctggcgctgtggaacccgctccacgcgccgttacgcgacgtgcaccgtacagcggtgtggcccttgagatccaaaaggcatcaagacaggtaaccacaaccctctaaaaaagaaaaatatttggaaaatatttgccccttcgtgtgagagttctgtgtcgtcgtacgtacgtgcgtggtgacgtgtagactcggggagacgtgagacgagtcaacacagtacagatggggagacgtgagacgagtcgagacaggtacagatgtcacgttttgaactagctatacacaacctgttctgttgttcttgtgttcatcaagctgctagaaaagaggctacaggtactacagtcggatactctagtgtgcttctttcagaacaaacgctcagggacaacagatcgatacataacacgagtgaaggtacacaagctaatcggagcatcccgtgatatgctagcatactacttaaccgtcgtcaggcagaagcagcaaggccgtcgagtcgtcgctcaatcgctcatcagtgtgtcgtcatcaggtgaaaaccctcccggcgtgcgccgtagtcatcgccggcagatcaacctcccggagatcggtcttcaagcccttgccggcggcattcgccagcgggtggatgccgtgatccgggccgctcatgtacgctcggttctccctctccttgtcgaacgacacgctgaacttctcctccacacctgcaatgcacgcaccaatcaccaacacaagtagttaagctgtgacgactgacgatagattggagaaaaaaacacaattgaacatgaatgattttgcacgtacatttggcgagttcttggcggagctggccgtcgcgggtgagagccatcatgatctggggcaggccgagcgggagcgcgtcgccgcggtcgacctgccagaagtggatggtcttgccgtaggtcttgcacaccctctcgaggtcgcggcgctcgacgacgccggggacgccgggcatgaagaggacgccgcccttgacctcgaactcgtgggtgtgccacagcggcttctcgtcgtcggggagcgtgaggaacagcggctcggcgacgatgtactcgacgccgatgaggcgcgcgccggcgtcgggcccgtcgaagatgaggcactggcgcatgtcctcgttgaggtgggcgcagaagtggtgcgcctccacctgccgcgtcatgtcgtcggcgtagaagtggaacgcgcacaggtgctggtggatctggttcacggggccgaacccctggatgctccccgtcgccgcctccagcagcgccgtccccgtctccgtcggcttccccggcacctccacctcgtggcacgacgccgccattgctcaactactagaagctagcttggtgtgtgtgccgctggatggatgaacgagagagagactcgagtgcgagcgagctgttcttatggtgcgctgactcgcccatgcagttgcacacgtgtagttctggaggaggcacgtgtctcccgcgacagatgcttcgctgccgccggctgccacgagcgcccacgactcgaactatcggcacgaagcatatgggcctaagagcgatgaaattgaggtgtccattttcggcccgcggcccaataggattgtcagaattcagcccattttcctccgactaactccataaggtggtgggctagacgatctgggtttgaaacctcacccattctaattatttgatattagatccttctctaatattggcctttttttaagaggatttttagggtacattgtactgcaagtatatactagcagtatatatgatttaacggtgtagattcatctaatcttccgcccaatgagcctgcagtataaattgaatagggtatattagtttttttcatcttttgcgtggaggaatatttttgtattttcgcatttctttacttcttcgtcagatcccgctcgagcgaattccagttggagagttagagccgttccctttcctttgtcgcatgtttgaccgccgccgccgacaaccaccggaagcacgccgcgccccgcgccgccgcccccgggaatcgattctatttacgtcctcttttcatcctcttctatcattcccactcatccaaaaccttccttaactcctctattgacggctcgggtgtgcggagacggcattcaggcggagctgcatatgggtgccggctgctgggggcccaggccaaggcgcgcagctgcggcagtttgctccggcaaggctacacacaaggactgaacattaatgatgaacaggttcgaaaagggtacatatagagggcttcagatgttcaagatggctacgcaaaaaaatattttgatcctgttttggataagaatctgatactttcagtagtagcatgtaacattgaacgctcgacctcagtctttgtctctccctcaggaggcagaccgcatggaagtaacattttctgcaacaccagcagtccaaggaagcctacagaatcggcgacggccgggcatggagggcagaagatggggaggcagccggctatagcagcgcgccgcctcgccgcgagagggcacggaggctgatgctgggttccagccgccacgagagtagtgtacaaacacttcaccgccacgggttggggagtacaggagcagtgagactggaggtgggaagcggggggaggcagccagctcgtagcggtttgggaaaggctggagctgtgaggacggatgcggaggagaaagccacgcggggaggaatcgcgcagtcgtcaaacgaggagcctacaagcgcgtcgtcgtcagaacatgccccgaccgctcatgcgagatccaggcctccagggtactgtcgatggacggtattataaatctcaacttcaaatgactaataagcactttttaggtttttgacaaattcctattatacccataaatatactgctagtatatacttgcagtataatgtaccgtaaaagtcctcttttttttaagtgtcaccctgaagtctgaattctgtctgcgtagctgttagctctgaattctgatcagaaaagttcagtatatcttgcgcccacatgtattggtatcacagaaaccaaaacaaacaagatgactctggcataagcttaaaacgaaccgctgaccaagatggtaaaatctttgtacacgtacaagaagaatttttaccaagatggcagaggaggagcatatcgatctcatgtaaaaaaggaaaatggtaaaattctaaactatcaagccatattctaaatgatgataccgggttgatcaagatggccactgcagttagtcgatggaacttcagaaagctcaagcttccctgtccactcctctcccggtttcagagtgatttgtctctccgctgcagccgcatcaacgcacagcatctgtttgtactcctcatcgccgaagtccacgatgtttttcgatttcttttcccacggattccacacaactgggaggaataaagcgaatatgatggaaatttttcaagcaaagttaccatggttaggtggcaaagagaatattgtgtcttaccaacgtcaggcagtccttcctttcttatgacaaatgtgcgtttcttctcatggtccagaacagctattacatttggtgagctaacatagactcggtcaacctgcatatgtttgcacatagaccaggtgctaacaccgtaaatcttggactttatgatgtggcaagtaaatttttacaacaaaatgtcaaaacaagatttgcggaatcagtagatcaaagtatatagcgcatatgattattcaaacatttttcacctccgattcaaatgttatggcatctccttgttctgtaaaacgttctctctggctaagattatcgagataatcaagtgtctcaaggccttctatcctcacctcactggaattaacaagatatataatctgtcatcttcaaaatattatatggcaccaacaaaaagtggttgaagtacaaaaagaatgttgggtgaaatgcctgacctgatgtcagaaacagacagatatgtgtgataaccaaatgagaaactgaatggcttgccattaacatttctgatgcgtgatactagtgacaggttcccatcctttgtaagagaaactctcaggcggaactcaaaactgaaatcaaatattgcaggatcatacataaaatcaaattcagtcagcattaacaacgagatgaggtgcaaatgttcaacaacctccctgaaataaaatattctcctgactattatcatcaaaagtgccaggattaggctgttcaactaattacccccatgatgcagtacataacaaaactttgacatatggcccttactaacaaaaaggcgtgctataagagaaaaggaaatacatattggacaaaaacaaatgcatacccatgtggccagcacttcaggtcatcttcagatggctttagtataaggtcaacagaagctttgctgttgttatcattttgatttaatggtggatgctcctcatctagggcccatatcctgtttcttgcaaatccatgttgctccaatgttccagaatttccaaactgcagtgagtcttgtggatatcagaaaagaccaaaaagaagggaagctagcttccttatcaattggcatcctatttgtaacagtatataatacaaatcttcagtgcaatggaagactatgatacctgtggaaaacatatcgggattccaccacgcatcgcctttggtggcttgaagattgcctgcacgtcaagaaactgcgtgttgaagccagtgaaagagccatggaagagaatactgaagatttcttcagtttcccagatggaaacagtgaaacagttcaggtttttgtgtcttcagagcccgtctgaactgtccttccacaagtacagtttaatgttcagagtacacacttctcaaacagaatcaatccaagaacatatcccgcgagcgtacagtttgaattctactgcaatcaattgaacttgcgaaatacacttccctaggctaatcgcagtaatgtgaacccggttgcagagcactgaagaatcgaaaaatgaattgaaaaaaaaaaaacgtcaccttgctgctggtgaagagaagctcctcgccgcggtcgttcctccaggagaggacctgcccgccgtgcaggctcacctgcaaaacacacaccacgacgaagaaaacaaagccatcagaatcgcaccaaaccaaaccaaaggactcaatgccaacccgatcaaaatccattcgcaaagacctgctcacccgcgagtaggcgccccccggcgagcggagcacgacctggtagacgccgttccagtccctgaccacctccagctccgtcctcggatccgtcaggttggtgtagtgccccatgctcatcaacagccagccagccagcccgcgtgaagagagagtagaggagaaggagagacgcacacgagcgcgcgcacgtacgcgtacgagattttatggcgacgcgcgggaagcagtgggcggcgtcgccattgggacggttggggttgccacgacgttttacactgcgcgtctgcactttccttgtgagcgcaaaaaaaaaaaaaaaaaaaaaaaaaatgaacaccgcgcgagcgcgcgcgcggcctgaaacccgtgagccaccggccacaccagcgcagcctcagcggaagccaaagcttctgcaaccaaccaaaccaccggctcgctctcgctcggagcagcaaattcacaaggcacgccacggcaacaacaacaaacggatcggatgcagcgggaaatggaaatgcacgtggtggtcagaagcgcagcgcagggcaaccacctcgtcacgtcgccattggaagatcgagatgagggaggcgaggcgaggagagaagcacgagtgggtgaagctctagcttctctagtgcgcgaggaggatgagaggatccgaggctaggagaggagaggttgatgctgataccgatggcttcgtgcacccggcagagcccggaacccggtaaaaccaacccagcgccgcggccatggaggacacgtgcagtcgccgctttttcgttgagaaaaaactaagacaaaccgtgggggttcgaccactttgttgcactttgcaggtatagaaaagtctcaggaaagaaactgagaaaggaaaaaagggtttcatcgacgacgcaatgctgagtaggagaaagaaattttgaaggaagaacgaggaggagaattaacagattgttttggcttctgccttgtggataataatcggataaactcttgcagcttttctcgtgtcctgccttgagtctgcgtaatgtaatgcctgcattttaattttagccggttctttttaatttcgcggaggagcccacgctgcaacggtcaagttttctcctccaagtttttcaaaggcttttttggcgtttcttaagccttccgcttcgccatctctctttctttactcctttattataatctttattctcttctttaaagcagaacggcagattagtagtagctactataatcaacaagccttgttctaaacatggcgtctgttcaaacatcgaagtaatgtgttcttttgttttcggagaggacaaatttccagaaacaaacgattcttatgcgtgacacgatctctaaataactttgtttgcatgcacacataggccaggtatgctttgttcacagacagtgcagcgaaaggaacacttgcgttgcttcaggacctggaacttatccatggtcgccaaatgtacgagtgccgtgctctctgaaacctgcttagaacaggggcctctcatttacttacatcaacccagtgatttaactttttttaacttaaaaaagaactcaatgattcggacaaaaatggtgatccgaaaactgtttaagcgaatctttcggaaagggagaagtgcagcgagtgtaatccacaagtcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9239 - DNA, 843 bp, Oryza sativa
atgcagcgctatcagtatgcaagaagctgcaaacaacacagacctcctgacgtatgcttcgggatgttgcgaaacagccctgcagaaacaaaatccaatgtcaaaatcgtaccacttggttataactaagaaagtctttaacacggaaatgcttgttttaggcttggcagacctagatctgatcatatcaagaagagctggggcaacaactgatccctttgtatgcattgccatgcaattgacacagacccagcatgtatatcaatttacctaggacaacaaagtccggattgagcaagtcaacaccatgtgatcttttatcatatccttgcataacagggagcataaaagcagcagcatataaaggaaatctgttttttgaccactctgtctgcaaatccttagcttttccaagaccccatttaggagattttcctgatttaacttgaccagatctagatggaacttctctttcataccggtgtgaccaattcagaagtgttcctgattctgagacttccctccaaggacctgcaccagcaggtccctgatcactaggaactagccaagagggagaggtgtcggatatcaagtttccatgccgcagctctctccttacaattttagtttccgcaagctcctgtgcggcctcagtcataacatcaataatcaaaatgcgctgacttacatccacgcttgatgagtacagcaacttggtgagaacatctaatgattcaaatgtgcaggttaccagcaaggcaactaatgccttctgtctcttttcttcagcagaatcttcctctccttccattgccacgtcagaacatcgaacatgcacaagtg

SEQ ID NO: 9240 - DNA, 6269 bp, Oryza sativa
aacctatctatatagggatgtgaatcagcgattggacctactatgaataaacaagaaaagggctgaccaaagcctttagtgtgccacgagaagcccacacaaccagagagtgaccagcattattcccaaccttacgacctatccttgacccaatccataacattaacccggttattttgaaagagaaaaaaaagaaggaaatttgagatcgtgataacaacattgaccgtaagggtgttgagattgatactgaagtggaggaaaccttctagcaatctaaccaatttgttgcagcacaagctgggctcatgttcatccatcactacgtataaaaaggtcatatcactctggcatgtcaagaatcaagatgctatcgctggccttatatcacattgctggcaaagctctggaatggagtacatcgtgcttttgctgctatgcttggcctacacaaaactgatgctccgctaatgcagcccacatgaagcctccagccccccactgccatgatcaacctatgttacaccccctcaagcccaccaccacacacctagcctttattgttgcaatcatgtcacaccgattatgcgttgcaatcatgctgcactaatcgtagccaaggacccataaggagaaaatatctcacttggaaacgacaaagatgaccaatgatgtaggaaaaaaatgggtaaatattaatttgtttgttgaagaagtataacttgtttttgtccaagattcgtttttgagataacagatggagatgggaaattatttctgttctccatcatgataaatcgactactacaactaagtttttaaagcaagtgcattgttttatatatgattgtaaatagaaactagatactatcaaccaggaaccaggaactacaatgaagctgaatggtgttctgaagaagcaatataaaggttgatgctatgaagaaattttagcacatcattaaaaagaacatgatacaccaaatgttgaaaggttcagagacatacctcaacaagggttataccctttggcccttgagcactgatcatatcatatatacagttttctaaagagagttccataatttggtcagttgcctgccctttcttgccaagtttgtagtttgaggtttgaatttttggcagaaactcatttggatcaaatttcttcaaaagacgtaaacagggaacaatctgaaaaagatgagcatttttatagcttatggtcaacaaggtatgtgaccgagtaaatgattaaagcatgagtgaggcacaccaggctgataactatgtcactacatgcctaacagatcaaattattgcatgttttcattgcagctgtgaaagaaaatatagcataagtgttgcagttgccaaacagatttggatggaactgctacagtcctgtaagcatgctagaaggacgagttcttagttgtctaaccatgtttcaagtaaaaacttgtgcactctgtttcagattattttaaataaaaaatagaactggaggcatagcctttttgttaaaaagaaaagagacatgaaatttggtaaaacaaatttcaacctgcatccaaaccagggtatgaaaccgtgctggcgatttctgaagaccgaaagattttcaaaacatgaaatcgattattttgaatttactgttcttgaccaaaaaaaccaccaataaccagaagtattaagaccaaatattagaaaaaggcatataactgaaaagactacaaagtgggaggaaagataatttcaccttatcatcaactttggcatcaaattcttcaacaaggtgtgcgtctctaagcctatgcagtacctggagaaaaggtgtcgcggtaacacccaaataagtgcaaccataaagtgtataacacaaacaggaagtgattacaaacaaactcaaatttctccatgctctatgcccaaatgtcatcctgtaattgagatcattttttatgtctgacacgacaagaacctataggaaatagttactgaaggttagaaaactggaaaaatgaaaaagaacaccgaacaaatgaacagaacaattgacccttccactagcttcttcgagtttgtcacaaatggctttcattgctggaagataatcatggatagatacatcattatcggagtttacaccaaaagtcccatcttgtagatcatctatgttggtctcttcattgctcaccaatagtccgggctttataatctcaattctctggtgtgaattcatacagtctttggcatatctagtgagatacaatgagttggtattggttactcgtttattctgtgaagcatcttccttctcagctccattgcctttaaactttataatagttgatcgtctaacaattaacttctgggactgaaggctttgcacaatataatggaagttgttcccttccatgccaaaacttttgcacaggtcattttgtgttacaccagaagtcctatgacaaatacatgatataagttattgcacacattatatcaaaggcactatacttagttagtctatgaacgtttgataatttgaccaaatgtcacacctgacacaccagatgataatttgatcaaatgtcacattgggtagatgttgtgaccaaatgccacaacagatgataatttagaccaaaaatgtcacaaaaccaggacgaacctgcttgccccgacacgttgtaaagccttcttctggacggcactcatctccgatttggagtgcctgagatcatacatgccaaggaagttgtccctgagcgcggcgctcgcaaccagccgcatgcccagccgctcggcgtcctccacgccgaccttgggatcgtcgacgaccggcccctccgcctccgcctccgcctcccccagcacgacgctgatgacggggagcacgatgaggcgggcccagacggcgcgcttgacagccggcccaattgggaggccggccgcctcgagcgcgccacggagcgccgcccagagatcggtcaccgggatgccggccgagaggcgggcgctcacctcctccagcgccgccgagacgagcgcgtccatcggctaccttccgctagggttttagctctagccgcatcggctaccttcggctctccacgagacgggaagagaggattgcttcgctatgggctatggcgagtcggcgaggtggaggcagcgcgcgacgatggccgcgcggcggcgccgcgcgcgcgaccgacggcgagatgaaccggtgttccgtgcggttcaggcgtgccacgttcacgcgctgttttgcgaataggcccttgaatttaaacaaaagtagtttccgtgttcttaactttttattgtagtccctatatgtccgctcgattttatttttatgttttgagttttgattttttaattttaaaataatcattctaaaacttattttaaaaatacttcttttaaccacatcaatcagtgggactaacatagcaaaacatcgctgccacactcatctaaggtagggatgaaaacggtcggaacgatcggaaaacagcctcaaccatttccgtaaccatatttttcttggaaacgaaattggaaacgataaagtcggaaacaaaaacgatatcggaaatatcggaaaaccggaaacggaacaatacggacggaaacatgtcggtacagatcggaaaccggtaacaaatacggaaacattaaactataaaaacatatatttaactttacataagtatgttatatatatatatacataaattcaagcttatactatataaattataaattaacttcattttagccatgtacaaaagttagagattttattgaagagtcattcaatctataagctgtgggttaagtatagacatgtcctataatatcgacatatttagaatacggtaattaccatattataagaaacggtaatttccgcgagaatacggtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctaatctaaggccccgtttgatagatttacaactcctaaatttaactaccggagataagatctgaagtgaattgtagagtagcataacccaattccacctatctatttttttttataacgctccagctagctctattccgactttaggtggagttagagtcagagtagtgtcaaacaagacttaaatgaagtggcagcgttatttgatcacgccatgttaactaacgtgacaaaataaaactatcatgtccactacgggtgatgtaattttgtcatgctactgttttagaatgaatctctatctccactaatataaaaattaaagatatttttatcggtactttagtacgtcatccgtgtataagtcagttttaaggtcattcgcttatttaagtgagtttttaagttcgttcgcttttgaaaatattggagcgtataagaaatctcttttaaaatactcgcatgctaacttgagacgttcggactcctaattacagctcatgattttgtaaaaaaaaatattcaaggtaaattttaccttagctaaaccgtacaacaataataataaagattaaaatagtcttcgcccgttacaacacaccggcgttcttttctagttatttgaaaattaaaaagtaaaaaaaaaagttgaaataaattttatccgctccccaccaagccagccagccccactgcccgacggcacccggccgccgccgccgccgcctcctcgactcctccgccccgccgcgtcgcacccgacgaccggaccgccgtctccgcctgccgcccgcacggccgcacccggtgagtggctggatggatcctgtttagttctttgcttcctcggtatttgagtgaaaattttgttctttgatgggtttgggcgcgcgatttggtgggaggtgaactcttctagattctccactgctgccgaaattaagctgtgatcgatgttcatggtactctagaatgatacgcgagatgttagggtctaggttccccattgctgccaaattttagttgtgattgatgtccatggaactctagaatgatacacgtgagatgttagggttgtgcgattgcgcaaaactagttgtgtttgggcatattgtggatctgatgcagcaggtcataagactgagtgtgtgtgatctggaagcactcctcattctttttagtcttgcatatgctactgccgcttggttctgtgcttcactactgagtactatgcccattcatgtctattttcctgttgttgaaattaattaagctacatttgtggccagtcaaaactgctcaactggttgacttctaaatgatacagtttcttttttatcatagcactgtgttgatttcgtttattggatccctcggattgcaaaatgcttgccaaagggaggaaagttgctggaaggggtggagacatgtctgcacactatgcatttgggctgcaggaagatgatgcgatcattaaacgtaggcttctgaccaggacaacaactaccaggggtgaaccaccactaaagaagcttcagaagaagttcatgtcctttgccactgaggttgagaaggatgctgacaacataagtgactgtgagaggttgtacaaggcctttttacaggaaattaatgcttttgtgttgcctcttcttaagagcaaggccgtggttgatgcaaaccttagggagaaggagagcttcaacgagctgcaagacgagattcagcgacaaatcttgcaagctcagactgatattgaggaactcaaaaagaaactggaacagagcagaattgagaggctgtacaaagaggagtgcgaagcgatcagaaaaatgatttctttgcagcctccacgatcggaaacagagaagctcatcgcgggtcttgagaaggagattgctaatttggaggccgagaatacagcatgtataaggactctggaactaaggaagaagcagctttctcttcttcttcatgtggtgagtttattcgtcaggttccttttgcttttctgaatcatgccttttccctttctatatagagtggtaagaggatactcattggaatttattaatctgcatggtaagcttaaatgatatactacttttacaaacattgtttcccgcaagaccgcaacacaaaactacgtttaggaaaaatat

SEQ ID NO: 9241 - DNA, 805 bp, Oryza sativa
tacatccaaacatatgtacatagccgaatgttatgtatgttagattatgatatactcccactatttaattaaacaaaaatcaatattgtaatatgtaagtacttagaataacataatgaaagctatgagctttcgcgtacaaatgaatgaataaataaataagtctcattttttaagcaatatgctagctcttgatttgtttacttaaagccatgttcttgtggtggttgacgacagtatgtttacgaaaaagagagaaggggagactacttgggtcagactgttcaggtgccaaccacttctcctcaattcttcttaatttgtttttcaatttttggtaaatttaatatctacatttcttgaaaatccaaccaatcatcatttttttaaggttatcccacatattacaaatgagatacaagattggattgagcgtatcgcgatggttcccgttgatggtgaggtggatcctgccgatgtctatataatagagctcggtggcactataggtaacaagagacaattaaccagctgcattttattcttaacaaattcttagagttacataaatttttggacttacaagtcaatttaaaagctatatatcatgtctttattttcagtttattaacagtatttgttcgacactatgctgcaggcgatattgaatccacgcaatttattgaagcctttagtcaattctcctatcgtgttggtaaataaattgaattattgcataacagatattttaattttctccatggtgatatgataaccttatttgcatgttatttttggacaggtg

SEQ ID NO: 9242 - DNA, 1044 bp, Oryza sativa
aaggtatacgttagaattacagttattaatttagggatggaggttagtacagtagtaaactaaaacatacacaaacatatataggaaaaagagaaaaggaggaattagcagcacgttggttgctaggagtactccagtacgtaccgatcttaatggacgtaacgcggaggccgcacgccttgaggacgacgccaatgctgctcgccgtcacccccttgccgaggccgctgatcacgcctcccatcaccaccacgtacttcatcgtctctatgtacctagcttcttgctccttgggttaaaaacctaacgcagccaacaaccaaaggtaaattaaaattacctgatcgatcgctcaccggccgtaacttcagcccttttattagccgcaacaagggcagagctggactcggactagaatttggtttccacgtcgacagtgcgtcgattagcattcagttaggggcttgtttagcaaataataacaaccatacatgttggaataatctggaggagtatatgtcacaccatgatgttctgttccttcagacaaagggcacacgattacaacttaggactgaaattacaactgaaactacacgagagactctggccttctctctaaaaaaaaaactacacgagagtcatcatgtgtcagggtgtaattaagcaacctacaagtctaaccaaggcaattaagtgctatatagccacaagaaaacgtatctgcctttgtggaactaggcaggcatcgcgcttttctgctaggatcagtctaaagccatggcatctgaagcatcgccgctaccttcatctgtgctcatgttctgctgctcttcagcgccagctctcagctcatccgctatgctcctctgctcatcttcgattgagatctgcaattcctcgacctgtaatagatacaacatcagaaatcaataggcatcagccaaaacaatgaactgcatggcatgattaaaatagctacatatagtcttccaagttccttcttagacaaatggatgctaatagttataatttgataaaaat

SEQ ID NO: 9243 - DNA, 1107 bp, Oryza sativa
cccacgattaccataattcttaaatttattactgctattaaattggttcattaaagttcaagttgcttaggcaaataaaataagacaggctccgacacagttatgccacacaccggcataaccatgccccacacgactcaacaagaagacaaacgaggaagaacacacgcgcaagcctactaactgctcgtctactgctgcgacgggccagggcggaaggtgagcaacagcgcatcctccgtgctaccaacgccggaggcttccccctcctggggaaccacgggcgcgggctcggcacgaggggtctcgacgaagcaggtccacgccagggactgacgaacaagctcaggcctggaggtgctcttgcgggcggtgatcttctggctgcggcagacgcggcgacgcttggggcggcagacctctccctgggcgatcttgagctgatgcagctgcgcctccaccgcgtcgaggtccttcttgagctgcaggttctcctggcgcagctccaggatcttcatgttgttctcgaccataccgcggcgcaccatctgatggaagtcgatacgagccgcgtcgtacgcctccaccatgcgtgccaggtgcacgatggtagcgtcatcctccgagctagcatcccggaaggtggcgtagtcgcgggctcctccgcgacgagggtggtagcggtagggcgagtgctgcaactcgtccgggtagcgctggtgaagggtgccgatggcgaggagagcggcgctctggcaagcggcggggaaggagtctccacccgcggtgactgccaacgaagcccgctcagaagagccggcgaggatcactgcggtgacctcccacccagcgtggggctccgcgtcgtctccctcctgatccggaagcggcctggcctggtagtccactccgtgtggataccccaagaccacgcacatgcctcgcaactccaagacgaagcagtcatgtccaaaccatgacgggtgacgctgccggccatctacaaacaaaaacaaaaagagaaacaacattttaaaggtcagattttgatgataagtgaagcagcaagacagagagagactagacagttttcacaaataacaaagg

SEQ ID NO: 9244 - DNA, 1232 bp, Oryza sativa
gaggtgtacatctttacccacaagacacatctttctcacgtgcaaccacgtgccacataccaccacggtatacagacgaaagacgtgacatagtttccaacccatcctagccatagacaagagtaccgacccaatcccgcctacggccggaacccccgggacaggcaggcagaactgagcccctcgcagcagggcaccaaccctgtgccatgacatctcgactaccgggccgcagctcgtgtagccttcatttgccctggagaatgtccatcgacccccgacttcatccatctccaatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgggggcttttgaatagagggagcggtgtgaatccaattccacaataaaccaacaattccaaagtgcccaggtgatatgaatattcccaaagtctaaagttgtaaaaccacctaatgttacctaattaaattgcgaagcatctacctaaaatcatactagtgataccacgagtagagtgtccactagttggggttttgtttaatctagggtgaacaaggtaataataacaatagcaataataataaggtcataacaaaggtaaataggcatggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctacagcgtctacacgaccaacggaaaagaaaaggctcaaactgtcacgtcctgataaattcatcccaaaataaaaatcattttcaaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgaaaagaaataaacaaagttgaaaaggtttataaaaagaaaaatccctaaaagtcttttttcccccccccttccttctt

SEQ ID NO: 9245 - DNA, 4014 bp, Oryza sativa
atgtcatatggcagagggttggtcccctgctgttaggggctcagtcctgcatgcctgtcccgggtgttccggccgtaggcgggattgggtcggtactcttgtctatggctaggatgggttggaaactatgtcacgtcttccgtctgtacaccgtggtggtatgtggcacgtggttacacgtgaggaagatgtgtcttgtgggtaaagatgtacccctctgatcagagtataatctattcgaatagccgcgccctcggttatgggcaagccgagcaatgtacccaagtcagtgtttcaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggattgtcttataaaatggctttggggcaactaagtgacttttaaatgctgtttactgcaaaacttaacccctatattattatccccttgtactcccttgcattaattatgcatctccggtgtggcttgctgagtactgtggttgtacttattcttgctcaatctttcccctcttcagtaagagaagctttggagaagatgtcttaggtggagtcctggcttataccccagttgagcgcctgtgaagattgagccgtaggcccgctagtccgctgctgtttatttttgattgtcaggccttaagtgcctttgtaataatgtaaatattatcgatataataaagatgtgtcttttataccatgtttgtgtggtgtaccccggcttttcctgggacggggattaatacactagcgttcgggaaaaggcaattttcccggtcgcgacacaaacactaataaattccacataacagcagaaacaaagcacaaaaatgggttcttcacttcttaaggaaaaattagagacttgaacggtccaattccgagttcaaatggccaagttatggccatttgaagtttatatgctctttaaatggatatttgcgaatttcttcatttaaattttaatttaaaaatcgaattattgcgtcagccgagagagagggcgcgcggaccgggtccacgggagtggggcccacgcgtcagcctctcggtccacggtggaccgggagcacgcggctggcggcggtcggcgccgtgggtcccacaagtcagccgcacccgcgggcgcgggcggctgacggccgggccccacctggcagccgcgggaggcggccgaaggcggcctcgccggcacggccgacgggaggcggcgcacccgctccccgatggtcaccgccggcgaccaccggcgcggcggagcggcgcccgagagagcggagagaagagggaaagcgaacggcggtcctcggctcaccccgggacgacgagggcggcggaaacgacgaccgaagcggcgagaggcggcggcgcggttcgggatgacgagggcgacggtgctccggcagtcggcgggcgaaacggaggagcggacggggtcgacgacgacgcggcgaagccgatggaggtggcgccgagtcgggaggaagtccggagtgacgacggcggcgaaccgaaggttggcggcgacggcggagagagaggaggacggcgctagcacgaatccgacggcgagagcgagcggcgagcggcggaaacggaggagagaggcacggggagcaaatatatagcgccgagagggggagagcgcggccggagagggaggaaacggccgcggagatctcggctccattgaagacaccggcgacgattgcgggattcaaatcggacgaatccgagggagagagagagggaaaagagggggaaacgggagagggaatcacggggagtgatttccccctctttaatgcgcgcggggacggcgggatgcggcggaatccgcggcggcggcggcgctagggcacgggcgggcggcggcgcggcgcgaggaggaagatgacaggcgggacccacccgtcagcgagggtggcgggcgggcccacccgtcagcggcgcgcgcgcggggaggagccgatgggccgcggggagaggagagaggggggggagttgggccgagccggcccaagaagggaaaaggggaggaaaaggacttcttttagggttttctttttttataaaccttttcaactttgtttatttcttctcaattattatttgtgctctgaaaattccactaaaatttgtttaagcattttaggcttttaggaaatatacaaaaatcctccaagcctcatttgacttttacatttgcacattttaattgttggaggctttcacatgaattttaattattctttgcacaatttcgaggatagattttagagtcgatttgggacgcgacacaagctaacacaacgatctaagacaacgacttaacaagtcattctagttcttccgagcataggaggtcgattgaaggctcgttcggctcatcttcctcatctttgatagctacccactcaaacttggaattgttgcgcttgggttcttcttcttcatcactacttatgatgatgaccggaggatttgctggggcaacttctttctccaccacgcggacctttggcgccaattgatagcgagggacaaacaaagctctcttccttgcggtaagacgaatcctagccttctgcggcggtgcttctcccttcaatgcggctaattccttctccaaacgatccaccttgtcttctagcttgcaaatcttaccacgattccgatcttcacgatcttgagctgctaacacagtctccgcacgactttcatccatagcccacaacatctcaaccaaatgtcttgtggtaacatcattctcaattccttcagtctcaaggtaactgccacggtcacttccctggggttggcgaggatgatagcgatactcagtgtcggccaactgatcactgtagcgatcacgaagctctcctatggcaatccttgccacctcctgacatgcatggatgtagtttcttcctccagcttcaaacatcactgaggggatatcttcactattgctgttcaaggtgactttgactcggcacttttcttcatgacgatcatgacgaatctgggcataaaaaggagcattcccaaatccaatgacaaaggacatcgtacgcaactcctggacaaaaccttcaactccaaacaggtactcaggcttgtaacacggcatctaaagacaagtgaaaggagagagttaagacatctatccaattaatagcacaagtttttggattaatttgaataaagtttgaaaatcaaagtaaaaaggtaagtaattaaagtaaaccaagctttgcgaaataaattaaaacagttggaaacgagatcataaattttgtaattttgaataactggtttcaaaagaaatgaaagaaaattataaaatcaacatggtaaatttattttattgcagcaagattaaataaaacaatattgtaaaacttttgctgataaatgagccattagtacagtaatagatgtacagtactaataacactggaataaatttttaatgagaaccaaaaaaaaattatgaagtgcatgtgccattagtttggttaattaaaagagaaagggaggagaacagttctacttttccaatatttttagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggggtagacggcttcactccacaggcagcttgaccaaggctacacctaatc

SEQ ID NO: 9246 - DNA, 5879 bp, Oryza sativa
caatccctagccagggggatcctcctcgcatcagcagcatcagcagcagcagcaacgtcgcccagcgcaccgacctcaattcgtggtgcgcgtcccacagccgcagcagcatcagaatcagcaagggactcgtgcgccccgtcctcatacgccagctgtgcagcccgttcaaggccgcagggacgctcaaggtcagcagcgtctgtgcttcaactgcttcgagcccgggcactttgcggataaatgcccaaagccaaggcgtcagcaaggccaagcgcctccccgctccaacaacggcgggaaggatgtctgtcacgcccggaatttctatccaaaattccaaacgcttacatgtgtgtgaaccctcgtccaggaatcagccgaggcacacaataacaaattgataatagagtacaaatattactctaattaataagcgaatagaatgtcattacagaggtagatagttcctctcaatcaataaagttctaagcagcggaaaataaataaacggcgtagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaattaaacaatattaagccaacgctatacaacataccctgttgtataggcccaaccattctgaacaaccaccccggctgcacagttctatctccaaaccaggaatgtaccattccaaaccaggagctaatcaaattattaccagttatagcatcttttataatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaattcactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgctcacaacccaccattaccaggttttagttggcacaataattaattaactaatcacgattgaccatcgtgaactatcaataagccatcatgaaataatagtgaatcattagttatcccataagtgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccggcgcatgggcggcggttcacgctaacggacggccgagattgatccgatccaaatcggacggctgagattgatcgagtccacggcggttcacggcggacggccttgatgacgccagcaatgacgtcaccgacggcggcggcggctcggctaggcagacggctcgggcggcgcacgctcaccggcgaacggcggcgctacggcacgaacggaggacaccaacgggtagcggacggcacggcgaacacaccgacgaccaaaacgacggcggagaagcaacggacggcgacggcgacgagaaggaagcggcggctaccttcgggttgtcgacggcgacgaagctccagcgggttccgacggctgcgaaggggcggacgaggacggcggcgacttggcgatgacgacggcggtcttcccgagcggcggcgacagctggagcgacggcggagcacggctgaagcggcggcggcgacggcgaagctagggcacacggcgctagagctactccggcgacgagaggcgaaggcgagggctgcgacgggtagaggagacaccgggggtccttttaaaggggctcggaggcggcggcgaaggcccacggcgacggcaacggcgaaggaaactcgcggcttggaaagagggaaaaccgatccgaatcgaactcgattccaaagctttccaaagcgatttaaccaaagattccaaaggagaaaaggtagaggagatcccggagatcatttcccctctattgattcggccggagaaggaaagaggcggccggatttggaaagcggcggcgacggcagctcggcggcgcgaaactagggtttcggcccgaggaagacgacgactgacgggtgggccccacctgtcagcggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaatgtcattcggggccgtgtgaatcatgtgacggccgaggacgtgctgacaactccagacgtcatcgttggtacgttcctcgttcattccatccctgctacaattttgtttgactctggagcttcccactcgtttatatctgtgcgattcgtggggagaaatcagttgggggtagaaaggcttagaaaccctctgctcatcaccacccctggaggggttatgacagcaaagtattatagccctgccgtccctatagaaattcaggggattccttttccctcggatctgattctgctagacaccaagaacttggatgtgattcttgggatgaattggttggcacaattccaaggagtagtggattgcgcgagacgcactgttactctgtaccgagggccagaacaaccggttgttttctttgcacccccaacctctgtcagaagttcagaacttcatcagatagaactgtcagaaattcccatcgtcagagagttcggagacgtgtttccggaagaactacccggtatgccgcctaagcgagagattgagttccgaatagatcttgctccaggaaccactcctctgcacaagcgaccctaccgtatggcagcaaatgaactagccgaagtaaagaaacagctggaagagttgaaagaaaaggggtacatacgtccgagtacttccccatggggtgctcctgtgatttttgtagagaagaaagacaagacgaagaggatgtgcgttgactacagagctctcaatgaagtcaccatcaaaaacaagtaccctcttccccggatcgatgatctgttcgatcagctcaaaggtgccactgtattctccaagattgatctccgttccggatatcaccaattacgtattcgtgaagaagatattccgaagaccgcattcaccacgcgatacgggctgtatgaattcacggtgatgtcgttcggtttgaccaatgcgcctgccttcttcatgaacttaatgaataaagtgttcatggaatacttggataagtttgttgtggttttcattgatgacattctgatatactcacaaccagaggaagaccatcagcaccatctccgtctggtgttgggaaagttgcgggaacatcaattgtatgccaagcttagcaagtgtgagttctggttgtccgaagtcaaattcttagggcacgtgatatctgctaaaggagttgctgtggatcccgaaacagtgaccgccgtcaccgattggaagcaacccaagacagtcactcaaattcgcagtttcttaggtttggcaggatactaccggaggttcatcgagaacttctccaaaatcgctcgacccatgacacagttgttgaagaaagaagagaaatttgtgtggagcccgcaatgcgagaaggcgtttcaaactctcaaggaaaagctggtttcctcgccagtgttaatcttgccggatacccgcaaggacttcatggtgtattgtgatgcttcgcgccaaggattggggtgcgtgctcatgcaggatggtcatgtggtagcctatgcctcacgtcagctacgacctcatgaaggcaactaccctacacatgacttggaattagccgcagtagttcatgctctaaaaatctggcggcactatctcattgggaatcgctgtgaaatctataccgaccataagagtctgaaatacatcttcactcagtcggacctgaatcttcggcaaaggagatggttagaactcatcaaggattatgatgtgggaattcactatcatcctggtaaggccaacgtggttgccgacgctctaagtcgaaagagtcattgcaacactcttaacgtccgtggcattccacccgaacttagtcaacaaatggaagccctgaacctaagcatagttggtcgtggattcttggctgcgttggaagccaagcctaccttgctcgatcaaatccgcgaggctcagaagaatgatccggacatgcatggactcctcaagaatatgaaacagggtaaagccgctggtttcacagaggatgaacacggaaccctatggaacggaaatcgggtatgcgttccagatagcagagaacttaaacagctgatacttcaggaagctcacgaaagtccttattcaatccaccctggcagtaccaagatgtacttagacttgaaggagaaatactggtgggttagcatgaagcgggaaattgcagagttcgtggctctgtgtgatgtgtgccagcgtgtcaaggcagagcaccagcgaccggccggactcctccaacctctccaagtgccagaatggaaatgggatgaaattgggatggatttcatcaccggacttccaaaaacccaaggcggatatgattctatatgggtagttgtggatcggttaaccaaggtggctcgattcattcctgtgaagaccacctatggagggaacaaactagcggagctctacttcgctaggatcgtgagtctccatggtattcccaagaaaatcgtatctgataggggaagccaattcacctctcacttttggaagaagctccaagaagagcttggtacccgatt

SEQ ID NO: 9247 - DNA, 1579 bp, Oryza sativa
cagctcggcggcgcgaaactagggtttcggcccgaggaagaggacgactgacgggtgggccccacctgtcaggggccgaacgcgcgcgcgcggctgcggactgggccggctgggccgaggagagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatctggcccaattttatattggaatttattaattaaacatagattttcttttcaagacttttaaaattatttctaaaaattccatttaaacaacaatttatatattttgaattttcagggtgtgacaaacctaccccccttaaacagaatctcgtcctcgagattcggaagaactggcgaacagaagcggatgagctgactttaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatctggtcaatattagcttcttcggtaggtacccttaaacactttttcaattgcgacacatggaacacattatggactcctgccaaggattgaggtaactccaactgataagcaacctctcctcttctgctgacaatcttataaggtcccacaaaacgcggtgccaattttcctttggtctgaaaacgatgaactcctcgaagaggcgtgacacgaagatacacataatctccttcttcaaaactcaaatctctgcggcgattgtcggcataactcttatgacgagattgagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgtagactagcttgataactgttgttgtacgaaaattctgcatagggtagattcttatcccaacttccaccgaaatctagagcacaagctctcaacatgtcttccaaaatttgattcaccctttcggtttgtccgtctgtctgcggatgataagcagtactaaagttcaacttagaacccatctcttcctgaagtttcttccaaaaatttgaagtaaactgactgcctcaatcagacacaatcttcttagggacgccatgcaaacacacaatccttgccatatacaattccgccaagcgacttccagaataggttgtctttaccggaatgaaatgagccactttggtaagtctgtcgactatcacccaaatagagtcatggcccgatgacgttctgggcaaaccagtgataaaatccatacctatttcttcccatttccattcaggaatcttcaaaggttgcaacaaaccgggctgcagg

SEQ ID NO: 9248 - DNA, 1370 bp, Oryza sativa
atggcagagggttggtgccctgctgctaggggctcagtcctgcctgcctgtcccggaggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtttaatctattcgaatagccgcgccctcggttatgggcaagccgagcaatgtacccaagttagtgttttaattcttaaaacccgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtttagtgctaggatcgcgtttacaaaatagccttgagcaactaaatgtctttaaatgctgtttactgcaaccctaaccctttatattataattcccttgtactcccttgcatttattctgcatttgtgggtgtgtcttgttgagtacggtggatgtactcagtcttgctcaatttttcccaagtccagaagaggagttccttgaagatgaaggctttggtgtctagctcgtgcctgctgtcaagcgcctgtggtcgtcgccctagtcttccgctgtttttcgtttgtctttgtgtgctgggccttcgctgcccgtgtaataattctatttacgcttccgcttgttaaactctgaattgtatcagcttttggtgtaccttgcctcctgggacaaggattaatgcacgcacgtcaggaacgcccgttgggttatttccggtcgtgacaagttggtatcagagccacccttgaccctaggacgagccgtagatcccaagccttagctatattttcaaaaataaaaatctttggttatttgtgaaaattgtctagtctctctctgccttgctgcttcatttatcgccaaaatctgatcttttaaatgttgttttctttttgtttttgtttgtagatggccggcagcgtcacccgtcgtggtttgcacatgactggcttcgtcttggagctgcggggcatgtgcgtggtcttggggtatccacatggagtggattaccaggccaggccgctcccggagcaggagggtgaggatgcagagccccacgctggttgggaggtcactgcagtgatcctctctggctctcccgagcggacttcgctggcagtcaccgcgggtggagattccttccccgccgcttgccagaacgccgccctcctcgccatcggcaccctgcaccagcgct

SEQ ID NO: 9249 - DNA, 1159 bp, Oryza sativa
gtgcagtgcagtgatgaagagaaagtcatcttcgccgcccaccagctgcagggacccgcatctctatggtgggaccacttccaagctacgcagccagagggacagcctattacatgggctcgcttcaccgccgctttccggagaacccatgtgctcgccggagtcgtggccctcaagaaaagggaattccgagagttgaagcaaggcaaccgctccgtgatggagtatttgcatgagttcaacaacctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaagccaagcacaaggaactggagtcgcacaagcgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccagccgtgcagcctggtcaaggccacagggacgctcaaggtcagcagcgtctgtgcttcaactgctttgagcccgggcactttgcggataaatgcccgaagccaaggcgtcagcaaggccaagcgcctccccgctccaacaacggtggcaaggacgtcattcggggtcgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgtccctatagaaattcaggggattccttttccctcggatctgattctgctagacaccaagaagttggatgtgatccttgggatgaattggttggctcaattccaaggagtagtggtttgcgcgagacgca

SEQ ID NO: 9250 - DNA, 1072 bp, Oryza sativa
attggcattctcttttttttttttcctcctatttggttcatatatagtttcactcatagttccatactaattgcattgactactgtatattttccccctgcaggtcttgcgtggacagtgcggacgtggtttcttacatacatgaccgtttatcggtggtgagtcttttctttccctcagtttgtcttcttggcaggacaagatatcttagtggtgttaatcatgctatctgttctaggaaatgacttcaatcaagcaatgtaaatatcctgattttctcttttcttttaaaaaaaaactgtgtaagccctaaacctcacaaaaccatttgttagtttagcactgaatatgcatgcctggctgacaaactgccatctgctttgacttcgattctttcgctgttaaaactgctgttaccaataatgctgtgaccaattaatattgctatgcaggagggtgcagagctgcgtgtcatctgtgaggaggttgttgagttcggcttggcatcgggcgagaacactaccgtcatcctggttcagttcaagcccggcgccttccagtaccagctggtggatcccgctggatttggcactgccgtctctaacattgccagcaccagtgctgcgccggctggtgccagcgacacaagcgacgagggcgtcgatgacgctgccactgccaggcccaccgttatgggctacgacgcggactccagcaccggcagcgccgatgccacggtcgacagcgacgaggtcgatcccaacgccacggctgacagctacaatcccagggggcacgctgagatcgttgccagccacaccgacgacgaggtctacaccagcggcagtgccagggttgagagcggcgagctcgccgtccccactcccagcgccaacaacaccgtcgcggatgatgtcaaggtcgacgccgctgtcgtcgccggcggcagtaccaccgccatggctgctgacgaagccaccgtggtgtcgttgttgtcgaccatcgtggataactactactccattaacaccagcgaggagccagcgaggaggttgatcccactgccactgtc

SEQ ID NO: 9251 - DNA, 2520 bp, Oryza sativa
ccattttgaatctctatacatgctgggtatgaactacttctctgttcccgattcgggatcaacaaacaaaactgtcctgatagtcctagatagcagcaatagcttcaaaggttcagagcgaacgaaaataattttcaatagtgctggcacatgttttttcagaaacatcgagtggtctcaagtctcaactcttcaaatcgaacaactgctttcttggatccacatcaacaaaataggatgtctacggtctacctaccaagatcagcgctagtatctacttcctccgtttcacaatgtaagttattttaacatttctcacatttatactgatatgaatgaatctagatatatatatctatctagattcattaacatcaatataaatgcggaaaatgctagaatgacttatattgtgaaacggagggagtacttccttgtcaaatcttcgtgccggtgtggaggccgacaccagcagagggaggtgacaagtggtggcgcgggcgtagagcacgggagtataggggatgtgccaccgtcgatccgtcgtgccggaaggtggatggaaaaaggaaggaggcgcggccgtcgcgccggctcgaagtacgcgaaaaaggaggaggaggagggagcgtcgtgccatgcgggctgtaggcattttgtgcctgaaatcggcccatggtctgaagtaggccgtagcgggctgcttcttgggtcacggttactctttcagctcggcaacagcaatagactcactcactcacactcacggtcacaccgatttctccctaggcgaccataccggaaaacccgcgactccccaactccgacgagaacgacatggacgccggcggcgaggaggcgaagcaggagcgccacctggtgctggctcacgagctcttcctcctctcccgccccgacctcgacgacctcgccaatgtcgccctccgctccgatgccctcgacgccgtcaagtccgatggcatggcgccgctgttcgagtcgctggccaccgcgggcgtgctgctcaagccggacgacgcagctgctcgccgagatgcgcgcgcggatcgacgaggaggtccgcaagctcgacgagaagtgagtggattcttcctctcttcgattttatttctagccccacaaaaaagaggtcgcccgttgctgtgttgcgtatgcctgcagtagtactatgtggggataggttttgtgataaataactctggtgttgatatgatccgtttgcctaaactaacctagcttgctctcggtgcggaacatggatgctaaagctggtagacagtggcgaagctagagcaaaatggaggggggttcgagattttgccacaagtatatcaatatatataacttcaagctacattttcgatagaaccgttgattaataattttttacatcaacagtagagacacacatgcatcaataaaataaaaaaagtgacaaacattgtttttcaaaattaagaaatccactaataacattgataattgagaattggttactaacccatgagcaaaagatgatctgcatatgcaaacataagcaaacaccattctatttcattatctcaacatcctcgacgatgatttgataacctaaaacaagttaacatcaaaatcagttctcatttttcaaataaaaagtagaatccagcgcacttagatacaatcattaccttcaatcatcatcaaatatgcgtccttgcattttcatgaagcgacgaacaacggcctcattggtgactttcttcatttcttctttctccacataacaaataaggctatcacttaagtactcatcaccaattttattgcacaaatatgttttcacattcttcatagctgaaaagcacctctcaactgtggcagtagcgacgggcaatacaagtacaagttttaaaagttgataaaccaatggataacaaagatgttttcttgtctccaccattatttgagaaagctcggcaatagtttgtatgttggagaatctaccatcatccctcacatcagcgatgtagagaccaagttggtggctaaggtccctcaaatttccagaattaaaatcactaggatacaattttgctaaactcatcaaattctctagattgaaatcatgaaatgagtctcttggactaaaagccgatgagcaaataagcaattgagagcttgtctcactgaagcgattgtcaagctcttgaagtatccaatcaataacatcattaaacaatccacttgatagtaatgcttgtttgtaattctagatttgtgcctacgcttcttgggatcaatatatgtatcttccatttccaatttgacaatatatacttgtcacaaaagtcagagacttcatctagaactttctcccacttttctcttctaagctcatccaaattgagcctagttgactttacacatttcatagcattcactatgtcttgatccttccgttgcaatgctagtgacaagctgtttgtgattgttaatatagtcaacatgagggctgca

SEQ ID NO: 9252 - DNA, 3551 bp, Oryza sativa
agagttttatagtgggaactccatcgagtatccccaggtctctgaagacattgctcttgattcaacccggttctagtttgaagttgcccacaacccaatgccttactcatttctgtaacattaatatctctaatcaaatcccttctcttagatgatccacccaccacattcagtaagatggaaatcttagtaaaaaaatcactaacgcctttatgttttctcacaatagccacaagaacctattggagttggtgagcaaaacagtgaacataataagctgaactattttccctcatgatcaatgattgcaaaccattgaactcacctcacatattgctagcaccgtcatatccttgccctctaacttgctttagacttagcttcagttctgcaaatagagcatcaatagaagacttgagataggcagaagttgtttcagtcacatggacaagaccaacaaatctctctctcacaattccatatttatcaacatatctcaagaccactgccatttgttctttgcaagaaacatctcttgattcatcaactagcaagcaaaaaacatcatgcccaatttcttctagaatagcatgtagcacttcctttgcaaaacatttcacaatatccctctgtatttcaggagcaaccaaaagactgttatctgatttttttgtacctattgcctttcttaaggatgggttttgctccgctgtgtaatcacgaaattccctgaagttgcctctgttgtagggctcctttgactcatcgtgacctcggaaaggcaatcctagctttactagcatcctagcaacatcaatggacccattcaatcgagtaagatagtccctcttaccagtttctctcacactatgaaaagcaacatcaatgtgctgtctttttttgtaataaatcatcacacttcttcattgcttgatagtgtgaaccaccgacatcacctacatgcaatttcaacctttcttttctatgaaaaccattccaaccatttttaacaaatgcttcatatccaccatccttcttttctctaaacaagaaatagaaaaaacaatatgctcgatttttggactcactgtattcaagccaacttccaaactcatcaaaccattccgggacaaaccttcttgaacctgtcataggaaaagcaaatgtgcgaggttgacaagggccattctccaagtatttccttctcaccctctctctgagattaggatggtactcatcaatttgttttcttaatcctggatcatatttaatctcatcttcccagtttatatcatccaaacatgaattacatgcattgttagcactattcggctctggcactttccttttgtaaaatcgttccatcaattaacctatcattagatgatttaggaggatgtaaatatatactgattttatcattcattcaagtacagaagtagaatgaaaattgatatgacttacatccaaatagcaccttcaactcaaattctcaaatttccccccaatctgcaattttattccaattctgaaggattccaaattgaaccctactggcctcctaattctacaatgtaaaaaaaaacaaccaataaaaattttaggcctttgtatctaataaatcaaattgattaaaaaagaaatagatgaagcatgctttcttaccttgtctctactaacgcacaatgtggctgtgtgctgatcagttgatggagatggatgatgtcattgttggcttcatggcttgtgaaagtgtggtctgacgcttgctcctggttagcttgttgcctggcgaccgccttcctgccttcctggctcctgcggctggagcgagcaacgtaggcactaagcaagcaggggcgacggcgacagcgacagtgagctgccgagggcgacggccgacggcggcgcgtcacgatgccgagatgggcaagtgttgtctgggagactgggattggctgattgcagagcagtggcgtggaagccaaacagatgcgaggcggagtcgtcaagattggcagcgacgggacgcggcatacgagaagtcgagaagagaaaagattgatctggattcgactctcctcatgggcttacaacgttaactggactgttgtttggactgtgggtgcactatattgggccaaggggggtgcatatagggccgagatatgggggtaataactaaaaattttgtttgaggggggttcatctgcacccacgggcctctattgggcttcgcccccgctggtagatccgtagatagcttgcatttgatttggtagttgtaaatttacgaattatgcttagggtcaattcacctctatataaatctgtactacataatactaataaactttctccacagttttgttttagattcatgtacatattgatgattttgtacattatctctgcaatgtgtaatttagcatgtagaaaagtaattgagattgctaaggatcacaatgcacaacatcccaactgatacgaataatttgtgtgtcccttttatccagaaaaaataccagtgtaaactaatgtgaaggaagaatggcatgttgaacttcgttagtaatatggtatcgatttccttggtcgctactttgttgtcctaggtaaattgttatacatgctcggtgtctgtatgaagtgcatggcaatgcatccggaagcatcagctgtcgccccatgtcttcttgatatgatcagatctaggtatgccaagcctaaaaaacatttccctgttaaggaattttattggtaagttaccattttgacatcaaattttgttctatacagctgtttcacaacatcctgaagcatcagaaggtctgtgttgtttgcagctttttgcatattgatagtgctgcacccattgtatgtctcatcagctcttatagaaggaaatcgggacatttcaactggtttggaattgatacacatatgggctcttcatgttgcagaagctgatcctgatacagaatgaatatcagtatgtactttggtcactatggggggatatatctgttatgaatcaccgatttgcattttgttcgtcaaagtagagcaattatagtacaataggctcagcacataatactaatagggtcatttttgaaccaacaaagaagtacagttgttcagggtaaacgttatatcaaattcatttgcatcgtctttgattttaacctgaaagaagagtattttcactgtgagataattcactatctgaaaataaagagctaataactcccaccttatgctttagtttcctgtaacgtacttctttctatcattccatttggtcttctattatactcaaccagtgatccagctcttttcagtaatgtgtagagtaaaaccagactagttttttgttcaactcataattagaaaaccatttcagtacactggaaactcagtaacttctcacattgtcatctaactcttccattgtcatgtttgtctccttgcaggcatcatgacctgtttgcaactctgttccgagatcttcagacatcatgagcactgaatcagtggatcgcagcatg

SEQ ID NO: 9253 - DNA, 767 bp, Oryza sativa
  unsure (1)..(767): unsure at all n locations
aagagcactagtggcgaaagataaagggcaaatgttatatccaattccgtctgcatcgcctttgattttagcctgaaagaactaataatttcactgtgatatgattcacaatctgaaaatgaaagagctaatatcactcatcatatgctttaattttcagtaacctactccctcctctcattcctttaatctaatgttatactcattcagtgatccagctctttcagcaatctgtaaagaaaagagatcttcaaacgagtagattaacaaaagcgtaaagtgtctagagtttttggaggcgtcaccctaaggtggccgtttttcttttcttttggggggcgttagctgcggctagcaccctgctcgactgtctaaggtcgattctgtaaccttcgtgacaccctctttcttcttaatacaatttgggcgacctctttcggctgtcccggcaaatctgtaaagaaaaacaggacctctttttaccttataaagagaaaccaatccactaagctggaaacgcaataacttttaacactgccatctaactccattggcatgtttgtcttgtagatggctatgagctgcatgcggctccattctgagatggcccttcagacatcacgagcactggaatcggcggatcacagcaagaccagcagcagcagcagcagcagcaggtctctctaccttctnnnnnnnnnnnnnnnnnnnnnnnnnnnnnnnnnnnnnnnnnnnnnnnnnnnnnnnnnnnnnnnnnnnnnnnnnnn

SEQ ID NO: 9254 - DNA, 891 bp, Oryza sativa
catcgcccgtgtcttgtgtgtttccactttcgcgaacattccacagactaggagcttagaacctcacccagggcccccggccgaaccggcaaagggggacctgcgcggtctcccggtgaggagccccacgctccgtcatctgacgcgccatgtagggggttctgcgtgtgtttttctaagctctcatactctttcgtgtgcgccaagcttttcctgttcagcccaatggctaaacaagcaaaagcgcacaagctctctccgagtgttagcggtgacgacggggagccgaacccacgccgtcgagctcgtactccaccgccccctccacgccaaagtcctaggcgggaggaggcgctcgagagggtcgaaggatccgcgacttcgacatccacgggtgatggagaagggcgccgagatggggagcgtcgcctcctcgtctacggcgacggtagcacgccccagggcgcgctccaagctgcgggcgcgctcctacgtcacccgcccgtcgtccctgacccggagtctccagcccaacgttggctggacgacgtagccaacttggtcatgacggcacggcagcacctaggtgttggtgggcggtcctccgccactgtcacgtcccaaatcgactctaaaatacatcctcgaaattgtgcaaagaataattaaaattcatgtgaaagcctccaacaattaaaatgtgcaaagataaaagtcaaatgaggcttggaggatttttgtatatttcctaaaagcctaaaatgcgtaaataaattttagtggaattttcagagcacaaataataattgaaaagaaataaacaaagttgaaaaggtttataaaaagaaaaatccctaaaagtcttctttccccccccttttccttcttggg

SEQ ID NO: 9255 - DNA, 1287 bp, Oryza sativa
gaggagcccaagactactccaccatccgggatgctagctcggaggatgacgctaccatcgtgcacgtggcacgcatggtggaggagtacgacgcggctagtatcgacttccatcagatggtacgccgcgggatggtcgagaacaacatgaagatcctggagctgcgccaggagaacctgcagctcaagaaggacctcgacgcagtggaggcgcagctgcatcagctcaagatcgcccagggagagatctgccgccccaagcgtcgccgtgtctgccgcagccagaagatcaccgcccgcaagagcacctccaggcctgagcttgtccgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgttctttctcgtttgtcttttttggagtcgtgtggggcatggttatgccggtgtgtggtgtaactatgtcggagcctgtcttattttatttgcctaagcaacttgaacattaatgaaccaatttaatagcagtgataaatttaagaataatggtagtcgtgggtggatagttttaattgttagctccttctctgtttgctggttctgtgtggggttttcagatggtgacgaccaggagaaatgctgctaccggtgatggcaaccaacctgaaggcagcaaccacaaccaccagggcaacccacctccacctcctcctccgcctccgccaccaccaccagacaccaacgccattctcacccaaatcctcgcccagcaagccaacatgatgaccgctttcctccaccacctccaaaacccgccacaacagaatgctccaccaccacctccccaacactctaaactcgccgagttcctccgcatccgcccacctaccttctccagctccaacaaccccgtggatgctttggattggttgcatgccgtggggaaaaagttagacacggtgcagtgcagcgatgaggagaaagtcgtcttcgccgcccatcagctgcagggacccgcatctctctggtgggaccacttccaggctacgcagccagagggacagccgattacttgggctcgcttcaccgccgctttccggagaacccatgtgcccgctggagtcgtggctcttaagaaaagggaattccgagagttgaagcaaggcaaccgctccgtgatgga

SEQ ID NO: 9256 - DNA, 620 bp, Oryza sativa
acggcttcgacttccacgaagagcggatcttccgaagctgcagcgtctacacgaccaacggaaaagaaaaaggctttaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttgcgaatttcttcatttaattttcaattaaaaatcctatttattgcgtcagccgagggagcagggcgcgcggaccgggtccacgggaagtggggcccacgcgtcagccccacggtccacggtggaccgggcgcacgcggctggcggcggtcggcgccgtgggtcccgcgcgtcagccgcacccgcgggcgcgggcggctgacagtcgggcccacttggcagccgcgagggcgcgcccgagggcggactcgccggcgcggtcgacggaagcggcgcgcccgcgccccgatggtcaccgccggcgaccaccggcgcggcggatcggcgcccgagagagaggagggaagggggaaggcgaacggcggtcctcggctcaccccgggacaacgac

SEQ ID NO: 9257 - DNA, 499 bp, Oryza sativa
tcctgcagccctgaggtgagaagtttactcctgaaatatttgctacatgtagaatttttattatatatgctttatctgaaatatatttcatttcagggtgcagatggcattttagtacctggtggctttggagaaagaggtgttgaggggaaaatattggctgccaagcacgcacgcgaaaacgatgtccctttcctgggcatatgccttggcatgcagctcgccgtggtagaattcgcatgccatgttttgaaactgcctgatgcgaacagcacagagtttgatgccaaaacggagaacccatgtgtaattataatgccagaggtaattaactgtcaaaccctcagtctatatatatagatatgattgtaacatttatatccactcgtgaatataaatatcagatttctatttattgcgtaaaaacgtgtatttgcctttagtcttttttttagaaaaatgtgttgcatttaggtgtatgtactggttagctataaac

SEQ ID NO: 9258 - DNA, 442 bp, Oryza sativa
cccgcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaactgttcgaatagccatgcccacggtcatgggcggatgtgaggtgattcctagcgtagttttgtttgactactgctttgtaaaatttgctgatgtggtttgggttcgatgtttggaaaatctgcggctgatgggatcagccaggcccgggtggccgtttgaaagctgttggccgaatgccaaccttgatcaattcaaaagactgataccttgcacatactccgaccggacgagacgcactg

SEQ ID NO: 9259 - DNA, 1228 bp, Oryza sativa
actctgtattgtatcaacttttggtgtaccttgcctcatgggacaaggaataatacacgcacgtcgggaacgcctgttgggtgatttccggtcgtgacagcttgcttgttttaagtttgtttgtgtgtgtgggtctcgcatgtgatttacatcagtggtgggatgtaagtgcatgcgtttgtttgcttttgagtgttaggaagtgggtgagtttagtggtgtgagagtcttcagtttgtaataatgaaactcagttaagatcaataaaagttaaagtaattctctgtcctaagtagtttcccccgttttctcttcttatcctgtccataccagatggtgaacactcgtagcaatgggaatggtcccaacaaccccaataataacaacaatggagagaatcccactctggcccaagttcttgctcaacagacacagcttatgaacatgatgatgcagcaatttcagaatcagcaaaaccaagggaataatcatgcacctccacagaacaagttagcagaatttcttcgtgtgaggccgcctgttttctctagtaccactaatcctgttgaagctagtgattggatacatgccatagagaagaagttggatttacttcagtgtactgatcaggagaaggtctcatttgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttacccagggatctcgctctgttacggagtatctgcacgagttcaatcgtcttgctcgttatgctccggaagatgtgcgcaatgatgaagagcgccaggagaagtttttgggaggacttaatgatgagctttcttacccacttatggttggagattaccctgatttccagaaattagtggataaggctattcgtcaggaggacaagtacaatcgcatggagcagaagaaacgtcggattgctcaattcaagacacaacagggaaataatcaaaaccgcgtcttaccttaggaccccagtccatgccacagggaggttatttgtctgttgttcgtccgcaacgtcagttcttcaacaccaatgctggcaacaacatccgtaatcaagctccacgtcctggtgcagctccagctcagcaaca

SEQ ID NO: 9260 - DNA, 796 bp, Oryza sativa
agaatatatttggaacctggaacaactccgatccataagagactttatcgaatggcagccaatgagttggcagaagttaagaggcaagtagatgatttgctacagaaaggatacatcagaccgagttcatcaccatgggagctccggttatttttgtggaaaagaaagaccatactcagagaatgtgtgtggactatcgtgcactaaacgatgtgactatcaagaataagtatccactacccaggattgatgatttgtttgatcagcttaaaggtgccactgttttctccaagatagatcttcgatcagggtattatcagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggcctcgcaggatattaccggaggtttatagagaatttttccaagattgctaagcccatgacacg

SEQ ID NO: 9261 - DNA, 727 bp, Oryza sativa
aaagttttacatgaaagagaacttaagactggagatgaaaagttttacatgaagcctgatttgctaatattatttgcaggaaattgttgatgatatacactagataccgtgcagcacgtggagcaagatcttcccgtgtagattggaactctctctctgatcttccagcttcaccagcagcatgttgtagaaggatgtcagacttacgagcaaaaatgtacataagattagcagtgagccaaatctgcaaccttcttgggatacgttatgctaagcaccttgaaagggaaaggatatcaaaagcgaaaggattactttcccaagtctcagattctaacaaagagaactgtgtagattcagattctgagcaattaaattgggataattttgaagatcaggaaataagaggtgcgctcgatgaagtccttgagttcattcaactagaaaaaatggaccgaaccaagcaaatcagttctaagaatgaagtgagcaatgattctaatgctgacgaagctccaactgggcaggaacagacagtaagtaattatctctttatcctcaaccaacatatattttattcaatactgatttttccttggaatgatcagattatgcaatatgtaaccagctcaagcactgaagttccagaaagcggactccatgaacatgtaaaaccgtatagacatccaactgcaatccatgcacgtaaaaacatggaaaatttctt

SEQ ID NO: 9262 - DNA, 701 bp, Oryza sativa
tgaaggaaaaagtacttctgaggtttatttttttcagttagtggatgttttaggtaaggtgaatgatagtcttcagataccctgtatgtctttgttacttcattcctatgaacgacaaacagggtgccatgtatgtttactaactttcagcatgggcttatattatgggtgtctattcagcgtataattggcatgcagcgattgatcaaataatcttcaacgtgtcttttcttttcttttctttcatcctttaattctctgtgctttcttcaaggcaatgtttgttgacaaatttttgcgttggaaaacattccctctatgttgtctgagatggattcttcactatgctgtctttgaattgccaccaaattcaggcatagaaacacagaagcaaaggacatcgagcttccttggtacactgcaaactttagtcagtgtttggtccaagaaagagtttgtccaggcatactcagtggagcaacaagcttgtatcctttgaggcactcaaaactgtattacattacacactttttatttgcaaattatcatttgacttgttccccttaaacaacactcagacatcactgcagcaattgggttgtgtttggagaagatgtcaaaaagagaattagaaacaactaaagatgtattgaacaatattcttgaaggtgtaagctgtgagtatcccccccccacccccc

SEQ ID NO: 9263 - DNA, 5354 bp, Oryza sativa
  unsure (1)..(5354): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttctaggcgcagctcctgctcatcgttagcatgcattatggcatcatgattgattcactctttctcatagaaaaaaaagatggacatcagcactaaatcactttgattgaatcgaagcaaacagatcctcaaaagataatccaaaaccagaaacaaaaatgcctatactgattattagaaatcttatacgaaacctgatcgagtaccaggacctagtatcaaatggatgttggctagtgataaagcatacttgttaataatttacagaaacaaccgaaaatttcctcgcattcatttaatttgatcaaacaaataaatcaaacattgatcttatagcaaagtgaaaggaataagattattctctctaaaagactgtctcccaatgcagcctgtcaaaaacaatgaaaaaacaaaacagataagaactgaccatgctaagttctacccaaaaaacaaaaaacttgatcaaaatattcatccacctaaatagcataagtgcattatgcaacttctaagcaatcaattttctcaaatacaagaaacatgagtgctattttagaacattaattactaacgaaaataattgcacctattccattcgaagccaaatagcattgcatctagagtacggactttaactttttaagaaaactgatcgatttaccaatataattctgcatcaaaagggcaaataaatacacatagcaacgagtgttttactgaaataaaagaaccatagcacgccttgtgtaaaactttgaagtctttttaaagttgtgttgcaacataaagagtgatcagtgaaacaagacttgttggtgatcgcatctaggttctgaacatttctgtgctctctgaattagtttgaacagttatgaacttgtccatttatctgatgcttgaacggttccaaaatccatcacgatctttgcttgtctagagtgttacctgggacttagcaatatttccaaaatcctgtgcgcttgtcgtccaaactgaagtacctggtgttgcccgggttggcgaagcccttgccgttcttccgggtggtgttgttgaggtagctgtggatgcaactgacacaacattcatcaatggtttaccagttgtgcaacctacagttaaagaagtagcagggatcgatcttcaatgttcaaaaacatttaccaagttcaaaaatcttgtgtctaataagttttggaaagctgcttgattttatattttacaccccaaagttcgggaaccacattgaccacatctttattacatggtgtctcagaagcactgatccattctctgtgctatttatctagctaagagaataattcaagttatgttacaaatgcatgacagtaacaaaaaacaatgaaattggcaagcatgatcataaccaatgagtttttagctgtagcttatgttcaataaatttggcaagcatgattataaccaatgagttcaacggaaaaaagataacttcaaaaaagcaaagtgctaatgtctagcgctgcctccaccagaggcccgactggagaatactttttccttttttagataaacatggagaggatatatataggcagggatgaactgtacaatatggttgaaacaaacaaatgaaacgtcaaaagtgaatactaagttcctgcatgggcaatcagaaaaaagaaattaaaatgctggtactagtcagaaaatgcttgcctaatatcaaatccaagtagtgggttcagttacttctcgatatctcaaagcaaataacaaattaagcattctgttgttataactttttcacgtgcacactccataccaggttcccataacaaactttgcaccaaattttttggagctcgtaatctgacaaatgagaaaagaacgaattgtgaaggaagtattaccaggacatgcttcaatatatatatggaattgaaagttgggaaagaacgaattgttgcggtcctccagtcaataccaaatgtttgtattccagtatgtacaatctgtcatctacatgttcttgtttcagatttgtttctttcctacaaaaagaaccagctagccataccagaaggttttaaaaagacatgggagacatttcccatcaatcaaatttgcatgtcttatctgaatgaaattaacgtttgcagtatgctacactaacaaaacattgctacggtcagcttcagctaaaattactggcagttattcttcagcacccatgtttcagattttgcgcctctttgcgacaatgctatttccttcagcatatttacaaagaaaaggacagtcatttttacaaataaaaattgaggaaaatcatttgactcaaggatcagaattattgcttacatgaatccctgagcatcataaaatacttttcaaaatgtaggattcttcatctacctgatcaaaactatgctgctatggtctatttttccctgtccatgccaggacgaatttggttcagtctcaacggttgtctgcaactctgcacatacctgatcttgttgctagttatttgcaactttggtaatcacatcttcagacaattggctgaaaatattggatgttccagccaaatctttaccgtcatagtcttgcagcgtaaattaattcagatataagtgcaaattttacagagaaatttactattaaaaacaaaactacatacaagccaaaattcagtgaacaaatgacaaagcattactaatactatgctaaccatagtatctgcagagtaagatcaaaattattcatctgccaagtcatctctgaccggcatccagtcgaaacttggaaatgcagtcggttagaagttttgcgtcttaaggcgaaattgctagcagtaagggcatatcaacacagcaagtatctcctctcatctcctaccctatcttaatgttttaagactttatttaagcttctcttggcttaagacaaggaattgaaaaacgattcaacagaaaaaaaaaagttcatccaaattcaccttatttaagcttctcttggcttaagacaaggaattaaaaaacgattcaacagaaataaaaatttcatccaaattttaaaaaagctaagcgctagtgtctagcgctgccttccaccagaggcccgactgcatgcatatgccgtatttgacaacttaccgttgccgtattgacatcttaacgtggatgcagctaaccggcagggggtcgcctgccgtgccccataacgggaggggatcttttcactgctcctttatctttttttttttacagccattaaccggaaggggatacacacccagccgatgcccacatttgggatcttttcgctgtattcggtcggggtgggtgcctctggggaggcgatggagtagaatcgaaccgcgttgataaacaggtcgctcgctctcaaaattggcgatgtgggacaaaactcgatagctggacgcgattcagtccgagagcctacagacgccgcgcagaccctacctagggagtagaggcggggcatacctggtggtcttcgctgaagccggcggcgagcgcgccgtcgacctggccggagctgaagcttcccaccgcccggccgccgccgccgatgccacggagactacgccagcgggatccagatcctcctggagcagcgcgggcgcatccgcagccggctgctcgccgctggaagtcgggaagcgccgaagcggcgccgtcggaggagagcgagcgagaaggggaggggaagcggtgccatgagggaacgtcttcgctcgagcccaacccgcccaaggcccagttcacgccgaaccgcctgggtcgtttcttttttttttctttttttcccttttccccataggagtataggaccacctggaccggaccggtgggggctctggttccggttttttccggtccgatcgccggttcggtccggtccggtcttaataactgtgcataggactgttgtttttgctcaaattggtgggttctttgctttcgctgttataaaggggtgtgtttagctcacgctaaatttaaaagtttgatcgaaattagaacgatgtgacagaaaaattgaaaatttgtatgtagaaaagttttaatgtgatagaaaagttaaaagttgaagctcggccaagctgcagccagaattaagaggagagtaagcggaccgtaatgaagtgtagtagtgacgtataataggaattctaaaaattataaaaaagacaacctgacgagaccaattcttaaacagaaaatctacataacagcattacgtgggaacaggataacttaaaagttaatataaggcaaacgttttttcgatcaccgatcagatacacccatgatttctgactacgtggtggggctagcgtttcacctttcctgcacaaggatttctaactcacactgacacatgtggtcatgtgatccgtttgagcatatgaatctgttggcttgatcacatcccatctataccatagaccatccatgtgacttttttttcgttttaccttttctcttgctttgttttttaattttcttttttttccagttggaacgcttttaaggtttgactagaaagtacccgcggcaaagtcgcgcaacagtagatgggccagctcaaattgagcgtattgaatgtatgcgtataccttaacatcttagctgggatgctagcagtgatgctatctcattcaacacttagaaacacaacaacatgttgtcagcaaatttatatatgcatagatactcgaataattaagctgctcttatagtctacgggaactgaacggaagacattgtggatcacatggcatccctatttgttgaaatgttcttttttctagaggaatttgcaaatatatcttaagacttctattagtcaagtctatcatatagagtgtctattacatgggcatagatagttcaggagattaaatgatcagagcttttgataatgccccatttcatttttctaggcaatataaactggctaagagcacccgcaatggtaaagtaaggtgctatctacaaaacatgtacatctcagcaatagactagattaa

SEQ ID NO: 9264 - DNA, 31715 bp, Oryza sativa
actaaagaagggcaaaaccgtcttttatcccgctagttaacatcgtcaagtgtaaaaactaacagaagtgctacatagggaagggaaattttagaagtgcctggatagggaactttttaagtttaggtgctatagagggaagagcaactttttttgatgctagatagggaattttctctaataaatttgagatgatggaacatatacaacacatcaaacttctgtagttttttatcaagttgattcaaacttctctacctaagtttattttagatgagctaagaatagtaatatgaaaaggaattgaactttgatatgtgtcgaggaaaaggaaaatctatgaattttgcctgtgatcttctgtgtagtactaagcggctgaagcataccataccagtctttcataatttaatattaatataaatatataatttaaaaagggagaatcaacatttagctattggcagtcaaaattatagaatcttgaaatttgtgaattgcattatacaaggtccatgcttcagagatggtactttgtaaaaagaatccttaaattatgaggcatagcctggtaacactttgaactgtgcactgcaacttccatctatgcaaacacacaaatcttaccgctgtattttttccaagctataaaataatattagcttgttcattaatttatagcaggtgcaggcagcttttaaggttagttatgttgatatataggtaactataaatcgagttatgttgttgtacatgatgaaatcccaaattctaaagagagtcgtatttgaagtttattgatgttagagccttaagagtcattttttattggaaacaatccagcaacttaaaatactacctccgactttttctcacatgtttgaccattcgtcttattcaaaaattttatacaaatgtatatgatataaatcacacttaaaatactatgaatgataaaacaactcataacaaaataaattataattacgtaaattttttaaacaagacgaatggtcaaacatgtgagaaaaagtcaacggcgtcatctattaaaaaacggagggagtatcctacatggcgcaaaagtacacaccttttatggattagtattacagattataacttatatacgtataggaaaattagcattacttgaaacatataatttacatatacttttaatctttattgtcttagaggcatatgcccaggtggcaacaacagcagagggcaataatagaatatgcaattcctatgacatgtagcatataatgcagaaaacatttttgaagataaaatcatacgatggcacgtgaggaggaggcaacagcagcatatatagggaaatgacaggaagtgcaattcatatgacatgtagcatataatgcagaatttatttttttagataaaatcataggatggcacgtgaggaggctagactcctcctcctcatcgtcgctgcggccgctagcgaagaccaacgcacagcaataagcttcttcaggccatgaccggtcggcgtctggccgtcggcggcggcgccagacatggcatgcatgcgtgcaagttagggactacatgaaatcgatttgcaggctctattcatatgtaacatctgcatgaaacccaactgaaattaaactaccaaacattttatcattagacgcaaacggaattgatcgccctatcgcataaatccgatcaacccaattccagggcatccacccaaactgctgattaatctaccgactgatatgagatcatacaaatcaaaagaaatcaggagattgccaagtactcctatttagcttacctcgaaattgatgtcgtggaggtggggatggaagtggatgcggatggtggatcgacttgatcagcgacggcagtggatgcatggggatggcggcgtcgatgggagtggaggtagtgacggcgatggacggtgatggcggcgatttttggaagagaatagcgagagcgatgtttgcgctattgtgggagagagatatcggaagaggaagagacggcgattttttcggagaagagatggggagcggaagaggcgcgagctttccagagagaaggcggccggcgtattttttttttcacatttactcacgcgtgggaatagattagatatacttacgcaggggagtatccccgaataatgctgcgccacgtggcgtttgtctctggccgggaacgtgcatggaattcgtatatagagatacggaccaagaaaattacattagcataataatccgtgtgtaacacatattatatttttttcctttttaacccgatacctacacctatcaaattcgatacgtgagtatcacccccgatacttgagtatcagagccaatacctatagataggggtgggaaaaaaaaaccgaaccgaactaaccgaaaccgaaaaattcggtcatcagttgtaactaaccgaattttatacggttttttcggtcatatccttcagttaaccgaactaaccgaatcaatatgaaggcccaatacagcccaatagcccattagcgagaaaaccctaatcccccgtccccacctctccttcccactcctcccgtcctccccaggcccccacctgcgccgcgctcgcgcctgcttctctccgctttctccgctttctcctcacatcgcacatctccgctttcttctcctcgcgccgtgccacagccgctaccttctcctcgcggcgtgtcgccgccttctcctcctcgcgctgtgccaccgccttttcctgctgaatcgccgccgatctgcacatcctcgactccgacgaaccctcaactcatggtggcgccgcctcctctccgacaggtgctgtggaggtcactcatagctcctagatccagcgccgcatcccgtcgtcaaggtcctcatgccaccggcgaagcccacctccacgtgttgctcgcgccccttcaactcctcttcggttagcatgcacttttgtggggtttttttttcgatctaaaattgtggatggtctgtgttttattcatctcaagaatctcggtcgagaccgagaccgaaaaaaccgagaccgaattgtccggtcttcaattttatcgaggaccgatcggtcttgactttctgatgaccgaaatttcatccaggaccgaagaccgagaccgaattgctcggtcagaccgaatgcccacccctacctatagatatcagatccgatacatgagtattaaatccgatacatatagatatcagatccaggacctgagtatttgtcacaccccaatccggcaccgccgcacaacggcacctgacaggagcgtgtcgtagaaaaaacggcgcgaaccgcttccttacgaaaccgcgatctcggtaccagtcccaggacatagtgctggtacccacggtgacaaatatgaatcatagcaatccttaaaataaatagaggacttatttaccttaacttaggttgcagctcagacagcccgagaatgcaaccgacgacacggacgaggcgaacaccaacaacagcagcagcagcggaaccaacggactaacacccaacaccacaggcgacggctgggaaccaggacgaaaccctaatcttcacttcactttatcttctcttcagggcggaggaactatatatatatatttatatagagcaagagtgagtactttcgtactcagcaagtcacgggaacttaggtgtttgatgcaagcttggaggagaggcaaggttgttttacaaatcttttatttgaagatattttgaaatcactaagtgatttatttctttctatgtttgggcgaaaagagacttgcgtctcgattcgactttatgagatgcttttcaacagctcatttagtaacgtaccgacctcccgggtcagatcattacttctcggctcccagagcttttttcattttctcggactcccagagtccagctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagtttgttaacctctgcagaggggtacactttacccacaagacacgaacttactccagacactggccggtgtcagaggttcgcgacaaagcctttctcaagccgacccagggatacctcatgccacatagaaggatcaaatcctcacataaacataggccattttaggcgtgcacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaatggtgtatgtgggatatttggtatacgcgctcagagagcacgaataccgaggtaccacaagggtggagcgacaaggaatcagggtaatacgacctacggaaattagtgcgactactgggtaggtccgtcggtttggcacgcaaaccgaggccaagcaagttaagtgtgtgattctaataatgcaagttacaaacaaaataataatgattttccaattataggagcaattggtcaaagggtgacttgccttgctcaaagtcttcacgaagcttcacgaatcttcaagaaaacccgcgatcgacgaaaatccggtaaccgcaactatacgcaaacaactgaaaacctaagcaaaagaccaaaagagggatcctatttagactaattagtagtgccattaaatagatctcaattttacggaattactggaagtggaacggaggcaatcggacgaacggatagagggatatgaattttggaagtttaaaggaatttttctggacaaggagacgatttgtcggaattttctggaatacgagagatagtttatggaatttatagaaataatattctcaagaatattattgacatccactgacatacgggctcgaggggacgaattattggaatctccggattaagaggatgggtttatggaatttggaatataggaaatgatttattgaatttctagaaaagagaaatatgtgtggagtattgaaaaagatattcccaagaatatctttgactcattgacacgtggggccaataagaaggtgagagagagaggagcaattggagggagtaattgtggacttttagctcttgggtgatggacactgggcttggacaaagggagtgtatgtggactttgtttgtcttacttatcaggctgaggaggagggtggctactgggccaagcccaagagcaagagagagggggcggctgctgactgggcgtcggctgacttggtcaagtggggccgacggctgaggtggcgccaacgtggacgtcacgtcggatggggaagggagaggaggccgggcggctcatcggacggctcacggcgtgcggcgggatccggcgaacggcggcaagccggaggggcggctagcactggcggcaggaggaggagaaggggaactcattccacggctcggatcaggaagacgacgcgcgacgacggccggcggcggcggccaatctcgccgacacgccaacgtggccgcacgcgagaagagcgaagggcacgcgggctcgggcttcaccgaaccggtatggggttgcgacgcgcacgcggtgacgcgggacctgatggtcaccggcgacgcacgcgcggtggcgttatgcggcggcggaaggggcgacacggcgcggaggcaaaggagaaggccggtggcctagggacagtcagggggagctcaaggggatctccgggagcgtggcggcgagaggaatcggctcgagaggtgccgacggcggtcgattgcggcggcggcaatcaccggcgagcaaaaggggaaaacacaacgagacgacgaggattcgattcaaaggggtgggagcatctccggggttcaaggaatccgtttctggtgtcggatggggcggagaagcactgaggagggccggcgacgagcagcggcctccgggagcggacggtaatggcggtgaggccatgccgggcgacggcggtgctagggaatggtttggggaggtcctagggagctcaaggacggtgttggcgagggtggtcgacgagctggggcccgacgacggcgcgcgactgcgcgcggcggcggaaacagagcaacggcgaggcgcgcggcgcatcgtgcggcaggctatggcgtgcggcggcgggcgcggcatagcgagcggtaggaggaaagggttcggcggggagctcaccgacaagaggaagcggcgtcggcggatcggagggagtcgtggtgaggtggtcgcgatggtgggacggaacggcaccgggtgggcgcggccggggaggaagagaggagaggtggcgcccggagctcctcgtcacgcgcccacgcacgcaccggttcctccggtgctcggcggcggacggcgacgacgagatcgagtcgagcggcaacagggcggcgacggttgttcggctacaatggcgcggtggggggcgaaaacgagagagatggaggggaggggctcggctgtggttttataggcgcgggatgtggagcttcgaggggaaggaaccgagcacgggcgatcaaggagaggcggtggcggactcgcggtcaagttgtgacagaggcggtcacgggtggcaaaggaggtgacggtgtggatgcgttgggcggcgaaggcggtggatcgagcggcggaaaatcgaaccgcgggagcgggaggattagcacgggctggcgcggtcaagttgggggtggcgagctggcgctggcgtctgcgtctctgcctccgagcgcttgcggccaaggagtggaggcatggcgtcgttgcttgggagggaaaaagagagggaggacggtggaaagggggggctttaccatgccggtttgggaaaaaggaggtgggagagggagaggagagcgcgtgaggcagagagacgtgctgcctccacgtcttggacgcacgcgcgcacagggtgggggcgagcggcagggcggcatgggcggccgtgcggcgcaggcggccagggctgatgcggcggcgaccgggcggtctgccacgcgcgggcgagcgcgggaaagagcgaaggcggtggcgggttttgggcggcgacggcgggaatcggcgccgggaggggagagagcagagagagagagcgaagacgggagagagaaagaacgagagagcgagagagctctctctcggctcacatgcgtgcaacgcacgtgcgaggggggttaagatgatgggctgggaggggagatgggccgggggagaaaacggcccacaaaaaatccgagggaggcaaaatagactttttcggaggggattgattcgaagagaatttgaacttggaatttgacttagattttggaattgggatctcgatgagaggaaggagtagacggaggattcaagatggggttttggatattttggatctggggaagtatttggcgatgattcaaagagagggatagaatttcagagtttgatttggagacttgagtcggaagaggaatttcgagggggcaaatttgtgatggtgacgagagggatcaaggacggatttgaattgagatcttggcacaacttagactcgcacacaaagaacgaaaattttcgcaattaggatttttgccgaattagtttttaacgcctcacgaaaagcggagcgttacagattggtgtaacatcccggcctagggattaataggattaatagaatactcatatcaacaagttgcaacttcttttccggaagccaatctccaaagaactccagggttaagcgtgcttggcctggagcaatttgggatgggtgaccgaccgggaaattctttccgggtgcacacgagtgaggacaaagtgtgcttccgggtgcacacgagtgaggacaaagtgtgcagaaaagacatgtgttggtctgtgagggcagtctatgacctatgaaagctatcagatgtaagcgggcccggcctaggggaggcgggacgttacagtattaaacccgatacctatagatatcagatccggtacctgagtatcaaacccgatacctatagatatatgactcatatgtaccatacctagtatttgggtatcatgtatgatacaatctaatacctgagtattacgtatgatacatacatgtatcttgtatggtatctggtacttgcgaggcatatataaatcaggcattgtgggagcccaacgtgtactagtcaatctcaataccagatataatagtgtatcatcaaatattatcaagacaaaaaaatctttttatttttcacaaaccttgctccgtgactcgggaggcatattgctctgccaagacatccggccatgcctacccaagctcaattaatactccctccgggttgataatacttgtcgttttggacaagggtgaggtcaaactttagaatctttgattatgaatcattttcaaaatatttgtctttcaaatatagtgactacatgtatagattagtcttaaaaagtactttaataagatcatatatttgttaatacttttttacatattatgatagaaaataatggtcaaagttgtttttttaagaccttgcctttatccaaaacgataagtattatcaacccggagggagtatatcacaactcagagtgctcaactcagcagctctcctgagacctggtcattgagactaaattaatatgcaggtagaatggtccaagctggtgcacttgcactagtggaaacacggaatagctcacttttggtgtggagcggcatgtgcgacttgggttcggaaatggtagttgggagcgatggagcgctagatcgatgcaggggaggtgatgtcagtacttatcctgttgaaacagaatcccgttgtctagccgtttttatttttaaagggttaattggattcataccattacaaatttatctattaaaaaaaataccattacaattcatttatctaaggtgaaggcgtcaaagtcctcctcccgcttcttcttcgcctcctcgggctcgtcgcggcagcgttgctgcgttggcgtgcagggtggcggcgtcgggggcggcgttctcgtcgtcgacggagacagggatggagcccgtcgtgtcttcggcagtggccgcggcgagctgggtcctgcgccttgctggaggtgaaggcatcgaagtcctcatgccgcctcttcttcgcctccttgggctcgttgcgcgcgtcgcgacggcgttggcgttctgggaggcgtcctcgtcgtcgatagagactggccgtgcgtcttcggtggtggccgcggcgagggagtcgtcgtcgccggcgagagctcgtgcctggtcaatcctccgcgcatgcctccacgtcctccggtgggaggggccaccaacgtcgaagagaggaggaggcacacctgaccggatcaccggagtagcttcagctcggcggcgttgcgggtaaggattggtgagtggaagaggtcagtgcagccagggaggaggtagtcgtcgggcaggccgagtggatccaccaactccgccatcgacactcccagtcccagtcccagtagcgccaccaacgatgtcgtcgcccactccgccgccggcgtagtgccaccaacgacgtcgtcgtccactccgtcactgccggcgactgccccgccatcgccagagaaggtgagcaacgacgaggacgtaggtggaggaacgacgtgcgacctgtacgacggggagtgggtgcgcgacggcgacgaggaggcgcggccgctgcacgcgccgggtcgtgcccctaggccgacgacgaggcgaacgcctgcgcgtcgaacggccggccggacgcgccgcctacacacggtggcgttgggcgccgcgccggtgccgcctccctaggtagtactagcaagcacccggccaccgcttggctccgtgccctcctcatcctccagccacccatgggccatggttgatccaatctcgctaggtttgtatgttcaacgtgacggatttcctggcgaggctgtgcgcggccatcggctgatgctcattggcgactccatgaaccggaaccagttcgagtccctgctcaccgccgccgtcgccgccacaactagcccgctgcccatggctgcttgttcagcagaacaaacaagtttcgttcctctattacttcagcttgcgaatgcaacttgttttctcagaaaccatctcctcattttgagaaaacatctgctcctactcagagaagaagatgggagaaagaaggaagaagacggaaaagtaagaaatagatggaaaacgtgacagtagtggcatggttctatttttgtaaaattctaatgacacgactacgaatagataaatcgtaatgttattttttattacacaaatttgcaatggcatgaatccaattaaccctttttaaaagttgcaaggagaataaataggagccgcggcacaccaggtaagcaaataaaggataggcaaagcagccaggggtgacggcagatgcgtataaaattgaaaacccgattatgataagattcatttttaaaatcttaagcaacgagatgactatttagcaaaattttaagaaaattattttttaataaaaagttagttaattttaaataggtgctagctagccgtataattacgcagggcacatctagtcagttatgctaatgaaactaggttttgtgccaatatatataatgtagcccatgtgtaataccggcttcaagtggaatgacggtggtaaacccagcatgcatgctttgacctggaagatgtaaagtttcgttcatccatataggaagtgctataatctcaacaactatgtttcttttttttttttgagaaacaacaactatgtttcttgaaagtgttttaccttatgtcaaccttaataaattcgatcggggcacttcttcaccaccgatccggtgaaaaaaataatgctacctccgtttctccgttttttaatatatagcaccattaactttttaacattcttttttattaatttattttgcaaatataaaaaaaataattcatacttaaagaacatttaataataaattaagtcacaataaaatatatgataattacataaaatttttaaacaagataaatgatcaaactatctcaaaaagttaaaagttaatgatgtcgtatattaaaaaggaaagagtaacaaccgttttggaagacttgtcgtttgattacactgcaacctcgtgcaacaaaatatatctagaatgcaatgtacaatcgatacacaggcgagagagaatttaaattcagaacttgaatttgcccgtggagacggccctggccctgtcgctgagctccttctcgatgtggcgccacagcttgtcgatcatgtccgtgcgggtctcctcgtccagggtggtgtcgaagtagacctccccgatcgcatccatctccttgaaccgatcgtcgtacccgctcgcgatgatgtacttgtccgtgaactcgcgccacagctcgttgtgctccaacgactcctcctcctctgctttcttgatcgcatcttcctcatcatcatcatcatcatctgaatcgtcggcgtactccggtcggtgatgacagccacaggtggtagaggaatcacggtggtcggaggaggagtcgccgccgccgccgccgccggcgggatgaagattcgtctcgggatcatagcgggaggccgatccgaggacgatgaagtaaggatcgatgcacttctcagcgaacctgcggcacttctcttcttcatcctcatcatcatcttcttcttcctctgcgtcgcccaacttgacgtccgatcggtggctactactacgacctctctcgccggcactggcgccggaggagtcgccgtcgccgtcgccggcggcggcgggatcaaggttctcctcgagatcacggcgggagggttcgaggacgaagtgggtctggacgatgtcccagaggtcgaacttgaggtcgatgatggcgcatgacaggtagaacctcatcctccgttgtgcctctggggacagcgactgtgacggccactgtttctcgccgccgtcgtcaccggcgaccttgagagcatcggcggctacatctccctcggcggccattgctggatcgggtttcttggctcctcgagttaagcgaagaatcaaatcaaaactaatacgtactaaatcgtacgtgcaactgctgtgtacgtggtgcctggaatagttggcttggtagcaaataaatagggaggaacaacaactccgaaccggattagcaacgcaaaatgcagcttaatttccgagtaattaattgtttctggatttatcaaagccttcgatacgtacagtatccgagtcggagaagctagcatcgccatcattgagaaaacaaataaataaaaataataattagagatattgcatcgatcgatacgaatccgatactagcttagatagacggcccactaacccctcatacaacggattgacggcccacaagatagatagccatccgtattgagtgagatgagagatcagaagatcaccgccttcttcgccgcacgccggagctcagtcggagaagccgccttcctcatcaattcctcgccggatgtcttctctgcaccgcttgctcgatgctgatccctcttgcacctgaattggtcggagctatgcgcgtggagggaattttcttggtcgtcgtggacggtttgcgggagactctaaggccctacttggggaagcttgttccagctgcagcttttctcaaaagctgcttctgctagaagctgccccaaacagtccacagcttctgagaatctatagttacagattctaaaaaatgaactaaaaagtcagaagctggagaagctgggttttaaagcttttccagattctcagaagctggctaccaaacagctgcttctcagaatctaaagccctccaaacaggccctaaggccattcccaacccaatgactaggatgttgtccatagcattaaataagctgtcacctaaaatgaaaaataatgtgacaagtgaataaataaggaaagagaaggaaaccatgtcttgcatgagacatggtttctacgcaacattcaagacatcatgtgagataagtagcattaaattcaagtatagaataatgatgtttgcattggaagagtagtgtagtacagtttttgatgatgtggagtttatggaaactatgtatagtgtcttgggttggaaatggcctaagggcaagtttcatgggggagctgggtgccacgtctaatttaaaccatgtcatcttcttattaattaagaggtaacaaatacaacatgtcacctctagtacacaaaccccaatattagtttactctcacattatcttacatttttcttggagattgtgtagaggttgccccttgcatgagggctggtttattctctcttctaacttctctcttccaactcatcacctaatcctatttggcaaatttagaggcaacatgtagaggcttatagtacttgccctaacagttactcctacaacttcttttaaaatctccggagggccccattcgtttataaagaaacacagtataactactaaaaataattagccgtaaacgtaacacttatgtcaaatctagagttgacttaaatccagataaactagttcaacctcaaataacctaaccggttatttgagctatcgcacaatcaatcccaatgtttgcaatgttttgctttgatctaacaaaaaccctgtgcgatgagataattactgtgatatgccagtttttctggccccaacgagaaaatgaaaataaactacaccggttatcctgggatctctcttgtgcagccgcaagtcgaaaggtgggctgggttatagagaattgcatctgttctggccatgctgtgctcaagttctcacggcgaaatactaccgtgtggcaaacttctgaatgctagggacgggccggggatttcggggatgtttagattcagtggtgtaaagttttggcatgtcatatcggatattatatagggtgttatatggggtgttgagacactaataaaaaaactaattatagaatccgtcagtaaatcgcgagacgaatttattaagtctaattaatccgtcattagtaaatgtttacagtagcactacattgtcaaatcatggagcaattaggcttaaaagattcgtctcgcaaattagtcgcaatatgtgcatttatttattttttagcctatatttaatactttatgcatgtgttcaaatgttcaatgcgaaagggtgtaaaattttaaagtgagatctaaatatacccttcatatccctggagattggagaagtattgtacgaggcttgaaagctctgaatgagtactgatttggggagttggtgatgccaatcagattgacatttggaaggatacatggataccggctggcattactcgtaggcctgtcacgcagcagagcgggatgatctttgtggagattatgggtatcccatatctacatggcgacggtatttggattgggtaccggatacttaatgtagatagaatatcttatctgtatctcgggtttgtttcttaacttgtatatcaaggaaacaccctgagacttagtcggttacgattgtattttacctatatcttcatattccgttaggaatatagattatcttttgtaatccggactccttcccatatataaggggggtccgggcgcctctaggggtagatgctgatttttcccgaatcataccatcaataatacactcggcggattcatccccggacaggagtagggtattacttcttttataagaaggcctgaacctgtataaatcttttgtctccaaacccatacactttccgagcttgatagccacccccttttattattgccgaaatctagtttcgacagttggcgcgccaggtaggggtagcgtcaagcctttcgccgattagtgcgatgggttccgtcaccggcatcgacgacctcgtcttcccaccagggcagacgtttcggttcggcagcctcgacttcgtcaccaacaacttcggcaagatttctctccttgactcggaatcagaccagtcgggagagaatcgacttccagtcccgtttggattcccaaacgcggctgaaagttacttcaagaccatctcgatcgagtcggcttcaaaccacccggccgagatcgcattttctccaacgacgccagatcaagatgatggggcttacccaccgatcctgatgaagctccccgacgatctagcggccgtcttcaccacgacagcgtcttcatcccgtaggcctaggcggaagtcggcttcaacaccgatttcgcctagcttcagggaagtcggcgtcatcctccaaccactcggcacggtttcgacggatcagctggatgactacaacagctctcccaccgtcgactcacgtcctactgacatcgtggagtacgacgaatttagttctcgctacaacgacttcgacgacttcaacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgagttccccacttccgatctcatgactaccatcatccaagcctcagcatcactggagcaggatccaatcgcaggagcaggggccacgacgagcggtctgttcactcgcctcccgaacttcatagggagcgccgagtggaacggcctcactcaccacctcgtcgccgccccatcgatcttcgcgacacaatcatacagcgccgagcagctcgaggctaccatcactcgccggatcgccgcgacgacgaccttgatggagtagcggccttcaccgacgatctgcgtcgagtggattggccagccggcttcaaaccgactggaatagagaagtatgacggcaccactaaccccgaatcgtggcttaccgtctacggtctcgcaatccgcgcagcaggaggagacaacaaggccatggcgaattatctaccagtggctttagcggattccgcccgatcttggctccatggattgccccgtggtacaattggatcttgggccgaactacgcgaccacttcatcgccaacttccaaggcaccttcgagcgtcccggcacacaatatgatctttacaacgtcattcagaagcccggagaatctcttcgagattacatccggcgattttctgaacaacgtaacaagatctccgacatcaccgacgacgtcatcatcgccgcattcaccaaagggattcgccacgaagaattggtcggcaagttcgggcgcaagcctcccaggacagtcaagctcatgtttgaaaaagccaacgagtacgccaaagctgaagacgccgtcaccgcatcgaagcagtcgggtcccagttggaagccgaaaaatacgccggctacgggaggaggtggaagtaacaatcataaggaccgcaagcgtaagcctgaggaacttgttgcaaccgccgctcactcttctcgacagcgttcgcgcgtcaacaccttcgacaagatcatgaactcccaatgcccgcatcatccaaactccaatcacgtggccaaagagtgcttcatctacaagcagttcgcggagcagtacaccaagtctactcggaagaactccgacgaggaacaaagcacgtcaaggaagaaggacgacggcgacaccccggctggatttcaagaccaccgcaaggagctcaaccatattttcggcggccccatggcttatgagtctaaaaggaaacaaaagctgaccgaacgggagatcaatgctgtccagcccgacacgccccaatatcttcgatggtcagagatcgcaatcaggtttgaccgctcggatcaccctgaccgagtggtccacccggggcggtaccccctggtactagacccagtggttcgtaatgtcaagcttcgcagaaccctcattgatggtggcagtgcactcaatatcctcttcgccaagaccctggatgatatgcagatccctcgctccgagttgaaaccaagcaatgcgccttttcatggagtaattccaggattatctgcaactccactcggccagatcaccctcccagtcacttttggcactcgggaaaatttccgcacagagaatatcagctttgaagtcgccgatttcgagacagcataccatgccatactcggacgcccggcgttagccaagttcatggccgtcccgcactacacttacatgatgatgaagatgcctggtccccgtggagtcctatccctacggagcgacatcaagcaagccgtcacatgcgacaaggagagttgcgacatggcccaaacccgcgagatggcgtctgcccgagaggaaatccgactggctgcaaccacggtgagcgaaggagaagtgcccgctgccaagacttcaaaaagtggggaaaccgaagccgcgactaaaaagattcccttagatccttctgatcctaccaaaactgctgtaataggcgccgagttagactgtaaataggaaagcgcgctcatcacctttcttcaaaataataaagatatctttgcgtggaaaccttcggatatgcccggtattcccagagaggtgattgagcactccttacatgtcaaagaagacgccaagcctattaaacaacgactccgccgatttgcacaagacaggaaggacgcgatcaaggaggagttaaccaagctgttagcagcaggcttcatcaaagaagtccttcatcccgactggctggcaaacccggttctagttcggaagaaaacagggcaatggcgcatgtgtgttgattataccgacctcaacaaatcttgccctaaagatcctttcgggttgcctcgcattgaccaggtagttgactcaaccgccggctgcgagctcctcagttttttggattgctactcggggtatcatcagatccgactgaaggaatccgactgcttgaagacttcattcatcacgccttttggggcatactgctacgtcaccatgccgtttggactaaaaaacgcaggagcaacctatcagcgcatgatccagagatgcttttcaacacagatcggccgcaacgttgaagcctatgtggatgacgtagtcgtcaagaccaagcaaaaggatgatctgatcttggatctagaagagaccttcgcgagcatccgcgccttcaggatgaaattaaaccctgaaaagtgcaccttcggagtaccgtcagggaagctgcttggttttatggtgtctcataggggcatccaagccaacccggagaaagttaccgctatcctcaacatgaaaccgccaagcacccagaaagatgttcagaagctgactggatgcatggcggcgctcagccgattcgtttcaagacttggcgagcgggggatgcccttcttcaagctactgaagaaaacagataatttccaatggggacccgaagcacagaaggccttcgaagatttcaaacaactcctcaccaagccaccggtcttagcttcaccacacccgcaggagccgttgttgctgtatgtatcagccacctcccaggtcgtgagcacagtcttggttgtcgagcgtgaggaagaaggccatgtccagaaagttcagcgaccaatctacttcgtcagcgaggtcctggccgactccaaaacgaggtaccctcaggttcagaagctgttatatggtattttaattactaccaggaagctgtctcattactttcaaggtcactcggtaacggtggtcacatcatttccactcggcgatgtactgcacaaccgcgaagcaaatgggcggattgctaagtgggctttggagttgatgtctttggacatatcattcaagcctcgtacttcaatcaagtctcaagcgttagctgattttgtcgccgagtggaccgagtgccaagaggaagcccccgtggagaaaatggagcactggaccatgcattttgacgggtcaaaaagactttcgggcactggagctggagtggttttaatttccccgactggagaaagattaagttatgtgctttggatacatttttcggcgtcccacaatgtcgccgagtatgaggccctccttcatggattacggattgcaatttctctggggataaagcgtctgattgtccgaggtgattcacagctggttgtcaaccaagttatgaaagagtggtcctgcattgatgacaacatgatggcatatcgacaagaggtacgcaaactggaggataagttcgacggactcgagcttagtcacgttcttcgacacaacaatgaagctgccgacagacttgcaaactttggatccaagcgcgaggcggcaccatctgacgttttcgtcgaacacctttactcgccgacagtacctcataaagatgctactcaagttgcggacacccatgacatcgctatggttgaagccgactggcgagagcctttcatacgatttttaacttctcaagagctccctcaagataaagatgaagccgagcggatttcaaggcggagcaaactttatgttatgcacgaatctgagctatacaagaaaagcccttcaggaattctgcaacgctgcgtatctttagaggaagggagacaattgctgaaagacatacattctgggatatgcggaaaccatgctgctgcgcgcaccattgtcggcaaagcttaccggcagggttttttctggcctactgcagtgtccgatgccgacaaaattgtgcgcacatgtgaaggttgccaattttttgccagacaaattcacttaccagctcaagagttgcaaactatcccgctgtcttggccgtttgcggtttgggggctcgacatggttggcccgtttaaaaaggcagtcggcggttatacgcacctcttcgtggccattgacaaattttccaagtggatcgaagctaagcctgttgtcacgattacagcagataatgctcgagatttcttcatcaacatcgtgcatagatttggagtgcccaatcggataatcactgataatggcacacaattcaccggcggagttttcaaagacttttgtgaagattttggaatcaagatttgctatgcctcagtagcacacccaatgagtaatggacaggtcgaaagggctaacggcatgatacttcaagggattaaagctcgagtttttgaccggctaaaaccctatgccggcaaatgggtgtcacagttaccatcagtactttggtctttgcgtactacgcccagtcgggccacaggccagtcaccttttttccttgtctatggggcagaagcaatgttgccgagtgaagtcgaattcgaatctttgcgcttccgtaatttccgtgaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgactcaagcgcgaagacggcactctcgtcgacaactcttggaacattgaacatcttcgtcgtttctacgcttaactttatcattgtatttccctattttgactgtcaaacatcaagttttctccttgaagttgtcagtcgggggctatcatcataataatggagtgtgatttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaactttgcaagaatcatcaagcacagcataaatatgccagtattgtacaaattgagcctccatgtattacatttacacttagtcagaatcagtcctttcatcatcagagttattatcgctcggctgaaggtcgttgttgcggaattgttctacaacatcacttgcaatcttgtcagccgcactctgagcattactgataagatcaagagcagcttcttcacttgtcccgtctgcaaatccatcaatggtgtcgacttcaattctcgggtacaaggattttgtcatcgccaaggccatgccagctcccatacttccagctttcttgatatttttgaaatatacttccggagcaacactcagcttgtcaaatatttcggttgcgtcgagtgcactcggaccaccattattgaggaacatggcttggataattggtgcagcggcattggcgacgttatcccttgctccttcaagcctcttgatcttaccaaccaggacgtcaaattgggcttgcgattttattttgcgatctacaaaacacatttatgatgaggatttattgcattataaagagagaagctcagattgtctgctagcggtaccttcaacttccttcaaggctgagtccctttgcgcagccagttctgtcttgtctctctccagggcttcaatttgcttcgccatctgctccatcctggcggcttgcgctgtttgaaattcagatggttgaggatacagttatgccagtttaaaccgataaaacggatctagggattaccttttgatgaaccactcagctcatagtttgaatcctggagctgagcgattcggtcccttaactccttctccgtcctcttggcgtgctccttggcctcatgtagctggtccctaaccgcttcaagagttcccaaatgaggaaccagcttttccaaagttgtggtcttggcctcattgcgaagatggattctctgcatgatggatcatggttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttaatcaagataggaggacgagagtcgtcggtcgcctttatgcgagggatttcttctccgtcatcacctgatggtcctgatgtgtttccaagacattagacggatacactgaggttatttaaatcgccgttgtatgaaaagacaactaacctgaagatgtacctagctgagcgtgaggtgatctttgttctttgcctggagatccagctatcgagtcattaccagcttctggcccttgggaagctgtcgtctgcgcttctacttcagggatttcttgatcagggcctgcgtccgactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagtttcttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctctacctccctgagcagtgtgttggcgaggagaccggcgctgagtgactggtggatctgacttcatcagtgcatattcctgaacaagatgcttccatagttagtcaattcagcatgaagacaaaattatgttctgatcatggtttgaagatttccgatacatacctgcggaggcggattgaacgcattatatggcactactggcagctgatgagagtagctgactacaattgcatttgagaagattttatacatcctctccttcatgattttgaaatccagggagtctggttcttcacggttgggatcatgtttgccgtcgaactcgaatgctgtgcgggatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttggtacattggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacatggtttgttcttgtttggttggggcttgaggaagaagatccgacggaatagggcaaagtgaggtttgatccccaaaaaggcttcacaagcatggacgaaattggcgatatgcactatggaatttgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcttctgttacgtcggatgacgcccattgaccttcgaagctttctctctcttccgccattggtttcactcaaatgtgttgatttgatttgagggatggcttgggagaggtgagggattgaggcggtggatcacgggaaggattttgatgcacttttcggaggtggatttggccggagttgtgaaccctagttcgccggcgcagctttgcactgtagcggggagtggggaaaatggcgagagttccggcggggaagacgaagcgtcgcttggatatcggattttttcagttaagggtatcggaggtgctaatgggcctaggcctgaacagtacttcagcccaataattttaacagcgtggcccattgtgttccttagggacttaggcatattttgctttggcaatattatgcgcacaacagtgttgcccaatgctgatcaaatcctttttatgcggtcatataattctttggaattattgcaatgcaaattaaaaaggtgcccgacagaaaggcgttatgctgtttttgagcttttttaggctacaaaagctgtttgggttaactaggaatgacttgtttttactatagtcatttccttggcgtgttatatgcctgttttcatggtaaatagtcatggcctaggctatttgacttatttattaccataatctttataatgcttgatgggtaatctttagagtttttatattcggatgcctatcaagtgtgttcgttcgtgaaccttttagagtgtaaaccactcggatttcttttattgtggctaaaaagcagtcggctagcatgcctatttaggcgccgcgtatgcttttgtcatatgatgcacaattgtgttattattttgtctttcaactatatgtttagtttgttaactaatcacatagttgggggctacacctaattaggtgcatctattcgatgcaccatattctttatcttttcgccctttacagtccactcggcaggttttggcttgaggagtttgaagtactcggattatcatccttgagaaggctacgatggtcgactgcaaaggactcgggggctactgtggagattatgggtatcccatatctacatggcgacggtatttggattgggtaccggatacttaatgtagatagaatatcttatctgtatctcgggtttgtttcttaacttgtatatcaaggaaacaccctgagacttagtcggttacgattgtattttacctatatcttcatattccgttaggaatatagattatcttttgtaatccggactccttcccatatataaggggggtccgggcgcctctaggggtagatgctgatttttcccgaatcataccatcaataatacactcggcggattcatccccggacaggagtagggtattacttcttttataagaaggcctgaacctgtataaatcttttgtctccaaacccatacactttccgagcttgatagccacccccttttattattgccgaaatctagtttcgacaatcttgaacaaagttgcagacctcattgatccaaccactggtgattgggacatgtccttagtgaaaaaaaaattgggaaggaaataggaggaatatcctggcaaatccactgaaaagagaaatggatgattttgtggcatgtcatttcaacacaagaggtatcttctggtgaagtcagcctaccatgtgattagttttttttagcagttttagatctattaggtactttagggtttgtctttcatcatgtctatggagttagcattgtctaggctctttttctattttttttaatccctttgttgatgtctctctcgctgtcgtggttatcattgaagacctcgaaacacatgtctatcaggttgtccatgattcaatcggtggcgttggcttcaggttttggatcactaatttgtttggtaacgttggttcgcagatgtctgatgcgaaaactaccaaaggattgagagatggtagccggtgtacacatttgtattgtcattgtcctaaatatgggataccccattgacatgtaattacctcggcaagaccaccgtatatcaagtcatctatgaaaacaaatctcatacatatggataagatctatattatataggaaggaatcccagataagtaaagaaaatacaaattcatgcttaagtccgactagtactataggactagataaggttttccttccacatactttgtacttgtaagagattgatggcaacaccggttaataggagtgtggtaattacccatatcgggagcctaaacctaattaaaaatccatgtctcccttaatattgctacaccttcatttacatcctcataccccaaccccgcctacgtcctcaaaatataatgtatgtgtaccaatccctgtggatgcatataattttggaaaaagtacgaattaccccccgaactatcgtggtcgaccgaattacccctctaaaccataaaaccggacatcattcactcctaactttgcaaacctttcaaataacccccctgctctatccacgacggttttgatcctacgtggcagtccagtcagcaattcatttataaaaaaaaggtgggtcccacctgtcattttcttaccatcactatctctcttctctctcttttccaatctctctcactctctctctctctctcttctccatagagagcgacggcggaggcagcagcgaggcgagcgcggcggcggcggctgaggaggcgaggcagcgtggcagggcggcgcagggggcgggcgcgagcggcggcgacgtcgcagcgtacagcatcagccttcaacgtgcccatggtcgtcagcccgcaggccgtcggcggcgggaagtgccccgtcctcggctgcgtcgtcgacctcaactgcgagtgcctgccggggcagcggttctccgacgatgccgcctgccgcggcccgccggagtacttcaagggccgccaccagctagaacgctcgcgcgcttgctcgcttctccgccgagacgacgacgagaaatcccatgcctaatgctgattaatcaattaaactgtggctttgtgcatgttaattactagtacatcttaattaatcttaattagcatcatagattcacaatcacttccagaacaattcgctaatcgtggtctcggccaccgtgtgccgccgtcctcactgtcgcatcccacgccgccaccgccgccgccgccgccttcgcatcccaggtgccgtgctcgccaagagagatggagagagagtgagagaggggaagaggagagagactcgccgagagagagggagagggagagagtgagagaggggaagaggagagagtatatatgacaggtgggctcaccgtgtttaaaaaaaagaaaatgctgactgggttgccatgcgtacgccactgtttggagagaattttagctagaatctccccgcccaggaaaataaaatgtgcggacgtgccagtgtactaagtacacaaaaataaaatggacaaaggaaaatgtattttattataattctcaaggaattactaaaatacaaaatccttagtcaaatgtgctccacagcccatcggcgaggtggatctgacttggcgattgtgttctcatggttcccggggtctcggaaaacacccggttaattactctggtgggttaaacccgcgagacacctccgattaagctgcgctgtcgtcattggtcttcgcttcacgttctcccatgcatgattgtgatggtggtgatgatgtagatgtgtgtaggcgccggcagcagtccacggcctcatcggtccgtgcgtcggtgttggtgatgtcgccttcacatagactccgcccgctctgccgttcagcctcgtcggtggaggtaaagatggtgcttgtaatggagactagcatggcattggtcgtcggtagagatgccaagcttgtcgtcactggcgatggggtagcatcgcccttctagtctccacagcactggccgaccatcgtcatggtacaagagttagccttctgatcgctgcagcacatacttagtattgagcggtttttaggggatgttaggggcgcagcctagcctgagaacgataagacgcgttccaggaactgggtggccctcttgtatatgcgccgacaatcggagccaaaacccaaattatgttgggtcgcctccgatcgtagtggcttgacttgggagtactgcgccgtcagtcttcgcttcacattctcccatgcatgatggtgatggtggagtagatgtgtgcgggcgccgacagtggtccacggcctcgtcggtccgtgcgcaggtgttggtgacgtagtcttcatatagactccgcccgccctgccgttcagcctcatcggtcttgaacaacgtgttggtgtatattgttgttgaagatatgcatggaattgtgtagctcagatgactcgatgctatagtaattgcgtcggaattagattataaaggtaggaatgatcaacacggatgatagccgaattagtcatggcttgaaggtttagtacggagcaggatcattttaacttctcaccatgtgcggtagcatgcatgcacatttttatttgcttgcttgtcataatgtacagtagcatgcatatacatgcattcgtacagtgcgcatgcacaatacaagcatctgagtaatttcagcgcggcggctgcaaacgacgtgatagcctccggggaatgatgaccttcggatggcttggtcggcagctcctcggcagcatagtgacgctggcagcgaagccgatgaagagcatgtgcggaaatatgcagtgccggttaggatgatattcaatagacgttggcggcgacctgtagaggctacaacgagcgtgggtgacgcagggcgtcaccggccgattagtagagtctcagtgggacatccgtgcccagcaagggcgcatcatgacaggtgccggcaacaggggtccgacgatacccatcgcgaacttgtggatgatatattaacgacttccggatatcgacaactagcaccttggcgacctggcaatggccttctccggcgggcagcggatgatgatggggactagcgttagctggcaacgcctcgccatctatggatttaggcggctcagcggtgtccacggcaactccagcgagatggtttgggacacagctagagctgatgatgccttgcaggcaccgagtagtggcgctccggccggcgttctcttcaagcagcaagacaatgtgtgtagaggatagcagctttgatgagggcgagcggaagtcaacgatgttgcggagaagaggccgcgaccggcaaggcgacgacgtccgatccagcgtctcgacgacatcacatcgccaggtaaagacgtcatgggatagaggttgcggccggcgaggcaaggacgtcgcggcagcaggtagctgtgccaccggtgaccggcgtctccgacgagagggagcaacgcgatctccggctggcggtgcctccgacaagcggagaggacgctatatccagcgggccgggcagcaccggaaactcgcctcgtcgccatcttgtgcatgcatgatgatctgaacagaaagagaaggaaaacaaaagaaaactaagaagttaaactcatggcgatggctgagtacgctgctccggcgatcgtctcctcctccgcgcgcctcctcgccagacgccgaggcactgcggccaacgtcaccggccgccgagcgcacaagttcccgccggatgccgagatacggcagctgatgtcgccggccgcagagcacgcgtgttcccgccggacgccgagatactccggccaagacgacgtgcgcgatggttgccgatgagcagcccgtgtccgctccttgtccttgtgcttctctgtgtttctctcctgtgtctatatgtatgtctctctatggactactgccaaggctgggcacggcgcagcgcctgccggcggcggcggcgtgaactgcaggccggccctcggctcgtgcctctgtactctctctgctgctgccccccctgtaaaatgaaatgaacatccttttgtataggggtgaaaacggtacggaaacggacggaaacaacctttatcgttttcgtttccatatttttttcggaatcggaatcggaatcggaaaccccggaaacgaaaacggaaacgaatattatcgaaaccgaaaacagagcgaaaacgaaccggtgtggatacggtaacgaaaatttatcggaatacagaaacccctcaaactgagcttcaaacttttgtgaagttcaattctcaagttttaacagtcaacaattcattataaaacacaattatatgaagtctaattggtaagtctcaacaacaaaatatattcttctataacttcatataatttgtataacaaatattctaaaaaaattacagcaaaataccatggtataaggtataaagtatacactattagcccgtagcccgtagcccgcagcctctctctccctccacgggccggcttccccttcccctcctccctcttcgggccgccggcccagcccttttgctcctccctcgccgagaagtctataatgcctccttcctctcaattcaaatattttttagggtagtaaataatttcaaatgaaaaaaatgtcaataacaaagttgtataacttatcaagatcaacaacttttgttttggtcattttgctatatgactttgtttcaataatttgaatttgaatttcaaattatgacaacttcaaacaacatttttaaatactaaatgatttcaaatgaaaaagtcatcaacaacaaagttgtataactcatcaatatctacaacttttgttttgatcattttgctatatgactttgtttctataatttgaatttgaatttcaaattataacaacttcagacaatattttcaagtactaaatgatttcaactaaaaaagtcatcaacaataaagttgtataactcatcaatatctataacttttattttggtcatttcttcatccgataaagtgatagtaatattattcacaaattttacatata

SEQ ID NO: 9265 - DNA, 21466 bp, Oryza sativa
gaattcctgcagccccatttagtacttgaaaatattgtctgaagttgttataatttgaaattcaaattcaaattatagaaacaaagtcatatagcaaaatgatcaaaacaaaagttgtagatattgatgagttatacaactttgttgttgatgactttttcatttgaaatcatttagtatttaaaaatgttgtttgaacttggggaggaattatggactatttggatgggcctttttaacttcggaaattccgacaaactttctggaatttttccgaccgattccgagttccgacggaaactgatattatcatattcgattccgtttccgaaaaaatatttccgttttcgattccgtttccgcgaaattccgaaaaaattccgaccggctgattccgttttcgaaaacaggtccggaatccggaaaaattccgaaccgttttcacccctacttttgtagggatgataagtcggtgcacaggctagctcatacatggattggcatctgcacggccagccagttgcttccatcgataagccaaatttccatttagcaaatatcatgattatgataattccattttattgtgatatgatgattcaagcttccattctatggtgatacggagagtagtatttccatgtacttgttgctatatctgtttcttttccattcgaatcatctaggaaatattattatgtgattaccttgccatttcatgatgacactgtggcaacacgcttccattcagatgagatacaattcacaattatttccattaacgggctagctgtaggattgatcgatcatctagagctaatcttccattttataaaagataatcaatgatcccttccatatatttatacaagcttttatatttggaatatggcatttgtgaggggtatgcgtacatgatgtacatcacgtacaccggctgggctggagcataggcaaccagtactatacaagtgtcatataatattcagacgtgcatacaggtgcatgtgcccatgtagtcaaggttgcaccattagtgataattaatcatcaattttattactaccatcgtttctgggatcaatattttaacacacctcatttctttttttattaaaaaaaatgtacaaaatatcatcacacagccacgtaggataaaaccactctggattaggtcgaggggggtaattcatatggtttgcatagttgggggtgaagaatgtccggttctatggtttagggggtaattcggtcgaccgcgatagttcgagggggtaattcgtactttttcctatatttttgcgcgtgtcgaagttggtcaacaccacatggcattccaagtgtggatcatctttgttgtgtgttgacaaaatttgtcttattataagaagatggtaataatcgtctaagaatagaccttatttgaaaaaacaaactacacagtacaagtaattatatattccctaggtttccatccattgaaattcgatgtttcatattcaagaagcgaatgttttcaatagaatatgactctattgcacattttaagttttgattttatgattttctctatttcaattattagggctcaatgtttcatcaaccaatattaactatggcactcgttgaatcatcggatgtataggtccttcgagatttttcttgttcatgttgcatatcattctcccgttctcccctccatgtcttgtataagtgaagtagaattggagatgagctgcttgcaaaagtttggctataaccatatgaatatctcaggtagttggattagccatgatcgaacgacacctgatcgagagaggtcggcagataattcactattattgcccgctcattaattccctcctgcgcccagctagtccccttaagttatctgtgctaccgaggctggctagaaaaacagtattttgaaagaagataattcactccggccggcttaataacaatattttagccttttagggtttgtctttcagcatgtctatggagttaacattttctagctaggctcttttctgtttttttcatctctttgtcgatgtctctcgctttcatggttatcattgaagactacgaaagacatgtctatcgggttgtcaatgattcaatcggtggcgttttgggtaactaatttgtacccatgtattcatgagagattgatatataggcaacactagccaacaattacctatctcaggggtctgaaccttattaaaaatgggagtacctatacatctttcgaaagatttttataatcgtatcacacagatttttaatctttgtattaaaatccgatagatataataaaaagcaaaaagcaattaagaaacaccataatgaacattaaattatcatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgagtgagaaaatcgagtgagagataagaaaaaatctttcgagtgagatatagcaaaatcgattaaaaatccatctcacttcatgtggctacacacacctttatttacatcctcgtatcctgatccttacgtcctcaaaataaatcgtatatgtacggttcctgtggtagggatgtaacccatccatacatatagttttgcacgtactgaagttggtcaacaccacatggcattccaagtgtggatcatctttgtttacgccacgttcttttctaattaagatttagtttttagctcggttttaattagcacacttatcaaactattaaataatacatttcgtatgaaaacttaatttctatataaaacttattttaaaatatcaaacatattcatttattcagtttgtaatattaaaacttaattaatgatgtattaatattttttattacatacgccaacttaatctttattttcatcagtttcaaacacgttgacaaaaattatcttagtataaaaacatagtgacaatcatttaagaatcaaccttatttgaaaaaaagtaacaaacatagtgcaagtaattaatatatccctattttcccgtctgttgaaattcgatgtagaacatgactctatttctcattttaagttttgattttatgatttttttttatgtttcaatcagtagggctcaatgttttatgtaataattgttggtgttgcaaccaatattagctaggtaattgtcagggttatggataccatatacctagtagtagttgactaaatctcggcaggacccaccacataccatgtcttatacgaaaacaaccttcggatatagaaggagttccgcataaggaaggatgactagagttctacatggaaacgacaaggactactcggattgtatccatattggtttccctagttctagttggacaaggggatacctatgggtataaatacaaggcccctaggaggagaggggacacggaacaatagaagatcaatgtacaagccaacatacgccaagacaagataccagatatcgacttcagagataggcatggctagtcccctacggtgcctacggataccgtcaggagagatataacgctatctctgatctcgccggatgcggattcgaggaagaaggctactctgttgtcgagtaggagtcagaccttcagaccgccatgtcgacaacagttagataggctaccccaaatattaattgtacttgtgtgatccagatgaataaaaagcaacaccggtttcggccaacaggatgtagagttattacctaacaattcaggggcccgaacctgtataaaaatcctcgtctctgtctcttttactacaatcttgcatatattatagtaccaacgatcctcatactatgcaaataccggaatcgcgacatcaaacgtcaacagtaataccccgcgctttgctgcggattaatggatgagtatatgttaaatattattgaaatgatgaaagtttaaataatgaaaaaataatgtgaggaagataatttaacacatacttgtcgatctctataatataatattatagataacatgcctcttgtagaaactgatagtcgttatgatactcgttataatcctgcaataacgagtatcataaatttttttaaaaaacataccgtttagcagtttgaaaagcgtgcgcgcagaaaatgagatagttgagttggaaaaacttgaggaagaacacatatctttgctgtcgaggttgccttaaaaaaatattttgaaaagaagataattcactatggccagcttaacactgttctttaagattcagattttactttggttctgttagcacgtttttcaaataagtaaacggtgtgttctgttcgaaaactttgtacatataaatttctttaaatatcaaatataacaatttcctttaagtttgtaataataaaaacataattaattatgtgctaatagctttctaattttacgtgttcaacttaatatccacctttatcagtttcaaaaaccagtaaatgtgagaaaaaaaagaagagttacgggcacatcggattaaattactttagttgaagaaaaagggaaggactaaactgcaaaaataaccccatcttctcgaatctactccgtagcaaactgccaactgcgtacactaatgttacctttataaatagcatcctgcaattcctggaattaacaacgaaaccctccaaacatttcgcctccgccccctcgaatcatcggaattagcaatttagcccttgccgctctacccgcttcgatgtcgcccgcgtccggccccgcacaagccaatgtacatgggcagcacgagccccatctcgcccaggaggactccatctccagcgccgcccccacctcgatcgccgcgccgcccgaggccgccgccgatgtctccccgcctccctcgtccgtcgggagccgcctcccccagcagcccggagacggaggaggccgcggggccgacggatggagccccgccgctgcggcggtcggccagaaggggaagaagaaggagaaggtatcgggagcctctgatgatcgggagcaagtgatggttggctggctccgatctttccgtttttcgccgtcatggcgttcttgtttgtcaccttggaggttttcttgggggggttttggtggggtttgttcttgagcatttcttggtttccctgaaggcggagagggacgaggagaggaaatctgatttcctcaggaggaggagcgttcgtgttgcgtatcatggccacgccaaggaggaggtgaggagaaagttttgcttgtcattcttgactggtctggccggggctgggcattcttgtgtcatcttctgtgttggggaattttggatttggatcatctccttcttgtgaaaattcttgggatcatattgcatcatcgatttcataggttcaatcctgtcacttagatgctgttcttgtgtaggaatgtggaacttaggatctttttgctttcttgatttctatttacccacctgtttcattcagttgtgcttcagcgaagaaatattggttggttggaatgatgtggcaactaggcaattgttaggggggcaattcggctatgttctgtggaactttgattcagggaactgctttcttgttttctgtcaaaattattttagacttatttgctcctgcttttgttattctgattttgctgtttaatgtggttcattttaatcaaactgtaaaaatgtggggaatttattgggtgatgttcgattggttcatctagacgtactttgatacaggaacggctttctagttttctgtcaaaattgcttgacactttcgttaatctgatttttgctgtttaatgtggttcattttaatcaaactgtaaaaatgtggggaatttaatgtggtgattttgctttcattgtaactgaatcatccagatgtacttggggattgggattgcatcactggcgccatcgcatgttttggaatcttggagttttgggagcttgttcttgagcgtttcttggtttctctgagtaggtcatgtccaagaagctaccttgggatgatcccagacttcggaaggagcaggtgacgcccgtttccacaataaacaagtcacaccggaccagcgctcttggctgtatcaacaaagaggtaagcagaagtttatttgccattcttggctggctgagcattcttgcgccaaaatttgttctcaggatgctgttcttgtgagaaaccatggaaaatcttgcatccctgcttaggtgccaatttgcgtgttggaaatgttgaactgcgatattagctttcgtgttcctatttgttcctgtgaaatcttcgatgatttagtgtaattgagcacagatatcttagttcaaattatgctgcactctaatgttgagtcgaaatcattagtcatgttagggataattcgactttctgtttctacagtaaatgcttccacaatacccataagtgtgcctttttttgtgtttacttcttgccaatctaactacaaggctgtcaccaatacttgtaggaaatagatggacttcttgttgtagaaagacccaggtttggaccaccgtatgtggcatgtaatgaattcacacttatgtggtcactgaaaaatgatgtaagtaactattatataaatatttcatttaggtttaatttgggtgtcttaccgacaatttatcttgaataaaatgtacaggaaatttggtaccccttatttgctgaaatccttggagacgctgaccaatcaattgaatcggtaaagaaatatggcttcaactaattgctcttggttttataatgtccttatctttggttatgtgcatttgattttagaggaaggtgtgggatgatattaggcttgtgcgcaagttgaggcccctgcagaattcagagaaaatatcatcccgaacccattacaagatgatcctagttgcagctcataagcatggtcgaaagccaaatcttatctgctctagtttgttcactgaggatcgaaaggccaagggcaagctggaaggtttcgagatcccgcaaaaccttgtttgccccttgtgcggcaatgttatggttgaccctgttatgattgcaacaggaaaggtaattaatgggcttttccccctctttgttccttttctatttgcaatttttgtggatagagtgaatgaatggcatgtgtatgtaatatttgtagactatggaccgtcactgcgtacgggcttggtttgataagcatggacacatctgcccagtaacgtgccagccagtctcttctaccgtgctccgaaatgagcggattagaggatacgtggaagaatggcatgaagctgaactagaggttgaggaagatgctagggtatcatttacaagaccttaggctgatcacccaagtagtttgagaagtaactgtatcatactgtgaagtgcttaggctgatcacccaagtagtttgagaagtaactgtatcatactgtgaagtgatggtatttcgcttagtgaagcaaactgtaacatggagtagtgtattttgtgcttgctgattttctgtataaaatctgatctacttgcttattctggcagttgatgagttgctttatctttctttgagaaatgtacatgaatataataataataaaatgatggattgagccatcccttttcgatcaagctaagtaattcctcaagtatactataatccagaaacaatatgctaaataagtagcacgaatgagattcatatacataacatcctacgaaaaggtgcggacttgtttgcctgtctcaagaaggttcaacacatctcttagcgtattaaggactctttgaaacgcataatagaaaaaagatacaggaattaagtggcacgtttttctaatccttaaaaaaaatataggaaagataaaaggagcccttcgatagcatcacaggaaacaaacaaagtcaaggggttagacttcttgcttattttcttactctctattcatgtaaacattcattttgttccggtcacaaattcccacatatcctcactacatcaggtcatcacatatgtttttttagataatggattttcaataatctggcctctatatccacgaaggatatacacagccaaaaaatacacgagtacttcgactcatatctcaacaaggaggagaacacataaccaaaaaaagaaaagaaaaccaaacaacctcggcacatccatgcttctctacgtcaccccatattctcccgaaacggctagatttggcgagtggaagtcgtctagtcgtcgccgcccctagtgcgccgtcgatgcaaacctccattggtgccatctttatccattttaggtaagctgacgtcacgcgccaccagttagcccattttcaaccatcgtcattcgttgtttagccggaactagccaaccatacacgaaccgacaagatcggcccccagcgccaacgggagccgccgccgtcctccgtcgcagcccctagggccgctggcgccgacgggagtcgccgccggccgctggcgtcgacgggagccgccgccgtcttgaaccaccgcagcctctagggccgttggcaccggcaggagccgccaccatcctaggcctctagcgctgcctggagcccctgccgtcctgggtggccggcgccgccgggagcccccgccgtcttgggcagccgccgcccctagggccaccgccaccactggggcaccgccgagcaccgccgcccccgagggcctccctcgccgacgtcttgccgctcccctccgcccttccgaccacctccagccgtccccaactcacacggctaggcacgggcccggctgcctcaggccgccaccgccgcacctccgcctcccacctccccaccaccgccgtcctagccgccgcacaaacgccggtcagctctggcagcggcagggctagatctggggcgctggggagaggaagagacgcgttactgcacagccctccaggtttaggtgggtcatcacatatgtgacagcccatcgataacgagtcgaagtttttcatcatggataacctcatctctaacgggctaagtttcagatgagacttaagggacatggcccatcacaggtaacgacttatctatcaaaatctgagtacatcggcaatgagatttctgagtattttaaagagtatattatggttacactttttggttcaaaatcttactatgggtgtgtttagttctttgggtgtaaagtttttaaagtatacggacacacatttgaagtattaaatgcagactaataacaaaacaaattacagattccacatgtaaactgcgagacgaatttattaagcctaattaatccatctttagccaatgtttactgtagcaacacattgtcaaatcatggtataattagactcaaaagattcgtctcgcaatttaaatgcaaactgtgcaattgattttgtccacatttaatgctccatgcatgtgtccaacatttgatatgatatttttggctaaaattttttgaatctaagcaaagcctatattatctaattaagttcaatttgttcctatgaactaataatagattgtactactttctgaccaggccattcgagggaaaagaaagaaggtgaaaaaggtagcatcagaatcaacgtcactttattagcctttttctgtcgtaacgcatggtttggttcctaatttggtggaagggggattactcaccttcaatacgctgatgacaccatcttatttgtgaaggctggggatcacaatgtgttagtgcttaaattccttctattctgctttgaataaatgtcggggatgaaaattaattatcagaagagtgaaatgtatggttttggtatgaataaaggggaagagctgaaatttgctgatatgttgaattgtaaagtgcacaagcttcctgtcacttacctaggtctgcctatgcatgcaggaaaacttggtttgagggattttgcttgtcactcagaaagtggaaaaaaaggttacaatcttggaaaagtggttatctcacctatgggggaagggggattaagatcaactcttacttgtctagtataccaatgtataccatgtgtttctactggttacctaagggttttcatcacaaaatgggaactgctaggagcaatttttactggcaaggcctgagtgaaaaaaacaagtatcatatgatcaatgatgtggactagggttcccgatcatccaaaaggttctaataaccaacgatttgggcggagtcgcgatacaaatcgatccggcttcttgaacgaacacgctcttgagccccgcaatcgcagcaccacgtctcctctggttatcacccgtgtcgaaacacggatgacctcgccgagaaggctaatccctgtttgcgaatcaaagaaaacaaacaagaacaaggtagaatacaaccaaaattgcagatgaatgattaagctcacaagttggggtcttacaaaccgatctagcgccgaaactgttctcgacagaataatctaagcaaaacccaaaccataaagatgatgacgagtaatgatatatagagtttagggtcgtgcaaccaacccttgacgagcactaatggcctctaacacgatacatggcccaaagacccaaatacgatgatgcagcaccatgacagattctagacgtcaacttgttcggtcgattaccgttgactcggaaagaatttggacgtgtgaccaaaaccattagaaaggttatcttcttagctttccatccatataaagaatgccccaatccaagcacgtatgcgacctgggtgtccgtttcagtgcaaactagtcctggactccgaattgcactcgaagtcgacttggtttcttttctttcgcccaagcaagtacctctgcaaacgaaaacacacaaaactcattgtgtagcaacgtttgctcaattatataacaagtaaatctaatatagaacatatgcacctttagtggaataatacataaggtaatcatggttatatccgagctagttgtgtcctcatcaatcaagtgggaagctctctgcagacctaaagattatggtggaatggggttcttagacaccagggttatgaatatctgccttttgagtaaatggatcatcaagttggaaaatgggtctccagataagtatttgaacaatgcttgggggctctcagtagttcttccatagggggctctcagttttagaaagagttacaccattgtaagacttgggttgaaagacttgtggagaaacaggttcataagggagatcatgtttttttctggaaagatgtgtggtgtggagatattccactaaaaattaggttccctgatctttttgagattagctatcaacaaggggctctggtgagtgaagtgttcaatggaggagattgggatctagagtttagaagaaatctaaattcccagagagaagctgagcgcaacttattcaggggatttgtctagatgaaggagaagaccaaattgtttggccccatagtaagataaaagttttttctaccaggtctatgtacaggattttgacttttgggggtataagagatgtggatttatgggaaatctagaaatgcaagctccctctcaaaatcaaacattttcttttcctggttgggaaggggaggttaccctatgcagagcaactagtaaagaggacttggaaagggggtgataaattctgtaaattatggggcaaaattgaaactaacagtcatgttctttttttttccctctggcagtttttgattggtgtgtaatcaaagaggctttgaatcttcagactcatccttctaatttttgggattgggttaggttatgggagaaaaaaaaaggaacacaggctttggatttttctgctagggtgtctgttgggctttgtggataattaggaatgattgggtgtctgagaatactttggtttcctctcctttgcagactgtttacgaagctttgtcttttgcgccgaaatggggcgtcctgctaggaaatgaggagcaagcagtgctgggagggtggtatgaggcgattctggagaagtttaatcaacttagagttagaactttgcctgcaactctgtgaatgctcccaatcgaccatcgtgtgtggtgtgtgttgttgtgggtttctgttttcctgctatgccgaatgtttgtaagctgaaaatcccagccagtttagcttgcttccagtttactcccttcgtcctataatgtagcaacctattatggttactacattatgggataggttgctatattatgggacggagggagtatctttttgtaaagactctgtgtgtgttgtgtgtttaggctatctccagaagccgggtcaatatatttgatctgattttaaaaaaaaaatcatacagtctagggtgctatctatttataggattctgatcgcgtgagccgttgctttgtaaaaacgcattagtattttgctaatttatggttagggataattttaacatttatctttttgttaataatcgtacaatcactactaaaaaagtgtttttgcatgcgagctagaaggatcttttcatgcggttggttggtgcaaccgcatgggcgagctcttctgcaaaaatcgctctttggcgtaaccgcatgcgaaaatccatgcaatcgcatataccggccgcatgcaaaaataaattcggcaacaaaaaaataaaatccaaaaaacccccaaaccctagcccgtcgccggatccgtcgcccccgccgcccgctgtcgtcggcagcaccaaatcggcgcggggcagcgccgcccgaggaggccgccacggcggcgttgaggggggggggggaggcgccactgccgtccagatccgccgccgcgccgccgtcgcgcatgggaggtcggtgaagggaggtcgccgccgttgctgagcccgccgctgccgcgccggatgggaggtcggggaagagaggccgccgctgcctgtgctgagcccgctgcatgcccgtcgtccagacccgccgctcaccgctgtcgttgtcgcattgcccaccgccgtcgtggaagggaggtcgctgccgcgcatgggaggtcggtgaagggaggccaccgctgttgccgagcccgccactgccggaccggatgggaggtcggggaagggaggccgctgccgccggtgccgagcccaccgctgacgcgccgctcccgctcaccgtaccgcgcagcagccgcccctccccatccgtgcctcgccgtcggtaagagagagagaggagagaaggaaagagtgagaggctgagaggagaggagaggagaggaataggataaggatggggaaagttaaaatatcaggagaggaggggagagagaagaggagatgaaataatttgaagggaggagggaaaaattaattttaaaatattgaaacttcgaatagaattttatcatactaaatgaactcgtgtgaaaaaagttgtaaaaaaaagttgtagaactcattgagatataccaattttattttggtcatttctccatccgagtttgattgaactatataaaatttaaattttaaaatataagaaattaaaataatttttcaggtagtgaatgattttacatggaaaaattatcaacaataaagttgtataacttatcaagatgtataacttttgttttggttatttttctatatgactttgtttaaacagtttgaatttggattttaaattataacaatatcaaacaacatttattacaagtactaaataaattcaactgaaaaagtcatcaataacaaagtggtataactcatcaagattatttcttcatccgacaaagtgatagtaacattttcacaaaatttacatatctctcttatagtttataaaactatttgtcggatgaagaaatgactaaaatagaagttatatatcttgatgagttatacaactttgttattgatgattttttcagctgaaatcatttactgctttaaaatactatttgaagttttaaaattcaaatttttaattgataaaacaaagtttaaaaaatggcaaaaataatagcagtaagaacacagcaacatgatagagcatgattttagaaacatttaggaaaaagaattatccaatttaaagttcatatgagtgagataaactagtttcaaattttttaaattttattttttgatacgactccttaatatgcccgtataaaaaaaatcgatttttccatgcgggcggttaagtgagccacatgcaaagaggcctgtataagaaaatcgatttttctatacgggcgttttaagaagccgtccgcaaaaataccgttcgatttttactgacgcccctagttatagttatgatccatttaaaaaatcataatgtctcgtacagaaaaatcatcattgtagcagtgaatcagacgcccgtgtcaccgctcatttcgttccttcgtgctgtagctccgcgcatgcccgactcccggattctagtttatcttcaaattatttcatcatccttttataaacatctctcccgtatgaaaaataatttatctgtagtatttgcatcgatgcatgagagatgatgtacggatatgtagtcgctgatgtggcttggaccaagtcacggcaggtacaatgaagagcgatcgagatacacttctcgaatcatgcatggcaaacaaaaagtatttgcatctctttgatgacaaattattactattctcttgatgttgttgactctataaagaaaatgcgtaaccatgtcgcaacttgatcaagagatgtggtgtcattcctaatcaaagagatgaagacagttacggaatggttggcattgacaatttgacgtaatataaatcttaaaacaaatttgtgcaatactaggtactccctccggtttcattttaattgacgttttaaataataacacggtctataaatatttctttgaccttatttttctattataatatatacaataaataaatgcatgtttacttttattatattgctttgaaagataaatttatatatgttgttctagtctttttaaactaaatatttttaaagttattgatggtcaaagttataaaagtttagccttaaccttgttcaaaacgtcaattattatagaaccggagggagtacgccctaaactatttaccttttcgcccttccaagttcttatgcctatctgatttcagaccttttgccctgaccgcttgttagtaagaaatttataatatacattttcatgtaatggaaaatttacatgtatacattacatcgaacagataaatatttgatactgtatccaaaaccttactgcaataagcaaataaaaacgttgatataagccataagtaccttattatttacattgtcatatttgggctagttagcaaagactataatcctgccgcattctaaaccgaaagttaatatcaaattcgaaacaaattttcggtaaaaaaaaactgaaacaaactatacaggcctaacaaaaaaatgttcaaattaatgccatttcaaaccatacaattttttaattttttaagtaaagttctcaaaattatatatgcatttaatttcttgctaaactttgataaatatataagaaatcctgccaaaattttgataagttggtaatattactaaaattatggcattgctaaaatttgttaaagtttattttagctacaatcttaacggtcccaaaatatatacccaacaaagggcaaagtgggcaacaaagccttagacacccataggattaggctgagttcgttagaaggagatgggtacacaggcttcacacagctagagttggccagaagcttcatctcgaacgtagaaaatttgcgaaaaagaaagaaactacacgacttagtttatttatattcccatagaaataatactttcaaaaggacacctagatgaataaatgagggatgtgtttgtcgaaggttgagacgaatcaaaatagaattaggatagtaatctatgattcttaatgattttgtttgttttaagctgcactgtttaacttcaacaaatgattacgtgtgctattggggaaaaaagagaaaatgtatgttttccaaaattgcagcgatcttcatcaatcctaaaatttttgcacataattccttagaacttgtagtgttgcctgataatacatattctaaaaaataagttctcaatatcacaaaagtttgatccaatcttttactttatttctgttatttaatgtttttattttctataaagagtaaagtgcacgggcgatcttaaattaacttatgcggatatatatatcatctagctaggttcctcctgggttgttatatagggcacttatcttttgagagttcagtgtccacccgtacactgcagtcttctacaaatataggacaccaatgtggtcaggccaatttaacccacagtatgtcatattcatcttaagatttctacaaaattatttctaattctttactttcattttaaaatttttccttattctccagcgaggtgtgattactgattagtcagtaggcaatgcacaatggtgcaaaagccgcaggcgcaagggcctagatgcaagcagtccaattggctctcaaatcctatctttctgtatagatataacccactaattttaaaagttcaacatgcaaatatgccacctcatcatccactaacaataattgcatacaaaacttatgcaagcatgcaacattatctataatttattgaattctacaaatcaacatccaatcatcttccttcacattatttttcataatatttttaacatatatatatatccatcatatttataataattaatatatattcatccatataatcaaagtgcgggatatcatatttcatctacaatctcatatttatttctcttttaatatagtatgacaaaccagttttatttattgttaataactaatataatttttacttttagctcaattattaaaaaataataaaatttacttattaattttcacagcaaagcacggggaatcatctagtagtaatacccgtgcgacgtggatggatcgatccatccttgcagagcaacttgttttttaagtattcactccgtcccgaagtataagaaattttgattggatgtaacacattatagtactatgaatctaaactagtactatatgaatcatagtactaagatgtgtatcattcaactaaaatcttttatattttgagacgaagggagtatagttgaagaatagtttagtacatattttagtttttaagaatgggtatatctattttggatctaattattgtcaaattattccattatccttttatagacacttgcatcgtacatgagagagaggatgtacggaaacgtaagtcgctgaagtgccttggaccaagtcatcacggcaggtacaatgaagagcgaggtatacttcttgaaccatgcatggcaaacaaaaaataacaattattctcttgatgctgttgactctgtaaacaaaatgcgtaatcatgtcgcaacttgatcaagagatgtgctgtcagtcataatcacatagcttaagataattatggaaaggttggcattggcaatttgacaaaatataaatcttaaaaaaaatcgcaataatatgtacgccctaaactatttaccttttcgctcttccaagttctattatgtctacctgatttcagacgttttgccctgaccgcttattagtaagaaatttataattatacattttcatctaaaggaaaatttacatgtatacattacatatttacatcgaacagataaatatttgatactgcatccaaaatcttactgcaatatcgtcatatttatttacataaggggcggaactgggtaggcagggtgggttatatttgagctggttagcaaaaactataatcctgcctcattctaaacagaaaattggtctccaattcgtaacaaattttcggtaaaaaaaattctgaaacaaactatacaggcctcacaaaaagtgaattaggctaagttgcggagcgaggagggttggaaaccctcactcccaaacacgcaaaacaaagcggcgtttagtgtatgatctattaaatattagctaaaataaacttgaaaaatagattaatatgattttttaaaatcaacttccctatagaactgtttgcaaaatacgtaccgtcgtttagtagttgggaaaggtgagggaataacacagccttatatacccaacaagggcaaagtgggcaacaaaacctttgtggactgtggtgccggacatagcagtacgaaccagtagcatatatacggcacaacggcagccataggggagcttgattgccaaaacacaaactcactcgcggctgcaaattcacctttgcagagaagaggcctagctagagctcgatggcggagatcgccgtgagtttggttgggagtttgatcgccggcatctcgacgctggtggagaaggaggccaccttgctgcagagcgtgccggagaataccaggtaatcaattaggatgagccggcgccgcacatagagtttttctgtctcctccactcgcttttcttcatgaacatgagcatcggttcttgcaatgtgccaacagaactgacaaatggagaagacaaaaacacatcagaccattatctaagaaaaaacacacattagatcatgagagcaattagctcttttatgacaatttcactgttagagcatgtgacagtcattttcttttttgctttgttctaatatccctaaattagtcacttttaaaaaataattattgagtaatcattatggacaaaaggttaaaattggacaatatttaaggcagtatgatgcagaaataggtaaaagtttattagcttatggctttatgaaaatagcgcatttggagtacagaacaaaatgcatttgtaaaatatagagtcaatatatgtaaggtggtgttggtcacaaactcctactttggataatcttcaaaagttccctgaatgtccacagttattacagagaaaaccaaataacagtagacagttcccagaaagcaaacaacaaacaaatctaaatatttatgtgtattatggtatatcacgaactaataggagtttggtgaagcgatctaagttttaaaaagatattagatcctaaaaagaaaaaaaaagggaaaacactgtgcatgatcttaaatcaattttgcactacctccggtcaggaatatttaacacctgcgctgctgcgattagtgacactggcatcaaatattcttgactggatggagtacttatctttctgaagaaatcctaatgtttctatgttcagaggcagacaggtaggtccctaaactatacaaataaatatttagacctataatgttttagtgtgaacaataactacatatataagtatacaagataatatatagggctaaaagatgttatattatacacaactaaataataataggcattagatttgattgtgtgactaattagtatcggtatcataataacaagttggctcgagtttttaacgagctgaactgagctctactttcagttcagttatctaaacggccaagcctagcaagcttattctcctatcaagttttaacaagctgagccgagtaaagccaacttgttaattgttatccacccctagtagttgtgtccccatgccaatgactcaagatataaacaatgactgaatagaaactagggatggtttagcagttattttccaccattaggagtaaatggcatgagctgacaattagggcctgctggtcagcgatacagagaaaattaatatagaatcgcgaatcaacttgattcagcttgctggtggggaggatttgttggggctcaggatgactagagggaagggaagctgttcagtgttcacctgtcacgcggaccaatgctcactgaaacaattgaatcaataaaattaggaaagttatgtggaaacgaacttggaataagaacaattgtttcgataaaactagcagggtggcccgcgcaattgcgcggctagcacccaaacaaaatcatttttttttaagtatgattttacttaaaaatttattaaatagctatctcattgtcttaagagtttgaaagaccaaaccttataatccccgtgtttctaattatattgttttttaaaagtcacatcagttgctaccccttatgtcatctccttctttatttgcttgctcgatctaccactatttctattcattctccttggaacctttaaaaattggatcttatagtttttagagtttattgtcacgttgggtttcgtttttataatttctagacctcccgtcaaatgttgccattttactcctctatggcacatcctctgtctcttctctttattgtcattgagattttaaaaatcgaacataattatcgtttggattcatttttactttctagaagtcccgccaaaccgtaagcggctttgccattgtagttctctacggctcgcccgctgcctcccttctttattgtcattgagattttaaaatcgaacattattatcattgttttttttttacttttagaagttccgaacctttaaaaattgaaccatgtagtttttagagtttattgtcttgttgggttttattttttataatttttagaagtctcgtcaaacgatgccactgtgctcctctacggcccgtccaccgcctactctttattgtcattgtgattctaaaaattgaacataactatcgttggaattcattttttattttctagaagtcccgtcaactgtcggcagctctgcaactatactcctatacaccccgcccgctgcttctcttttttattttcattgagattttaaaattcaaatatgattatcaatagttttttttttactttctataagtcccgacaatcgccttgctcgtttgcttcacagcatgcttgtcgtccctccttttaatcgtcattaggattctatttggtgttttgttaacagtttttatatgtcgtatcaaccgccagcactctactcctttatagccatgatacttaatttatgtcgtcgtgtgttctagatggtcttttctttcaatagtctttatttttatcacaaattttagttatttataaattgtattcctaattgaaatcttttttctttttctaatttccgaatttatttttttcgtattgtgttcttttgatatttttattttttattttcatttttagttgtttcaaaattgtattcctactttaactctcttttttatttgcctaattttggattttattttatttttattccgaatttaattaatctaccaattttaattaatctcgtattgggtt

SEQ ID NO: 9266 - DNA, 3209 bp, Oryza sativa
aaatgttggatacttcgtccataccaggatgagctcagctcagtctcagaggttgtcggcgcagccaaagctgcacatagctgatcttattgcttcatttggaatcccggtattgacatcttcagacaattggctgaaaatatttgatgtttcagttcaatcattattgtcattgtcttgcagcgtgaacaaatccttcacatctctagctttaaaaaaaaaatcacctctgctaagagtatttcagtacttcgtttcacaggaaattcttgcatacctgctgatgataggctttctcctctatcgccacatctctaattttccccgtagtctgtaccacatataatttaagctggtaagtatggtattcaaatacaaatgcaaaggaaattggaattcaaacgcatagggggttcaaatgcaggcctccattgctgctgttgtaattaatcaacagaaaaataataatttgatcatacaaaatttcaaaaagcaaagcgctaatgtctagcgctgcctccacgggagacccgactgtatgtatgccgtatttgacatcttaacgtatttatatggatgcagcctaaccggcaggcgcctgccgtgccccgtaacgggaggggaccttatgactgctccatttttaatttttacagcagaaggtgtccgccaaaccgtggccacggtggggatcttaccgctgtatctagtcggtgtgggtgtctccggggaggcaacacaacagaatcaaccagagtttataaagaggtcgctctgtcgcaaaatcagcgaggtgggacaaaactaattgcgggatggattcagtgcgagccgaagcgcgtcgcgcagaccaagctaggagtagagacgaggcctacctgctctccacggaggcccggcggcaagggcgccgttgatctggccggagctgaagcttcgcgccgcaaggccgccgccgtcgccgatgccgcggagaccacggccgatggatgcgggtcctccaggagcagagatggcgcatccgcagctggctgcttgccgccggacgtcgggaagcgccgccatcggggaggagagggacggcaggacgggaagcgagatcgagccttccatataaggtgggccatgtggtaagattaccatgagtccagttcacgtcctccaggcccagttcacggctgggcagttttgcccccttttttttcttttttttttaatgttttccccaaggattgttgtttcttgtatgtgctcagattggtactggggttgtttggttagtactagtcattccgttccaaaataaatataccaatctagataagaatttgatataagctatgacaacgaatgcggacaggttatatcaaatcctattcaagattcgtttattttgtgattgataaagtatgctctatgtgtttcttttttttatgatcacatacactcgaccgtaattagttctaaatatgagcgcccatattaccgatgaatacgagcatttgtactaccactttgaacctaagtagacaagtattactgcaagaaacctacctacggtttgtttgttgtatcttcaaaattttaaaaatgcatcaatgaatttttaatgcgattatagagttaagcttaggaatctaattgatacaccctcgtctctacccctatacacaacctatttgtaccaccactgccacgagcttggggcgctaagatttggccaccctaacctcagccacgtgttgatgcaaaaaaacacatactggcctgggagatctatttagctccagtgtaggtccaaaggttatatgcggcgtgccagtcagtttgatcctacaattgacaagacatgtaaacaacatatcaaatagctgattggctgacaagccggtggagtaattccagtcgatagccgatgtcaatggggttttgagtaatcggctatatatcatatgtagataatgatgtaaagacaatcggctgatgataataaaatataaaaataatataatccaatagaaaccaatcggctaataataatatgagagtgtaagtacttatccgaaggttaaagcatacatcggctggaggtctgatgtcataaaatctaaacgattagataaacatccagataattcattggctgaaaccccgatgaaacccttattggcaatcaggaagcaggctagagattatggttctaaacacgacttagtatatcaaacttaacctatgcaacactaagtttgtaaagaaacacaatatctagactatcaagcccttagactgatttctcagggtggtagatgtctaagctaatttaatctagcaaggcgatttagtcgataccggtagaaaccctaaagcgagaaacaaccgatagagctaaatcaagatgctaatactagattaacagatataaatgataaattggtaggcaaatatatcattcaaaccagagcaatccaagaggtcgaatgtactgatgcagccatgaacgacgccaacgtagacgatacaattgcctggggcggcggaaaattggatttagcccttccccggagatcgaaaaccggtgcagccccgcgtcaggtgccaaattccgcagtgataaataaaaagtggaaaaggtaaaaggtggcgatgcgccaaattgtattgatcgtggagatagtttacaatgaccccgggtgtccatatttatacccatgggtagatactagtatttgtaggacaagaaagaaacttttgtaaagataaaaggaaactagcaaaatattcataattaatactccctccatctacttttaatagtcatatttcatcatagcacacaaactaaggataagtgattctacttatcatccatttaaacatgctactagtcattcctcgtaaacaagcgattcattaatatttacatttctcgatgcccatgtagccaatcctgtgtggaagaaggagagtcacgcattaaatccgagaaagtcattaagatgataggttgttggattgaaatatgtctatcaaaaataaatttttcagatttggaaatatgcctatcaaaagtagatagagggagtagataacttgccacgccgcatcctgattaatttccttaactgaatatagcatgaatccggctattgacaacgtgataattctcttagggacttaccaaatttcactgttataaaccagggctgcag

SEQ ID NO: 9267 - DNA, 9724 bp, Oryza sativa
ctatcggcgcctctccacttctggcggtgcggagctcgatgctgggcggagcggcgatggcgacgacatcctctcccctctccccttccgcggccacgagctccggatctagcctagcgttgggcggcgagggcggaggtcgatcttggcggcgcaaatcgggtcgacgagctccccaacagcagcgtagagtgagaggctgcagccgcctggctcgaggcggcgagggtggagatggatctcagcggcgcaaatcgagtcgatgagttctccggcggtggcgcaaatcgagtccacaagctcccgacggtggcgcaaattgagtcgacgagctccccgatgatgttgcggagtgggaggttgcagccgccgtcgagctcatccgacggtcattgaggcctccgccatcgagctcatgtgtagtggctgtatgtggcgagggagtggcatggagaacggcttttacagctttacatgtgcccttttcatctttttcaggcgaggaactcgcctcttcgttgaggaatgaaaagctctgcgaaggtgtgagagcccacaccctctctccacggcatcacgaagtctacatggtggaacgaaggaacgctccagtgtggatgcctgagccaatgcaaaatactgtagttcctctgcattttactcttcaacgcagaggatctaaagtatttcagtaatactataatcttttttttcttctattggactcttcttaaattctacttttcaccgtaaactcaaaattggtaattttcacttcaaatttatattttttccattttgcatttgtggaatgaaatgctcactactacatgataatcagctcttgcttcgtttacagctgcagcaaacaatgattaatcggtgtcgtgaacatttaaagaaaaatcttcaaatcggggagaaaaaatgatcaaaagaaaaaaggaacagaactccagccgagggcgtctctacagacacaccatacttggtaataggacaggtgaaaatcacacgtggagctgcatcaagcaaatttttcattttactacggaacatcaagcaaaggaaaaacaactttcagaacatattttcccattaatttcaaagcaaaaagaaaaagggttatacaaactctgctgcagtctgggttctaatctgaactcgcaagaaaacagaggatatataaattggatttctgagaaaatatgcactgcatgtacaaatactgtttgccgtgactaacggtgttcgtatttgaaaagtattgattgctcacattgacaactgagacatcatcagcttgacagggcaaatacctgtagtttgctccacgcggtaacaaacgagcatgtaaaagcaaataagattattttttgtttcttcagccagccaaagttcctagcagctcattctccacatgctgacatgcaatggtgaggtgacatgcatctgtaaccatggccctctcaacttgtaacttgcacttcaaatggcacccccgcatatgtaaatgacctagttcacctatatttccatgagaaacatcaggatagcaaacctgtgtcacaatccagatgatgctgaggattgtcagcaacagcgcaacaaaatttgagcaatggttagggaactaaatatgagctgccatagatttgaaaagataagatagattcatacatttttaagcagttccgtgttcaagacaatctgctccagttagctatatatctctggtttcactatagctggagcctggccttcaataatgcactacaatttcacattttcacttgacttcagcaatagaaaccttactgcttggggtgtagtgtagcacatcgcagttacgccaatatttactccaactgccatggtctttgactacagagagatcaataaagtgctttttaatattaaaacaatttttgaaaaaaataattattatgtgagccaatcaaattatcatgttgtatttgtcaagtgtggaatgatgacgtgtttatgttttaaatgggtgcaaacatgtgacatttcttaatcttcattgctacaattcgccctaactagtaatatagtgtcgccatacatagcacactcaaagagcaacagttttgaaaaattattgttataaattgtgaaactgcctatttgattgttctatttcctctgtgcttggattggttaggatgtcattttctgatacattgccatcattcggttcaatttttcacccccagaccttcctgcacaactcattgcatgacttgtccaatgtgttatttgtcaccctggaaaattgaggacttacttgtactgacatgttgcttccataccgttacggtacggctacgcccagaaaaaaaaatcaagattactttcactttacatcagtagttgactaacttgatactttccctttcccaagtccaggtccaggtcaacgttcttgtgagttgtgattatccctgacgtggtgttttaattcatgtgcacataataggtggtttttgtgtcatgaatttatttccttacatgagaaccaaacagttcattttgcagagcccaaaggaagaacctcctctggccaaacaatgtccccttatattatccctctgtgcctgattctcttcatcatcaaagctagtcattccatgggagctcagatcaatgagacaaccattcctcaaggttctgaaatcaacacagctggcccccaaagttgggtctccccctcagggcgctttgcgtttggcttctatcccgaaggggagggattctccattggtgtgtggcttgtcactgatccatccaggttcatcttgtggacagccttcagaaatgatcccccggtttctggtggttcaattctgttaaccgctggtggttcacttcaatggattccacctaatcaaggattccaagggaaggtaatatctgccgcccctacttcggctacttctgctgctatcttggacaccggcaactttgtgttatatgacgccaaaaatcaggtcatatggtctacctttggtactccgacggacaccctgttaccagggcagaacttgcctcctggcaatcagctgttctcaagtgtctctaacaccaaccatgccacaggaaagtatcgcctttccaaccagccagatggcaaccttgtgatgtatccgataggcgcgatagatcctgatagtgcatactggaatactggtacttatgcacaaaactttcttctcactcttacactggatcccaacggcaccctatggctgttcgaccgaaatagtccatatagaatggtgttgtttctgactaatcagtcattgagtgcctccccagattcagagagttactaccatctgacattggatgctgatggcatactgcgactctactcgcatgtgtttttcaagcaaggaggagcgcccaaaacaaaggtcgaatggttggtgccaccgagcaatgatcgctgcagtgtgaaaggtgtttgtggtccaaatagcttctgccaagtaactagtagtggagaaaccagctgttcctgccttccagggtttgaattcttaagtgctaaccaaagcactcaaggttgctggagggcacagactggtggttgcaccgggaatagccctaatggtgacatcggactggtagccacaatggtcacggtgaagaacactagttggtcagataggtcatacaacgtcccacctcaatcaccaaccattgaagagtgtaaagcaatttgcatgtctgactgcgcctgcgagattgccatgtttgactcctactgctcaaaacagatgcttcctataaggtatggcaagagggttcctggtagcaacaccacgctatttgtgaaggtctactcctatgaaccaaaaaggactgcaagtgcaacttcaattgccatgttgacatctggcgctgccctcggcatgctctcacttgtactgctctcggtgtctgtaatgctatgcaagcgccggccatttttgaggtacacacgtgctccacaacatcatgaaactgaatttgatgaggagagcattggaatccgaccatactctttccatgatctagagctgtcaacagatggctttgctgaagagctaggaaggggtgcatatggcacagtgttcaaaggtgttctaacaaatagtgggaacaagggcattgcagtgaagaggcttgagaggatggcagaagatggggagcgagagttccaacgggaagtgcgtgcgatcgcacgaacacaccataggaacctggtgcgtttgttcgggttctgcaacgaaggtgcgcatcgccttcttgtctatgagtacatgccaaatggctcccttgccaatcttctcttcaagcgcgatgcaacactacctaactggagcaacagaattgcgattgcgctggatgtggctagggggttacaatacctgcatgaggagatagaggtgcctataattcactgcgacatcaagccagagaacatactgattgacagctcaggaatggcaaagatcgcagattttggcctggcaaagctgctgatagggaaccaaaccaagaccttcaccggtgtccggggcacgcgtggctatctcgcaccagagtggagcaagaacacagcgatcactgtgaaggtagacatctacagctttggcgtgatgcttctggagatcataagctgcaggaagagcatggcacttaagttggccggcgaggagtgcaacatctctgagtgggcctacgagtacatgttctcaggtgaaatgaaagaagtggcagccggcaaaggtgtcgacgaggttgagctggagcggatggtgaagatcggcatttggtgcactcaaaatgagccagtgacacggcctgtgatgaagagtgtcgttcagatgatggaaggaagtgtgaaagttcagcgtcctccaccaccagcatcattttcacagtcactacgctgaaatcatccagagtatttcatgtcctatactcctattgtcttaagtcagaaggcaaaggatgacaaatcatctagagtatgatcgaaattgtgcgtcttacggcaaaactgctagcagtaagggcatatcaaaacatcaatgtatctcctctgctacctatcttaatgtctagttgggtgtttattgtaagattctttcaagaaattaaacttctctcggctaaatacactgtttttggagtattatatatggagtaatcgaactatgcatccaaaggatggaatggtcaaattgcaattggttcgattaacccatgagtagcaatgagttcaacagaaaaaaaaatggacaaattgcaattggttggattaacccattagtagcaatgagttcaacagagaaaaaaatctaatgttacaaatttcaaaaagccaagcgctggtgtctagcgctgcctccaccgagagacccgactgtgtgcctctatagggcctcttttcggcagggggtcgcctgccgtggggatcttttcactgctccattttttttttttttgcagctggccggcagggggtcgcctgccgtggggatcttttttttttttttgcagctgaaatggtagggcggatacacgccctaccgctgcccattgcagtcggggtgggtgtccctggggtggcgatggagtagaatcaaatcgagctaataaacaggtcgtgttgtctcagaatgggcgatatggtacaaaactcataaccggatggattcagtcggagccaaagaacagcgcgcagagcgacctagggctaggagtagaggtgcgtggcatacctgctctccactccacgtcgagggcgccgtcgatctggccgtgctggtgaagtttcccgccgcccggccgtcgccgtcgccgtcgccgtcgccgctgacggccggatccagattctccggcagcatcaccagctggctgctcgccgccggtcttggggaagcggcggcgttgggggagagtgggagaggtcgggagcgagcgagaagccgagaaggcatatgcaggatgctgggccatgacctaaggacgatgagtccatccttctgacgacgcacgtggggctcgagccgaagctttcccaggcccagtttgctactaggctgatttatcttgttttgttttttttttagtttcattcgcgtccttcaaccacaaagaggtatatagcatccgtcaactgtcaaaatcggaacgagtatcatagttgtttaaatgacggtttcgactgatttgatgcctacctaaaatactcttatggacatataagtttaatagttgatttatatcattagaagtttcaaaaaaatataaaaacttttatgtggccaccttacacagtataaaagtttaagttttaattttttttcatttctactttttaaaaatataacttgttttttatatgatatataaaatattttttgtgttgttgtttttaatataaattatctttcatatgcaacataagatattatcttttgtgtaagctatttctatctgatataccatacaaaaatatttttttaaaaaaaaatatataaaaaatgaaacttatgtacatacttatctgttgtgtaaggaggccatataaaaaatttcatattttctgaaactttctaatgagatagagtagattctctcaactttatatacatatataaaaagtttatatgtatgtatgtaagtatatacatatgtacatataatatatattatgtatatacttttgatgtataaaaatacatatacatgtatacaaagtttgcatctaatttaaactttcaaatctttcaactcgaaaattttaaaaaattaattatgtatagattttaaaactttagattctaactttttaactttcaaattcaagttgaaaacttccaactcaccaattgattttattccttgttaaggacgtaggattgcaacgtcgatgcgacactaaacatgtcgtaggtgcgtctccttttgctacctacagtggcggagctagcgtgggggcggagggggcttgagcctcctctaccccgctggactccatagagttgtgagggaggagaagggggaaaagaggtagaggaagaagaaaatggggggagaggggggctggagggcgctcgatctccactttttttttctttttcttcggtttttctcttcatcatttctctttatttctttctcccattcttcctttctctttatttttttctcccattctttactctttttctagaaaaattaaaaataatttggtgaattgaagactagaacccatgatctcatggtttacaacaaactctctcaataaattcaccctatgaccctgtgtgatttgagatcagtgtttgttttctttgtatatctgttcaaattttgtgaacacaaacccactatgttactatatgaatcataccttgttcggtagtaacaatcgcatatgtgcagtaacacgacacgttactgcgagatttattaatagtttgaaacattaagtattaatagtttgaaacttatatttttctttaattggaatataatcatgtgatatcttgttataacgatttaattccaacaaatacaatggtggtggtggcggcaatggtcgccaaaacaactccggcggcagcggttacggaaattcgggtggcaacttctaccaacagcagcaggccggtcttcgtcctgccggcccgtggttctgcttcaatccatgggctgcgcaggcctctacatggcgccctcccagcaatcccggcaacagtgctggcctccttggcccgtatcctcaagctcacacagcttttgccggttcctatgtgtctccaccaactccaggatggcctccaatgccgcaagtccagcccaactgggaccaagctggtcttgttgctgctcttaatcaactatctgtgaacagtccaagtccatgggtgcttgacacaggagctacttcgcatatgtcctcgaccgacggtattctcgttacacgcctccctaactctcatacctttattaccattggtaatggtcatactattccggttatatgtcgtggtacttcttttctacctataggaactactaggtttgctcttaaaaacatccttgtcgctccctccttggttcgaaacttactttctgttcgtcaatttacccgcgacaacaaatgctcaattgaatttgacgagtttggtttctttgtgaaggaccttcaaacccagcgcgtgattcttcgttgcaatagtcgtggggacctctacactctacctactgccgtccctgccatcaccgcccacagcttcctcgccgagtcatccactttatggcatcgtcgccttggtcaccccagtccagccgcagtacaaactcttcataaattagctattctttcttgtactaggtctaataataagctttgtcatgcgtgtcagttaggaaaacacacgcgtcttcctttttctaggtctttgtctagtacttcttccccttttgagcttgttcattgcgatgtatggacctctccagttttgagtttgtctggttttaaatactatctagtggtgcttgatgatttcactcacttttgttggacttttcctcttcgtcataagtccgatgttcaccagcatctcgtcgagtttgttgcctatgtcaagacccagttcagcctacccattaaatgctttcaggccgataacggtaccgagtttgttaatcatgccacctcttctttttttgctagccgcggtatcgttcttcgcttgtcctgtcatacacttctccccaaaatggcaaagccgagcgtgttcttcgcacaatcaacaactccatccgcaccctacttatacaagcttccatgcctccttcctattgggccgaggctctagctactgccacatacctactcaaccggagaccttccacctctgttcgcaattctatcccataccagctcttgcataacaagcttcctgactattccaaccttcgagtctttggttgcctttgttatcccaatcttagtgccacgacacctcacaagctctcccctcgttcagcaccttgtgtctttcttggctacccggcttctcacaaggggtttcgatgcttggacatctctactcgtcgtctctatatttcccgccatgtggtttttgatgataagacgtttccctttgcggctattccccaggatgcctcgtcttttgattttcttttacagggtttctccaccgcggtagctccctcctctgaggttgagcgtccgcgattttcctcggtgactccctcccatgaggttgagcaaccgattcccgacgatgacacctcaggcaccgaacttttccagcttctgcctggacttcggtcttctgctgccggccgtcctcttgtcggcttgcctgttaacgctcgacttccgggcgggtgtgctaatggtgccgctaatggctcttcttcaagcaatccttctccggttatggatcctcctgctgcttctgtcgttcgaccagctccatctgagggaccaaatacatcgctgatttctccttatcggcacacctacgtgcgccgatcacagccggcacctgcagctattcatggcccgattcgctcctctcgagcgttccgtagtgctacagatcaacagcagcagacaggtcacaccatggtgactcgttctcagaccggccatctccgacct

SEQ ID NO: 9268 - DNA, 31054 bp, Oryza sativa
ccaatgtggttacaggaaaatggattttcaaacataagtttcattctgatggaactcttgctcgtcacaaggcacggtaggttgttcgcggctattctcaacagcatgggattgactatgatgagactttcagtccggttgttaagcctgctacgattcgtgttgttctcagtattgcagcatctcgttcttggcctatacatcagctggatgtcaagaatgcttctccatggcaacctcgaggagactgtgtattgtcaacaaccatctggatttgtagatccctctgcacctaatgctgtttgtttgctccagaagtcgctatatggattgaagcaggctcctcgtgcatggtaccagcggtttgcgacatatattcgtcagttgggtttcacatcctcagcttcggacacttctctctttgtttacaaagatggagacaatatcgcatatttgctgctgtatgttgatgacatcattctcacagcttcgtctgctactctacttcatcatattactgctcgtcttcactcggaatttgccatgacagatcttggtgacttacattttttcctgggtatttctgtcacacgatcttctgatggtttattcctttctcagcgacagtatgcagttgatttattgaagcgagctggtatgtctgaatgtcattctactgcgacaccaattgatgctcggtctaaattgtctgctacagatggtgctcctgtttctgatcctacagaatataggagtcttgctggtgctcttcagtatcttactctgactcgccctgagctcacttatgctgttcaacaggtgtgtctattcatgcacgatcctcgtgagcctcatcttgctcttatcaaaaggattttgcgttatattaagggcacacttcacattggtcttcaccttagaactacaccagttaactctctgacagcttactctgatgctgattgggctggatgtcctgattctcgtcgctccacatcaggatattgtgttttcctcggcgacaacttggtctcatggtcatctaagcgtcaaactacagtttcgcgttctagtgctgaggctgaataccgagctgtagcacatgccgttgctgagtgttgttggttacgacaacttctttccgaacttcatatttcgcttacttcggctaccgttgtttattgcgacaatgttagtgctgtctacatgactgcaaatccggttcatcatcgccgaacaaagcatattgaaattgatattcatttcgttcgagaaaaggttgctttgggacaggttcgtgttttacacgttccttcctctcatcagtttgctgatattatgaccaaaggcttaccagttcagttatttactgagtttcggtccagtctttgcgtccgtgataatcccgcttcgactgtgggtgggtattagaattagattagatttgtatagtctaagtatctctcgtatatgtatatatctcttatttaagagtttgttgtaatctctattgtatttggctatataaatataatcgccccccccacgttgggttgtgtggcgtctcataattttctacaggcaattctggatctagctaattagtaacattagagcaggtacaagtacaatagcaggctaagccagctttaagtatattttaaaaagataaatgaagagagaagagcagcgggctacaaatctgtagccagctgcagcacggactccaagacgtaacgagtgtatgacaggtgggaccagatattaatagtatagtaagtaattattgtatgaattaactattacattggctataaatgatttggagctagtagtaggctatactattaaacttgctcttaatgaaaagtccaaacactagcacaaataaaaaagtttacaattgtttcttaaacacaaccactctttaaaaaaagaaacaagttatgaagagcctcttatggtttgcatctttgttgcaggttgattactttgccaggatctttccaggagtggctcatggctttgcttgcagatataacggcagcaacccgtttgctgtcagaactgctgaacaatctcttgccttaatgcttgactggtttgagaaacacttgaaatgacaatagctaatcatgcatgcaatgcaaggccagtgcaattgtttatttccatcaaaatacattgccagtgtccatgtatatcctggtgttaagtgaaacttacataaataagcactagtgtaaagtgaaagtacgtgttgaatatggtgcgaagtgaaacaaagtgtactttatgaagtgcaaaatgcaaactccttttgttccgaagcgaccattagcatggcatattaaaacatcagtttgtaggagaacaaaaataatgtgtgcctctgttgccattttaacaagtcgatatgttcaatcaaatgttgtatgctactcatcttaagcacagcatatattgggtacctcttgactatttcttatggccacaaattagacagatgaaagtcgtgtttccaagaaattgctggcccttaactaggatggggacttctcctgaagctgtagaggaaacaaggaattctgattccaaccaaaatggatgggtgatgaaccatttgcgtgcaaaacacagaaaacattcccagtatttcatctcctattgtcctaagtcaacaggcaaaagatgacaaatcatccagccaggttgaacagttaaaaaaactttttttgtttgaaaaaaagctaagatttaatgtcctccagggagttaggcatacctggtctcgccggaagccagtggcgaggttgctgtagatctggccagagctgtgttcacatgagcatatctccacctcatcctatatatgtgcgccgccacatccagtgccaccccttggttgggttccatcgaggaggtcaagggagattcatgttgccttaagcttttgacaagggtcgaggggcagctctttccagttcatgtaggtgcagaaaaactatcacaacttccgagcatccaaggttggcgtgtgaagcttctgtctctaggtgcagcttctggtcgtcgttggcattcatgattgatcgcactctgagaaaattaaaatatattttagaaacaaagtgttgaggaaaaccatttgccttagggataacaaattattgcttacatgaatccctgagcatcataaagacccttcaaaatgctggattcttcatgcacttgggcagagtatggtatattttaccctttgaattcctggatgaatttggtcctgtcccggaggttataactaatcttgttgctagtcattaggaagcttggtgttcaaatcttcagaaaactggctgaaaatattggattttaaatcaaacctttactgtcatagtcttgcagcgtgaataaattcatcatgttgctggctttaaaagaactcctctggtgagtgcctttcagtactttgtatttcagaaaatgctcgtgtatctgccaatgatatagacttactcctctagcatcccacttataatcagtctatatactgtcatatctctagcttgccgaattctctatgcacgttcactagcctaatccacagagaatttaatttgttaagtagagtagaattaccattaaaaacaaaactacatataaggcaaaactcagtgaataaatgacaaagcgttaccatgctaacaatagaatcggtagagtatgatagaaaattattcatctaccagatcatctctcactggcatccaaccaaaacttggcaatgaggttagaaattttgcatcgtacggcgacattgtagcaataagggcatatcactagcatccagtcaaaacttggcaatgaggttaaaaattttgcgtcttacggcgacattgctagcaataagggcatatcaaaacattaatgtatctcctctgctaccatatcttaatgtctagttgggtgtttcttataagattatttttccttttaagaaacagaaaatctactacacggtcttcccgttgcaacgagagaaactaaatgcgcgattaattcgcttcttttcatcttcatcgtctgatcgtctgattatctctttgaccctagggtacaacaacctagcggctgcgctgctgctggacaatgccatcgcggccgtgagaaacaggtgtcctctcggcggtagccggaatgggcagcggcggcgcaacgtcttccggcatgaccacaaccttaggcctcctagacgcctcctcccagaggaagggcacgccgacagaagaccgtagcagtggcgtcgtgggttgacagcgcgtcgaggtccagcaccttgcttgtccgcgaccacgcgcgcgccgacgcctgcaggcacagtgccacctgcgctgccgctggacggcacctgcaggcatgcgtaatggggagcgccatgctgtgggcggcgcgggtgttcgtgttcttctccaccgccatgctgataccagtatgacagctgttacctgatacttgtgatacctggcacctcgtacctgtggtatctggtacttgatacatgtgacacctggtacccgatacttgtgatacatggcacctagtacctaactagtacccgatacccccgatatttgtgatacctggcacctagtacctacctagtacccgatacctgatacctggtacctgtggtacagtatggtgtacgctaattaattacacattaaaattgttccgtgacttcacttttccacggtatcccgtgggctagctgccctctttaagaaattaagcttctctcagactaagcaatgagttcaacagagaaaaaaaaaatctaatgttagaaatttcaaaaagccaagcgctagtgtctagcgctgcctccaccgagagacccgactgtgtgcctctatagggcatctttttcggcagggggtctaatgtttattagctcgatttttttttttttttgcagctggccggcagggggtcgcctgccgtgccccaaagtaggggatcttttcactgcatttttttttttgcagctggaacggtagggcggatacacgccctaccgctgcccattgcagtgggggtgggtgactctggggtggcgatggaatagaatcaaatcaagctaataaacaggtggtgttgtctcagaatgggcgatatggtacaaaactcataaccggatggattcagtcggagccaaagaacagcgcgcagagcgacataggaggagtagaggtgcgtggcgtacctgctctccaccccacgtcgagggcgccgtcgatctggccgtgctggtcaagtttcccgccgcctggccgtcgccgtcgccgtctccggcagcagagagggcgcatccccagctggcagctcgccgccgatctgggggaagcggcggcgtcggggagagtggagaggtcgggagggaggagacatcgagcctaggggcttttaactatttgccactcttacgaatggtccttaacgatttgccactaggcccacatgtcatagacacatgagggcccacgtgtcattgacagagcgtggcaaatcgttaattgccatgtcacaagagtggcaaatagttaaatttccctcgagcctagctcccatcgatgactcaggtatactatgcaggatgctgggccatgacctaaaaggacgattgagtccatccttctgacacatagggctcgagacgaagctttgccaggcccagtttgcttctgggctgatttgttttctttcgtttttgaaaggaataagttcattttaggtcccttaacttgacagctagttcgattttcgcccttaaaccgcaataccagataccgttggactgtcaaaaccggtgtaatataggtcccaaggtggtttggatagtggttttagcccacgtagcacgctatgcggctaattttgttttgaatgaagtggctaatttgactcggttttcatctaacatggcatatgaagcaaaatttaataatttaaaaattaaaacaaaatatatgagcccatgtcaatcaaaaaataattcccagatggcctgttgaaactgaactcgattagaacaacagtttgagtttctccatttatttatagaatactggtttccttcaaatatgcatttatccatttagttttacatttatttttttttatcttatgcatatgtcacttgtgaatatgaaaaaaaaaatcatccctcagcctttacaagattttttctacctagtattataggtgattaattttaaacaaattggagagtgaaataacatgtactacggtagctctttcactttctgccatttttcccctattgatgaatatgtacagctttcgttacatgaaaaattttcaaaatcattacttgcttcaattggttggtgataacatcgaagtttcctacgcatgctcacaacccagtaaagcatggctgaagcctactgacactgaattttgtatgttttcttagaacttctttatttcccatttaaacttatgtaaagatcatacatttgaaagtagtgggagtattgtgttaattgacatgtagttttacttgtacaaagtgaattttgaatgtgtttgacaattgaggatagacatatctgagaaataaaggtgtattttttaatgaaatccttaattatttttatgttttctaaaatttctagctaaagttagagcaaatcgataatttcaataggaacagttgcacttttctttcttagttatgcttatttctgctgctaattttcttttaaaaaacacagcaaaaacacatattctcacaacgttgctgcttattttctagtatatgcctgaatctaaaattgatttatatttttctttcttcttcccctgtcatgctgtctgctaggccaattggcccatttaacgtgtgcagtttggttcataggtatattggataggatatggtcatccatacttgcaaggatgtggtgctccagttatttgtttagttgtgtggatatggatccagcttcttgattggtcaggtggatgagaatggattgaatgaaaacaataacatattaattaataataaaatatgttaattatcattgatatagacataatttatactaattaataacagaatagactaattatatctaatcaaccctaattttgataagttaattactaactaacaacaaaatacattaattattgctaatcaattactaatgatcaagattagcaattgtggatatcctcatccagcatctctgtggaatgttctctctccgggccgtattatccatccttgcccaccacctagacatactaaattaaaactggatcatcatctcccatctaagatattcctccaaccaaacacacccttagcactacaccagacccatacagaccaagctgcccacacttctgcttgtgccagccagccgcagcccgcaagtcacgcagcacggtgccagattcttccatatatggttttggattctttttatttttgtccctgacaactcgaatttatctttataggcaccacgtggaccaatcagatgatgacataacatccaacattagatgtatagatagattagagaggcaacacaccagtgatttggaggagaagaagttcctctcgaaaggaatagtcatttagtagaagagatcatggctctaagccctccaagtttagttgtaagagccccgctccggtgctttctacttgcagtagaaagtaatctaagccgttgatcgtgtttaatcgtagggttgagatctagttctactcccattagagttagtggcggtagaaatgtggaagggtatatttgtcaagagataataattttcgtagggtattatcgtaatttatcagtataattcccgtccatccctctccttcatcggctgatcccctccatcccgcctccgtcgctgtctctcactcccgcctccgtcgcctgtcctggtgtctcctccccatccagcgttgtcgcctcccccaccctcgctgccttctccagctcgctgggtgcgtccatctccgcgtacagcttcgtcgtcgcggccacgtgccgctccatcttcttgaactgattcgtcgcgcccctatagaacccaaccgtcgcgtccagccgcgcgagtccgttcccccacttcgcctcggcctagacacggtcgaaaatcgtgcaggaacggcgcgccgtgcagcaccgcgtcccgaaccgcgcagcgctgccggcggcgcggtcgaggtccgccacgacctcgccacacgcgagccagagcaggagcgactggtccgtagacgtgatgcgcgcaacgccctcggcgcgcagcgtgtccacgcggagcctcctgatctccacgtcagacaacgagcagtagagcgacacgagccgcgacatggccgccgccacctcgaacgccaggatcttgagccccgcctcctccctggcgacgccaccgccgccgaaccgcacacgcagccatgcaggttggcgagccatgacctcgccccagcgggcatgccaaaaacctcacacccgacacggcaccactttacttaccaagctcaagagcacccaacgtaacgagcagacgcgcagggcagatcaaatatcaccagtacgaaatcgagatgggatagctcatgcggattatgcgtctaaacagctcaactcgcaacgacaagctgatacgcgagctcagctcatagcgataaccttttttttacggggaataccgatagctgatgcggcgtcgggggctcggggcaacgcaacctgatgcgaacaagcgaccgagaaagagaaacatcgcatatcaaaattacccctaatctgtattaagagattactaatataccctttaaaatatacggttgagattaattctacttgcagtagaatactgcaagtagaaagcactggagcgtcaccctagttgtaaatgggcaccattctttgattctctcgtgatgcatatatacattacgaagaatgtcaaaatataactactggtgtgaacatgaagttatggttgtttggtttcattcatcaaggttcaaatctttatgtccatatacacatctcgcatgtgtattttaattggtgcagagaggcggtcattctatttctcttgttaaaaaaaaaaatcaaactataaccatgtgttcgccatgctttataccttccatacaaaacttgggtcataaatgtgagctgccaaagtgatcttaatggtttagaagtaagttgcttcctaacatggctccattatagaagaagaaaacaatgtttcattcatctcctttaaaccaagatgaaattaagaagccctcttcctagttgcgggccaggaagcgactaaccatttgtggacaagcacagccaagtaaagccccaaatctcatattgttgtaggacaagataaggttgacaacacacccaggttttgtccatgttgatgatcaattagtttggttgttcaactgtcccgattaacatcttcaaagcaaagcttccaacagaccaacagtacattgaatgaaccgaacaaaacagaagagaatagatggtttctttgcatttaagttttattgtaccacttcgactcatttgtattcaagttttacgaaacttcttgattaactgaaaactgggctaggtatacttagcccgaccaatcagatatgacttttcacccttcctttttcaccaattaactaggaaagtatcccgcgcatgcattcgtgtgcggggatgcatatattagtttgtttcaaaaacacatcaaaatctaaattaaaagtaagatgttttcctttattctaattgaatgttcattggcactctttctttccataagcaatctcgatttttaccgctgatgaatgtattttattataatgtcaagctggacatccctctaataggtttaattgcatatagtttacaaaattggaggaaatatcatctcggtgatatttgacaccataaaatatgatgagaaatgcttgaaaaattattatgacattggttattacatatcagcatcatgtacaatcaatggttcatgtaagtaaaggaatacaacggcgaaaatggatcgtaaattggatgtataatttaaatgtacgaaagagcatgtagcctagtggttatagtgacctgagtagtaccccatggtcctgagttcaaatctcctatggagcgaatttcaggttgggttgttcgcggggctaagttccctatttcaatggccgtatatatccggttggatgtagaggccgggtaaaaaatacccttctctaaaaaaaatgtataatttaaatgtgatgaacgttcaaagacaatgcttctatattttattggattactactcatgggttttcttctgtttgtcttgcttaacactgttgttgtaggtgattggccctatgtctggctcaattatgaattgattccaaaattgtagtgaatatgacatgtttttaatcaaaatatagtagttaaatagtttttctatggaaacatgttggcaccttatccaattgcattgtccagagataacaatatgcctctaaagaaaatgtaacagccagagaggtaccgagaaacacatggaaaaatgttcactcgaacatcaatcctttgcaaacattgagttattatgggtttttgatattttctccttataaggtctaatttagctatgtatgtttgtgaggaagtatatgatgaaataatatatgctgtcaaatttctgtgttattgtaaagactatttaatttgatcaagaatgataagggaagagctagaatatggctccgcgtcatttttttaatcaaaacatagttaattgtgatttaatattttcccttttatgtttgagggttcgggacttggtggtagggtaggtgttaattgcaatatcggagataaagatgggatcgaagcggaatccacaggataaatcgtatcgaaaacagagtgggaatcggttggagtccgaatcggctatggacaggatcggcagagtttgggtcggacaaggttagcagattgagccgattcttacaacacaactcggtacatatcatcaggttgagtcaaagtgcttcatacggattgccacgtacggattgagtcctggaaaggcaattgtatctattaattagggtattttgtataatttccttatagatatgtttgggcaaaagtctgccgcaaagacttatggtatcttagagtttgttagtgataagtgtcgtgtccggcaaggacatgttttgtatctcgggtataaatatgacccgaacccatgtaaacagacaacaatcgttcaatacaatctcggcgcatcgccacccttttttactttcgtttatttcgacgagttcttgctttcgggttgagctgcatcgatttcgatcttcaactagaggtaaagcttgttatggcagcttgcattatcggggttaatgcttccatctttatgatactttaaccttgtttatgtaatccatcgagttatcacacacatgttacaatctatgctagttgcgttatataacttgttatcggctggttcttattgttaggaagcaattggtagagttatgttttgttattaatttaggttgtatcatgtatccaccatctcttataggttttcatcaccttgcttagatctcatacttgtctttatgtttaatgctgcatcggttgagttcgatctattaagtgatatttataattatgatatctggcttgttttatgatcatcgagagagatagtattggggtttcagccgatcttacctgacttagctttatgttttatatgcttgattgatatgctgtctgccatttatattaagatcttatctcaataaagtatattaggcttttgtttgatatattctatctgttttaatatcttaacatagagtggtatcggagtactagctgatacatgccagatctatctgatcggctatgctataagcgtttataatcttcatgttaatgtatatttcgatttaagtgatttatactgtctcggcacgatgaccgatctatcgcaatcacttggtttaaatatacatcaacagaaagattatatagtgttaatatctacagccgatcgagtagatttagtcttaccttacttatttataactgccgatcgattcacatatgacatcggcttgtaaataaatgatatgtcatcggcggctggccgatcggctatcgtttatggatttaaccgcggtttcttttgtctttatttcttgttgattgcaggatcaaatcaactggcacactcacgaacctaaaggcaagattttggacttgcactgaagttaagcagatcttctaggccagtgtgtgtttttcgcatcaacagtgggatatatatgtgagaagtgtttttagttatcgcgcaatccaagtacgctttaacacatttttttgttacattataaatttatgatcaaagttacacaatttcaaagccatgaaaataatcaaacataacatattttgaactcaaacggactacttcaacaactaccccctcaccattttcacagccaatcaaaacaattaaatgcgagaaaacatgacaactctactagaaaaaacgattttgaccaacgtttggccttttatttttctaggaggacaaaaagatactctcttatagcctttttgtgaaaatacctaaagaacctctaaatttagccccgcctacaaaaaaatcaatttttcagacgaaccccttaagagatccgcctataaaaataacattatttttagggtttgttggaaccatgccctatatttgcaaaatttgagatatgccacccgtatctcaatgacatgtaggacccacatgagtcaatgacatgtgggtcagggtggcatatcacaaattttgcaaaatttgtgtggcatggttcaaattcaggcggacccccttaagaggttcgcttggaaaaaaatgatttttgcaagcgggaccttaagtgatccgcctgcaaaaatacgataacactataaaatttgataaagtcccagcggcatccttcacttctctccctctccctcactttcctctccttcccatctccctctcccttcccctctaccggacacgtggcggcgccggtgctggcccctcccctccctctccctccggctccccttccttccctcccagatcctgcaaaggggagaggttccgatggcggaatggccggaggaggggatgacggtggcggtagtgtggctccctccctctccctcccagatctggtggaggggaggggcgtcggtggcggtgcggatcctctcccctccctctccctcccagatccggcgggagggaggagcgcctgcggcggcagtgtggctcccctccctctccctcccaaaaccctaaccgactgtgcttgagagcaccagatccagtgggagggaggggcaacggtggcggcgtggctagaggtgtggcggccgtgcgactcctctcgcctccctctccctctccctctccctctccctctccctcctagatccggtaggggaagggcgtcagaggcagcgcggctggaggggagggcgatggcggtgcagctcccctccctctccctcctaataccctaaccgactgtgctcgagagcactagatccggcacgggcggtgctcttcccaagcgtgcgacagtgtcgacggctgagggttgcgacaacgacgacgccaggcagcatccacggtcaggctcggctcccggcctccatctcctactgctcctccagtccttttcccttccctcccagatctagtgtgcgatgcaatttgtgaatttggaatcgaatttgtgaatgtgaatactatgaaagttttgtgattaaacttggggtttgattgagattcgatgcctggatgaggagcagtgtacgctgcggattttttttatcactgaaaaatgattttttcaagcggactgtataaccaagccgcatactaaaattgatttttccaggcggacgatataacctggccacctggaatgttgattttcgcaggcggtcgagacgttcgactgcgaaaataccggattttcacatgcgacgtgtctggcagcttgcgaaaaccttttttagccgccaacgaaaatgatttttctagtagagtactactaaagttaaaaaacaaaaagataatcgcaaacctagggcgggagaccgggactactactccacgaggtaccaatggtcaacaatctgtatcatgccttcatatgcatctccctcccatagtctgcctacgtcatacaacacgttgcgtggttactgcagacgtcatgcgtttctgcactttaattattattactacgactcttccatctccgtctctccatcctctttcccggatcctgctttggattaattaataaactcattaacaaggcaaataaaaacgcaaagcgatcgcattagcccccagttgcatgcgcttctgacttggatcgcagcttctgcaaaagctcatgatcatatgccgggctttacttagcacttgcacaagttgagctgcactatccatcagatttgacttatctcctagctccctcataaagtaccactagttaataagaaattaagtatttttataaacgaaataaagaaattaaagatgctcaaatcaaatcgatacggccttgatacactctaaaatatactttttttttatgattttccttaaaacacaatgcaaatacaaacgctttgttgaaattataagcacataataatttaatttattccataaataaatcatgacattgcagatgtaaattagatttaacgcatcattagatctacacatgtaaactaagcagtaaaacatgaatagatcaaatatgtgcaacatgtcgaacacgtaccgaggtgacggaaagaccggttgctcggcaactcgcggtttcgggcgtcgacgaaggcgcgcagcacgcgagcggagaggaagacgagcgtcgtggacgaacagggagcagtcgcgcgaagcgcttcccaaaaaccttattgccgccttctcccggtgcaggacgtcgaaggcagaggttccggagacctgctctcctgatcgccggtgcacgccggcgaacgggatggagtagtctacgagcgacggcgcagtacagagtagtaggcaaactctagattgatttcgcgtgtgttgcatgaaggcggcggctcggtttatatagagataggtcgcttgatcagagtgcccacgtaaccaaaccggataagttgcgtgtaatttatccatactccacgctgttttcacgcaccggatttttcggaatgtttccaaaacaaaacaaatccgaatttcctgcagcaaaacaaaactgcaaaaggaggctgcatctgcgcaagggtgaggagccaattttgcggaccattcgacgcgtacgtcgtgcacgcgccgcctaacctgccaggcgagcgagcgcgcacgtgtgtttcccctcttctctccatcacacatgcttcaagtggctaggagggcatcctcccttttaaggaggtccccctctcctagaataaccaaggtggtactaaactgcacatgcatgtcatcccatgaagtgggcttttgtgattttccaaagaattaatcttcgaatgggccttagcccatctattaattccaacacgcttatattcacatgcgtacacctacatcttagtcctataaacatctcaaaaaattaaaggtatacctatatttatggtgccacatatttaaaaataatagtcaaattggttttacactatgatttgcctacacttacatttgagttatgctcaaatttcatgtttgtcttctaattatatgcaatattgagaatatcattcaaaaaaaataatttccatgccatgccaattctactaatgttattctaaatatcacatccaactatatcttatgtattagtgagttaagattttgaaatctgattacgcacgttcttaaacgtttcttcggaaaaaaaaactacatctaaatattaaataagtaacaggaagtatcttacttagcctagctaggtaggtgtattatattctcgtaggccctaaaaaggattggttaaacaaaatcaacttgataaaagcgatacatacatgcacttgcaaagaagggacaatgcacagagtgaggaaattgcgcggtcaatggctaatcaagctttagctttagttgaccttgaccctaccactattttaggtcagcttcacaatccaattcagacactgttccttgtctaaggttctcatttcgaggtatacgtttcattgatttctcttgtttgtatttagttggtgtagcacgttgttttttgggaggagagtgagtgttgaattgtttttgaaacaattgagaggatgttgaattgtgattagggccaattaaggactttgttgtagctcttggcttctagctgcaagtaagatagctgaccggttcagcactatgacaaataacaactaaagtcaatggttaagttcatggactgttgaggcaaaattgtcaaacagagataagaatcaaacaaatgtgaactactcctacttcatctggacaaaaaaaaaattgccattttatatgtagttggagtaaaactttcaaaacttcaaccatcaattttttttatcagttatattttcatgacactagtgttacaatttgatctacgtttgaatatacttaaagaaattggtggtcaaaattctaataaaattcctgaccggagtgggtatactaatcaaagaaagcacatggaacctctgaccccaataaacaagtaatcaaaatctgaccccaataaacaagtaatcaaaatcaaagcagctgctagcagcacacatatactatttatcttaaaagtggatgccccaaatggagataatcatgatggttattctctttttaattatgcacatcatgtttctaggaacctctcgccacaagtttcaaaggtttgactttgaaggcaagtcacattacacatctccactctcctaccaaaacatgaagaaaaattaaaaaaatacatataaaattgtggagtggtgagtattctatcctcgttccaaaagtccacccgttcaataacggggatcccaccatttggtcatgggtgctcaatttgatgcaacttttacaaccaaagcacaaaattcttctgaaattataaagggtaaccatgtgagcaaagtgcagcgttgcttgagtttaaaaaaatagaggcaaatacgatacataaaacaactaattcatctaacaaggatttttttcattggagaaaagggacgagtgaatcttttggtgttttttttttgaaaaaataaaagtctacaagaccgcgtataaagaacacatacaataaacatgtgctccaaccttgtaccgcctaagcagcgtaagcggtcgactataccatataagcgtccaattatgccgcctaaacgctacaaggtgggggtgacagcatgaaccgcataccgcttatcaaaacattgttcagtgtgctccaaccttataccacccaagcaacgtaagtggttgactattccatataagtgtccgattgtgccgcataagcgctaaaggtgggtgaccgtataaaattgtgtatcgcatttaaaatattattcaatatcttatcatcatgattgatcgacggtggaagacaaaatgttatttccttaagaacaattcggtgtcaaatctttccaaaaataataatgtaaggactaatgtgtactaaagaaaagtataaagttataaaataaaaaggacggtaaaaaaaatccataataacaacaatttgaaaacaatatcatttcatagttagcaaaaacaaatttaagctatgaatttccaaaaacaagttctagttacgtggcaaattattaatgccacatttccttttggaagccattcaacgtgctttatcaataaaaaatatagttacattgttcactagaatgcttagtaaaaaaaatagaggtttcatcaacccagttataacaattcttcaaatcaaaaggcacatttagctacaacatatgtcatccaattgtctatgctcccaatttttatccaacagagaaaaaaaaatcctcacatttatcaaaacgtgccaaaatgaaattcccatcttcctcaaggtgctaaacataaaaaaggatagaaaaagataaaccacctcattgacttccctcgcgtctatccaactcctcttcgtcttcctccctccccagtccccaccaccatttccacttataaaacccatctcccccaccccaaccccgttcccacctcacaatctcaccctcaactcaccacccaacccaactcaagcacctcctcctcctccaccggcaaacgcagcagcggcgcgcgcgctctcgcctccgtctccggcgacccatggccgtggacctcatgggcttcagcccgcgcggcggctgccgcccgtccgtggagacggagcagctcgctttccaggaggccgccgccgcggggctccgcagcctcgagctgctcgtctcgtcgctctccgccgggggggagcaccaccaccgccgccgcccgcaggagaagcagtcttcgccgccgctgggggagatcgcggaccaggcggtgtccaggttcaggaaggtgatctcgattcttgaccgcgaccggccacgcccgcttccgccgtggccctgtcgtcggagcggcagctgcggaggcggctgccgcggcggcgtcggcgtcaccgtcgtcgtctcctgtctcgccgcctctcccgccggtgacgacgcagccggcggccgccgtgaagagcctgacgctggacttcacgaatcccgccaaggtcgcggcggcgtcggtgacctcgacgtcgttcttctcgtcggtcaccgccggcggagacggcagcgtgtccaagggccggagcctggtctcctccgggaagcccccgctcgccggcggcgtcaagcgcaagcacccgcacccgccctgcgccgccgccggcgacggccacggccacggcgcaggccacgcgcacgcgcacggcgggtgccactgctccaagaagcggaagcagcgggttcggcgcacggtgcgcgtggcggcggcgagcgcgcgggtggcggacatccccgccgacgagtactcgtggcgcaagtacgggcagaagccgatcaaggggtccccctacccgcgcggctactaccggtgcagcaccgtcaagggttgccccgcccggaagcacgtcgagcgcgccgccgacgaccccgccaccctcgtcgtcacctacgagggcgaccaccgccactcgccgccgccgccgccgcttgtttaattaattaattagcaaaaatcgttagccccttgtgtaaatgagtttttactttttactgctgctcctactactggttgtactaatattaaatgagaaagcaaattttaccgagcaaaatcttaatcgtttggttgaattttcttttgccgagctctgtggggaagtcaaagtggggcaataaattccgctttaattgtggtgtcgggaggtggggcccacatgtctggccggatgaggatgatttcactggcgctggtcaaaggcgcgggtgagcggtcgctttcgtcgtctcgtcccaatgggctgaccgcggcccgcttcgctttaatttgcgcgttaaataaagagtggggcccacgggagaggagaggggggcccggatgctttcaacgcctcggtttcttcgcctgcttttcttggccacatctctcgcacagcccgttgacttttacagcctccaaatctatgcgtattctctcggtctccgaattgctttcggcaaaatcacgcgacagtttaactttagtggtgattatttcgttcggcaattaactttgcgacgaactttctatcatggtactggtgttcaaattttaattttttgttttaagcctaaatttatttatacgacagaaatcatacgtaaaatctatagtatcatacaatcccagtactatctaacaatatctcaattaaaaaaaaatagacaaatttatgagtatcacctctcgagtagtatatgaccaatgttcaaaaaaaaaaaagcagtatatgacctaaaatatgtgctatgcaaattcttctagaaattggatgcccttgatcatataacatcgtgtgtgtttactatgttcatattagttcatattagtggagcaagaacaaagagaggaggaataataaagggggttacaaacttacaatgaagtgttaagtagaaggaaataaaaggttataactaaataccatcatggctccaataagacaattatggatgtgttcttcccctatttccccaacttctattccattgttttccatgtaagttattttaaaaattatattaattcatttttagagttctttttacttattttaattaattatgtgctaatgagccaccccattttgcatgtgaagtggagaagttgccaacttaatgaaaagaacacagcctatattactatgcaaggacttattactctgtagtggtatttagaatggtattctagccgtagactttaatccatcgcttggaaacaatgaccaccaagcactttttgggtgttaattataattttgcaaagacaagactttgtctagcttgtaaacaatgtcacatttgccatgaacatgcatacttttgcttgcttttctttcatgatgtactccctccgtttcacaatataagtcattctagcattcttcacattcatattgatgttaatgaatctagatagatatatatgtctacattcattaacatcaatatgaatatcggaaatgctaaaatgacttacattgtgaaatggaggaagtagaatagaactagacaattttgttcatgatgttgccctatagtctgacccataatctactcgacctgtttcttcaataagtacatgcagatataatgtaagttcctttcaagtggatgtcaagtgggcttccctagtcagaataaaggaatcataattaagcatttattcttggaacatatcttatcttttgtttaaagccatatgacttgactaatatctaacctcgcttccttttttttgtggggtcgtgcaaacacataggttttcttttttgttgtttgtttcacaccgtttgtgataagatgtactacaaacctaataataaattaaagtatatcaatattgattatatatatatatatacatatgtatatatatatatatatacatatgtatatacatatatatgtatatatatatatacatatatatgtatatatatatatacatatatatatacatatatatatatatatagagcaggttttctattcaactagcttagcaaattgaccctattgcacgtgggaacaaagtcaagtcaatataacgagtgcgttcttcacaattttatcgagtgcaatcaagcctaatggaaattcagaatagacctttcaaattgacgatattggtggataaatacattccgtattaattaaaggcgttgttttgaagaatgttacttaggtattgtgttttcatttcgctcgagcaaagtgtcgcaacacgatcgtgaggcatgagatgtcattttcgagctatcttaagatatatcttaataatatcttagataatcatgattcggaaatgcaattttcgatagtcatacagtctgaattgtgaagtttggtttgtgccgtgctaatcacctacaattttcatatatatgattgtgggagtccaatggttcttttacctaggatttcttatgaaatacgaccaacctacttagttttcaaaattggcaccaaatcattacaggcaaccaacaatataatattagctatatgtaaaatatctttacagacgggcaaagaacattttccctgacgggcttcattacgtaaaatcattttcgcatgtggctaggctacgctgtccaccaaaaaaaaaaagtcttatagtcggcacgtggttggtggctgccaatgaaaatggtgtattttctttggctattagtcgctagcggcattgccgtcgcaaccagaggaaactttacctgttcgactgagattccgagaataccaaataggtttaaccaagctaggtgatgaagtacaattaattagttggaccatcccaacaattatgataaatgtgggctctgtggaatactctgaacaaatattttcgaattttaggttgtttgactttacactcatgattatatcaattttctgactttacaaatatttgttttttacacaattctaagcataacatgttcattacggcctgactggcctcttcctcgttcaagttaattaactacatgtagtaattaagttgttcgatcactggaaagaacatgccaaagtactgcttctagatacgagattatttcgcgaaagttactttagcttctggtatatatgaccacctctgaacatgcttaattagaccagaagatgcccgttaaataattttcgtgaaattggaataaattaaagctttgccctcccattgacccaacttggttcccacgtgtggcatctcatattcttgtcagaccaattgcactaagtcagcaaccttaaaagaacagctaatatatattcaaatattaagaagctttagttttttttttaacacatctcaccagctaacagtgtgaacactcataaaaatatctttctgttcttgtacaatagtacaaaagaagaagaaggcatcaacggtgtctttggtgacaatcaagctggggcagatattagtcaactcttatattgcttaaacaaaaagacgactttcaaaagtccaatgcttttgattttgttgatatacgcatgttctgactaagcatgcaacatgtcaaagtaagcaccccactatatggaatctctcaagcggtcaactttgttggttttctgatgaactaccaaagttagtttttgctaccataatgtcaacagttaatagtcatttacatttacaatatgctctaaggttagcgactcggtcagttggtgaataggattactgcaaaatagcggttgtgtaaatggattgatccgtgaatccaccaacgtgttactcacttattcatttatttggtctataattaggttgacgggttagcccaattacacctctaatagagatactctttctgatgatcataaatatataaatatgtgacgtttagaataaaattcgatcgaattgttaaagatttgaccatcaataatttctcaaatcctaagtttaaaaaataaataatggtacgagtgattttttctgtaaaagtacttccacaatacacaataccataaacttcttagattctataaacttgttataatgtaaaattaatggtaagagttttaaaaatctgatcaaatcatcctaaatgttaaatatttacggctaaaaagagtattttgggtacaacttataaatagcagccacataatcaatataatttaaaaataataattttagtaaaagatttagctgttattaaaaactaaagctaagttagcgtatatttgaaatatgatttttttatagaaaacctctaaaaaacagtttctactccctccctccaaacaaagacaaaccctggatttccgtgtccaacgtttgactgtccgttttatatggaatttttttataattagtatttttattgttgttagatgataaaacatgattaatactttatgtgtgaattgtctttttaattttttttataatttttttaaataagacaaacggtcaaagttggacacggaaacctaggatttgctttttttttcgaaggaagtagtacaatttaaactggcttctgtttggttcaaaatgaataggagtaactccaatggaccacatatgatacgaggctgaagcagagcagagggcggttggtgtcgtcgagtttaatggtgcctagctttccgttgaagagtctgcatcgacgcaatcactactccgtacaaaaaaaaaaagttaaaccctgaattttcatgccaacgtttgactgtccgtcttatatgaatcttttttataattagtattttcattgttgttagatgataaaacgtgattaatactttatgcgtgacttatctttttaatttttttcatatttttttcaaataagacggacggttaaatgttggacacggaaactaggtttatcttttttttttttttacatagggagtactcatcatccagaggaggcgaaagtctctctctgattcgtggatggatcgccggaataatggcgtcagagggaggggttgagtgaatgcagagaggcgacgacgggtcaggtcgatcatttcatcagctgccaccggcgggccggactttgttggcagccggcagccgcagtgcagtgatggcgagctgaccgcgagtggtggttagtcgtagagaaggttaagggtgtgtttagttcacaccaaaattagaagtttgattgaaattgaaacgttccgatgaaaaagttagaagtttgtgtgtgtggaaaagttttgatgtgatggaaaagttggaagtttaaagaaaaagttgggaactaaaccaaacctaaggaatgaaaaaaaaataatggaatctaaaaaacacataattataataaaaatgtaagtgtaaatagaggattacgaatgaccattagattggattgtaggaaaaagcaggaatcagataagagatatatactcgaagaattttttttttcaaaaattgttgtttttgctgagttttctttaaatttttttaggattatacatttcataggaatttcatatggtaggataggatcgaggacttattcactttatcgccactttcaacaccttattaagttttagcattaccaaattttggtaagacaacaaactaaacatatacttcctccgtttcatattataaaactttctagcattgcctacattcaaatagatattaatgaatctaaatacattcatatagatattaatgaatatatatatatatatatatatatatatatatatatatgaaaattataagctactaccgggagtaactactcccatcttatccactgtacggtttgctacgtggcagtgcaaatttctgtatatatatatattgacatatatatgaatatatgcaatgctagaaagtcttataaactgaaatggaactgaaatggaggtagtacttatcaatgccaccttaccaaacttttgacaattctaatagttttcactctcaaaatttctatcaaccttggtaaggttttaaactaaatgcatccaacattacctatatttagtaacgtcaaaatgtgtcaaaatttggcactattaaaaatagctaataaataaacaatgttagaattttttttcatagaattaaaattctccaaaattcttatgttttttctacgaagcaagggccttaagctgtgtgttgtatgctaatggggtctttattaatgacttaactacggcgtgaactacgcagagagggctagcatagctagtagggagaaaataaacaaaagtattgtcacgcccagaaattcacgaaccagaatttctaagctgaatgtgcattaaacctctgtttaggaccagccagggtacacaaacgacaattgttgacatacagatccacgtcttacaaaaatataaaagattacaaatgcagcggaaaaaggtaaaagcgagctaagtctgaagacttgactcctgcagcgaggagactctattccacaggcatccttgacagcagcgacgaaaccaacttcttcgacacagctccaactgggaagaacttcagctctggagtggggaagagagagcaagactgagtgctacctaatgtactcagcaagtcataccggaagagtagggtatgatgcaggatatatccaagggaggctaaaggttcatttgcataaaactagcatttaaaagcaatagttgaaagcagtaaaacagttgtagtaattaatcaatattaaccaatcactgctcaacgctacaccacgttgagacaagcccaaaccaccacctgaactatccagttccattagctaactaggagtgagactaatcacggtgaatctggtcgaccgcccataaccgcgggcacgactattcgaatagttttactctgatcagaggtgtacaactgtacccacaagacacatccccacgacacgttcccgtgcgccgacatgctaccacgacataccggaaagaggccacgacagcgggcagtcccctcccatgcctaggtgaatccggaagcgacaaaggccgtcgtagggcccatcccgctccatcacgcccacccttgcctggatgcgtaggctagaggaaagctacactacaagcccagccgttgcccatgctggcctgtggtaagtacgataagttcatccagggcatcccgcgaaccagtccttaatcgccatgggcacgactagcaaaaccatgcacccacagcccaccatgtagtgtattttaattaaccaacaccattgcggtggcactgatgcaaagctatgccaataattaaagtctatgcattaatatgatcccctttgtgtactaattgaactaagcatggctaagcaattcctaatccaacatctatgcatttaaatacccaagttatcaatggcgtaagggaaacaacatatagctgagtaataggacccatcccacatgatattgtaaaagaatgcaacgtttaatagaaaatgtgggacatttgtaaattgggtacaatatgatcaattgtaatgcatgacttgccttgctctcacgctgatgggaccacagcaacgtcttcgaggaatcgcggatcgacgaaacggccgaaatctacgcgataaacaaagcacacatgcaaaacatttgataagtctactgaaacaggaaacaaaaccatttttagtggattctatgcttttttatgaatttactgagacttgaatggacttaatcggagctcggatgaattagttatgaattttagaagattatatgtgtttttactataaaagaaaaaaccttaattatttattgcgcaacatgtcccaggctgacgtcatccaggaggggggcgccggcaagcgggtcccacttgttagcggcacaaggggagggagagggggctcgggcaagtgggccccccgggtcagcggctcaaggttccgatccaccgtggaccgggaccacgtgggtggtccacaggaccgatgatccagatcggtcgggaggccgattggacggcgcgggcggggctcggctcggcctatagccggccggccggccaatcatggcgatgcggtggcgcgcggtcgccggtgatggcagccggcggcgggaggcggcgacgggcggcgcaaaaggcagcggcgtcggccggaagtgacagcgagcgtacggggaggcggcacatgcaggagagagaagtgggaggaagaggaggttcctcaccgtggggtggccggtgcggaaggcgaaggcggcgacgatgactcggcgagcggaggggcggacgggcggcggcaacgccctaggggagagcggagaggggttagaggtagggaggaaacccgcggcgacaaaaatgccggccgaagatagggaggacagcgaggctcaccggcgtgcgaggagaaaagggctctggtggggttccagcgacgcgaggcggtggccgagatgaaccacgaggcggtgaagttaacggcggcggcggcgtgcggccggaggtggcggcaagcggcgtcgctagcagcgagcagtgcaagcgagatggagagcatgggagagggcggcgagcaagggaaacgagagatggggctcgtgggagtgtttttatgggcgaggaaggggaggacatggacgggaaccctctcgatttggccggcgacgtgggaaggtggggagggagagagagagggggattcaaattgaatcccgccccttgcaagcgcgcgcgcgtgcgggagaggagtgggaagtgggcgacgacgtgggcgcaagcgcaggagaggcgtgggatgggctcagacggagtggaggacgtggggcgccggcggatggagctcggttccaacggctggaggtaggggacgaccgacaggttggccccacctgtcagcgtcccgaatgggaagaggagggggcacgggccagcccaataaagaagaggccgagcgcgggagagaatgggccgacggcccaagaaagaaaaagatggaaaagaaaaagaagaaaaagggaaattgatttgttgggaaataaataatgcacatgctcatttttaattggttaaaattatttcttaggctctgaaaattccactaaaaatcatgttagtataatttgacatgtagaattcaggaaaaattctacatgccgattccgattattaattgcatttttttattatatattaactctaggttaaattaaactatttcttcggacgatttattttataaaattttaaacaaggaaggggaacttcagggcgtgataagtaggtcgtgtttagttcaccctcaactactccaaacttctaactttccatcacatcacatcacatccaaaacttttctatacacataaacttccaattttttttctaaacttccaactcttttcaggaactaaacacaaccgtactccatttgtttaaaaataaagtacaagatatgacatattttattattacgaatctggccaaatcaaaagatctcctatacatattcataaatttaaaatgtgtcacattccattccccattggtgtattttgggagaagagagtacatgtacttctcctgaagagagagtaaaagctagcctcgtttcctagactcctacgcccacggcttacaaaatcggtgaaccatgtggttaccgtggtaattgcacttatcactgaggtatgataatgataaaaccatggtaataccatcaaattcaaataatttagaactatgaatttttgaaaaaaattacatggtttctcattatttgccatggttatcacacagtaaccgcacttgccatttgtgtgcggtaacccgtcccccattgtaaggaaactctgcctaggctgtgctagaaatttacgctgatttaatgatcaagccagttcacctaggtaaaaactgttacaaaatcaaagcgcattgagctgatatgcataataggcatagaatcaacgagtgaagaaaccataatagtttattctttaaaaaaatagataaaatgcccgtgtatttttttttgagagcagatcaaactattaatttgacccggcttttgggagaaagccaaaggtaaaacaaagtacaaggtctgcaaagagcaaaacaagagaaaaaaggctgagcgacaaacgctggggactccagcttccaacagcacactagggaggggtgaacacctacgccctcaaaccaaacctcagatagcccacaacacactaagaacacacaccaaacggcctactcagaaccgaaacaaaaagactaaatggctgcaggaaggaccaacggtttcacttgtcgcagtttgtccataatagcttcatgccagccatccaacaccttttgttcttctcctcttaggaacaccttccacttttgcgccagcgagagtgacttgtaaacgacctgtaagggagaagaaaccagaacatctttaaagacccagtcattccttattagccacaaagcccaacaaatactagccaaaagcaccatccaaaccctttttttcccctatcccaaacaaagctagtgcaatcccagaacgagaaaggtctcctttttaaatgcaaggcctctttaatcacacaccaagtaaacacagctaaaggacagtgaaacaaaatgtgatcagaggtttcatttttcccacatagtttgcaaagctcattcccccctttccaattcctttttactaattgaacagcacaaggaagctttcctctcccaaccaaatagagaaaatgtttaattttaagagggattctactcttccaaacagcccacatgactgaatccttaatcccccaaaaattaactgattatacattgacttggcggtaaaggatttatgtttagtatagggccagattacttcatcacaaccaccctcaatctgaactgattgaagcatcctcttcaagtcattcagctcttgttctctctctgtactcaggatcctacggaaggacagaatccaatccccattattccacagctccctaaccgtagccttctgatgcacacttatatcaaacaaattattaaagactactctcagtggtacattcccgcaccaaatgtccccccagaaatctgtcctagaaccatcatgaacttttttttctaccagtctctgcagaaatttcttacaatggtgtagccctttccaaaattgagaccccccacttcagagctctgaaaaaaactccccctcagatatttccttctcaacacctcaaagcacatatcaggggccccattctctagtttcataatccatttacaaagcagacaaatgttcattaccctagtattcatgaagcccatacccccaaaactcttttggacgacacaaagcctcccacttgatcatatggtattttctcttctccccagtaccttgccaatagaatttgctcctagcagcatccattttagcatgaaaaccctcaggaagagagtaaaaacccatggcataaagaggggcactagataggcaagagttgatcttaatttccctacccccataagacaaatacccactcctccaagattgcattcttttttcaagggctgcaggaat

SEQ ID NO: 9269 - DNA, 680 bp, Oryza sativa
tcggcggccatgacggcaacggcagctgccggcatgaggttgggtatgaccccgacaggtggggccgcgggtcccacctgtcggccaaagaggagagggaggccggctggggaggcaaagtagacttcggggaggagagggccgagcggcgagctgggccgagggagagagagggcccgagagggggaggaatttgggccgagcccgaaagcaaggaaggggaaaaatattttcttttctttttattttaattggttaaatgaactttgtgactttaaaactatttctcgagctccgaaaattcacggaaaattccggagagtattttagggcacaaagaatattgcaaaatattcccggccgatgatttttaagggaaaattttaattctcccaataattcacttgattaaattgcttaactttttatttaatttgtagaaaatgcattatttaatgatttttaatcccgaacgaaaatcggggcgttacaaatctaccccccttacaggaatctcgtcctagattctgggatggctagaaagaaagctggtgtaggcagtcggtttgactgatctacgggtatgcacactgcactgcccctttctatcttgaagtgcctgattgactgattgatccaacctgcaccattgaaatggggctgcaggaattcgatacgag

SEQ ID NO: 9270 - DNA, 680 bp, Oryza sativa
gaattcctgcagccccggctttatagtggaatgaccgtggtaaacccagcatgcatgctttgacctgaaagatgtaaagtctggttcatccatattggaagcgctatcctcggaacaactatgaaactttgtcttttctgagaaacaacaactatgaccctagaaagtgatgtaccttatgctaaccttaataaattcgatcggggcacttcttcaccaccaatgcggtgaaaaaaatattgctacctccgactctcctttttttaatatatagaaccattaacatctctaacatgcttttttatgaatgaatctagcaaatataaaaaaaataatgtcatacttaaagaacatttaataataaatgatatcacaataaagcatatgataatacacatcataatttttaaacaggataaaggatcaagctatctcaacagatgaaaagcaaatgatgtcggatattataaaggatagacttacaaccggtttggatgacttgtccattgatcacactgcaacctccagcaacaaaatatatctataatgcaacgaacaatcgatacactggcgagagagaacttaaatgcacaacttgaatctgcccatggagacagccctggccctggctctgacctgcttctcgatgtggcgccacagctagccaatcatgtccgtgc

SEQ ID NO: 9271 - DNA, 640 bp, Oryza sativa
tcgaattcctgcagccctattttattggctgaccagccggtggagtaatttcagtcgatagccgatgtcaatggggttttgagtaatcggctatatatcatatgtagataatgatgtaaagacaatcggctgatgataataaaatataaaaataatataatccaatagaaaccaatcggctaataataatatgagagtgtaagtacttatccgaaggttaaagcatacatcggctggaggtctgatgtcataaaatctaaacgattagataaacatccagataattcattggctgaaaccccgatgaaacccttattggcaatcaggaagcaggctagagattatggttctaaacacgacttagtatatcaaacttaacctatgcaacactaagtttgtaaagaaacacaatatctagactatcaagcccttagactgatttctcagggtggtagatgtctaagctaatttaatctagcaaggcgatttagtcgataccggtagaaaccctaaagcgagaaacaaccgatagagctaaatcaagatgctaatactagattaacagatataaatgataaattggtaggcaaatatatcattcaaaccagagcaatccaagaggtcgaatgtactgatgcag

SEQ ID NO: 9272 - DNA, 4279 bp, Oryza sativa
  unsure (1)..(4279): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagttgcgtaggtagagacgcgtaaggccagcgaatgcatcggtacaggcaccgaaaaatctcatgagttgcttcccattgtggcggagatcataagtagagtaatgttccggcttcttctctggcagaataatgaactcgacgctgtcgaggaggttgttggtggccatggctcgggcgacagctttgccaatggtgagacaatcatagtatttcaagtagaaacaaacgctgagatggcgaagggggatatcctgtcttctgaaattgagaatgttgtctgttgcatcggcgacagcagcgttcatcgggattgtatccttcaaggtggcataaccgcagtcgggcacgaaggaatcaacgctaatttggaatcgcgagagcatgtggcggaggtggatcgtcctcttggaaaggaggcaggttctgacagcatcgggggtgttgagacggtcaaggatgttgagcagcagatcatcaggtagcttggtggacctatccactactagttgggggttattgtgagctgctgatttcttctgcatcaatcaatataattgcaaaacgaaattaattagtgcatgcatacatatccaagagaatacagatagagaaatgcaaaaggaaggaaacaatagtagatgaataaaaggctagttaggcggcttacattgcggttatggcaactacccttcttattcttcatgatggtatggtggttaattccaacgaggtgtaaagtagcttggctgatggattcgatttcttaattggttgtttaatattgcagcagcgcttatatatgcttaattgtttgcgatgaatatataaagaggaggagaaggacggtgacctcgactgccaactagtcctccgtccgtctcctaaacgaaacgaaggagaagaatttccatgtttgttagattgagtcctttacagatttttctttttgggaacaagtccattacagatttaaaaggctactcttagatcaaaggtaaaagcttcttactgtttgtatgaactatctttgtgttttcccccgttgaagaatttagttggtgaaaacagatcttcttactgtttgtatgaagtagcattccaggtttgtagactgccggttcatattgaaaacaaatctccattctctaaacacatctgagagtgttttttgtttattgcttgccaaagccaggagcaagaaccaggcaaatctcaactttcccttaggatttatctctaagtaggacaatacacattacaaacctggaatggacaatacacagtttttacccggaggtagtaccattcactaattctaaaggtcttaaaaaagtgagagtgcgatggcaggtgaaaattaacaaccccatactaagcttaaatagtggggtaaatagtaaccgtaggggaaaggataaacgaatatattttttcactgcaccaaaagaatatcagaatattcagaacattcacatacattactccagttactggtccgaaaccaagttgcaggaaacacgatgagtgaaaaaaaagaacccgaatattcagaaaactcaatatgtattactgtatagcaaaaccaagatttacatttttgcgcatagtaaattcagatttaagaccggaagcgaattatatcagaggaagcaatcccgaatccctctgtaattttcctcctcaccaactcctgctgcttgatggtccgcggaaatcttgacagagcaactttgatcttgatcttgggatcaaggtcactgcagcaatcagagaacctcctgtcgtacagggatatcctcactaggttaaccgcggcttccatcatgcacctgatgtatccaacgaagttgtcatcaggttgaaaaccgtagatgatgagcttaaccagattgtgatgcttgaaaccatcaggttgtgagctttgccactccacgtttgttttgtcacggtaacccagttcttccccgttccacgctgtcagtctccatgtcacaccaatggtcccaaactgtgatggacatcttcaggttaggcgctgcctcgaggaagaatcttgtccaagctatatcacatccctcggggagtctatccagattcaaaacccgcagtttctggagaacaggcgccagaagttttgggcactctggcttaacccaaatctgcaaatacaagtaataaaaaaaaaaggaagaatgtggttttaagttaattaagaatgaggaacaaataacctgacctgacaaagatgcttggcttgcttaaagtaattattattaccttttcacttgcgaagctgaggtgcaggttgcttatgttggggacattagcaaggaagtgacttaacctgaaaaccttctgatatcccgcgcttacattgttgaggcttaggcttgaaagcattgggacgttgccaaaagacaagggttctccgggagagacccacataccaaaaaccagccgcttgaggttgggtagagatttgaggtcgactaggtggaaacctgcatcgtaaatgtcaagctcaacaagccgcgggtgttccagctgcagctgcaacacgctatcctctgaatcacacaccgacatgcacagatactgcagccgtttgcatgtggagaggatgttgggaatgtcagcttcagcaagcctcaagttctggatgaagagctgtgtaaggccggcgaatgcatcaagataagaaccaagaaaggtcatgaactgcttcccattacggcggaaatcatcaacggtgtaacactctggctgcagctccgtcaagatgatgaactcgacgctgtcgatttggttgtaggtggccatggcttgggaaacagctttgccgatggtgagacagtcgtagtatttcaagtagaaacatatgctgagtcggtgaagagggacgtcttggcttctgaaactgaggacattgtctgttgcatcagccacggcgctgttggcctgaataagacgaggcaaagagacaaaacgagaaccgttgaagaaggaaccagcacgtcgggggtgttgagacggtccaggatgttgagcaggacatcgtcaggtaacttagagagcctatccactggtagtggtagggaaccagtggatgctgctgatttctgcatcgattgcaaattgcggaaactaaatatattagtggcaggcaccaggcagcgaaccaatgtagtataacttacgaacaaaacacaaaacaaataacgtaaatgtaaactaaactaaattgatgtttttacagcacataacaataataataaatagtttagaagtagtttatcagagacagcatagcaacatccatggatctgacagacaggcgagagagatgcagatggaagaagataggaggcggcggcggcttacgttgcggttgcggcgacttcccttcttgttcttcatggatgacctgaagcgggcgctggtggatgagatcggaatcagatgtgttggcgatcttcttgtgtttcttctatactagtagatatataaatatggatgaaggcgctcggtcggccgggccggatcctatgcgaaattggctctcggacatcgaaatcccccactcccttttcgactgctatttcggcaagtcatatcaagaaactccattgtggagaagaacaagatcagaatcagaccagatcgccgttcgccgttagcggcggcgtgcgttgccgatggcgatgggatttagggtttttcggcctctcggggacgacggcctagtacactttgctgggccgccgatataaatgggcccactcatcctttctccctcagctatggggaaaagtacaccgaaggtcccacaacttgtcatcgggttacaaaatcgtccccaaaccgcaaaacaaaatactaagatactggaggtccctcaattagcaaaaccgttcgcttgagatcctatgtggttttgaccccggttttgtctgacgttgcggatgagttagcgtggaccccacctgtcagcattgccacatcaat

SEQ ID NO: 9273 - DNA, 19047 bp, Oryza sativa
cgccctcctcatctcacgccgcccgcgcgctgcttgtccgccggccgcgcaccgcccctcccccgccgctcgcaatcgcagagaatggagagatagaaagatgagatgggagagaagagaggaaaagagagagaaggctgacgtggcaatgctgacaggtggggcccacgctgactcacccaccacgtcagacaaaaccggggtcaaaaccaccagaggacctcaagcgaacggttttgttagttgagggctccgatatctgattttgcggttgagagacaattttgtaactcgatgacaagttgagggactttcggtgtacttttccctcagctatgacaccccacaactgttagtatgttacaactactagtaatatattaattgatcttcctcagtggtttttaaaggtgatttttgtactatgtgacattattcctataaataattagaccttgtgtagttggcaaaaaaaaatttactcctacgtgtcacatcggatatacggacacacatttgaagtattaaacgttgtctaataacaaaacaaattacatattccgtcaggaaactgcgagacgaatttattaaacctaattaatccgtcattagcaaaagtttattgtaacatcacattgtcaaatcttagcgcaattaggcttaaaagatttgtctcgcaatttacacgcaatctgtataattggtttttttatctacatttaatactccatacatacgtaaaaacgaaaccaggatattcaaaacattcaaaatatattgcttacattatagtatatccaagttactggcctgaaaccaagttgcaggaaacaagagaattctaatgcatgccttgaaacgtttgaaactagagtgtttcgtcacaaaaggaaagaagaagaaaccaaaaatattcagaacattcagcatacattattgctactcagctaatcgcattttcgcgctgatgaattaagaccggaagttaattacatgaggcgatgccatcaccaatccctctgtaatttgcttcctcagcaactcctgctcctcgacggtctgcggatactttgacggagcaaccttgattttgggatccaactcttcacagcaatcttccaccttccggtcgtacagggatatctcctctatgttaaccgcggtttccatgatgtgcctgatgtatcccaaaaagttgtcatcaggttggaaaccgtagatggtgagcttaaccagattgcaatgcctgaaaccatcaggtgaagatgactcccactgcacgtttgttttgtcacagtaaccctcttcttcccgttccaccttgtccgtcacaatattacaccaatggtcccaaattgtgatgcatagctccttcaggaagggtgcagcttcaagaaagaagcgtgttatcacatccttcacggagatcatccagagtcaaaacttgcagattctggagaacaggcgccagcagtttcgggcactctggctgaacccaaatctgtaatacaaacaagtcataaaggaaggatgcaggggttaagttgagaatgagatgttcataacatgatagagagagagacttgcttaaattaattaccctttcacttttgaggttgagatgcaggtctcttatggaggttacattagaaagaaactgacttaatctgataaggttgtgcaatctcagacctacattagtgaggcttaggcttgacagctgcggaacattgccaaaatacaagggttcttggggatgtctccaactattaaagaccagccgttcgagtttcggtagagaattgagcttgactagttttaaacatccgtggcagatatcaagctcaacaagccgctggtgttccacctgcagctgcaacacagtaccctctgtttgacacatgaacatacgcagagactctaatcgtttgcatgtggcaataatattgggaatgtcagtttcagcaagcctcaagttctgtaagtagagtcttgtaagcccagcaaaggcatcagtacaagcaccaaaaaaggtcatgagccgtttcccattgttgcggagaccataaaaagtgtaataatgtagcttataatctgtcagaattctgaactcagcgctgtcaagcttgtgggttgccatggctcgggcaacagctttgccgatggtgagacaatcgtagtattttaagtagaaacatatgctgagttggcgaagagggatctctttggctctgaaattgagaacattgtccgttgcatcggccacggcggcgttcatcacgatagtctccttaaaagtgatataatcaggatctggcgcgaacgaaactactccctccatccaaaaaaaaagtcaaatctgagtttccgtgtccaactttgattgtccgttttatataaaatttttttataattcgtattttcattattgttagataataaaacatgattaatattttatgcgtgacttgtctttttaatttttttttaatttttttaaataagacggatggtaaaacgttggacacggaaaccagggtttgtctttttttttgggacggagcgagtaggccaatttgaaagcgcgaaagcatgtgtcggaggtggagcgtcctcttagagaggaggcaggttctgacggcatcgggggtgtcgaggcggtccatgatgttgagcaggatgtcatcaggtagcgtggtgaacctatccaccaccattacgggagctgatttctgcatcgatatagtgtttatttgtgaaactaataataaattaattagtgcaacagtagtcatggatcgacagggaaagagaagactgacatgacagatgcaatgcaaatcagtaagtactcccttcgtatttatgaagccattgatttttcgaccaacgtttgaccattcgttttattcgaaattcttatacaaatatgaaaatatttatgtcatgtttaaagaacatttaatgacgaatcaaatcataataaaataaatgataattatataaattttttagataaaacgaatgatcaaacatttaataaaaagtcaacggcgtcatacattaaaatatggaggtagtaggaagggaatagacggcttacattgcggttgcggcgactacccttcttgttcttcatggttaatgaattccaatgttcaacggcggggcctgaccataacagacaagcgctgcgcttattgcgatggacgtcggctcctcctgacttgtttatatactgagaggagaagaagaggaaaagaaggcgcctccgactgaatccgattagaataggaaaatattggacacactcgatgatttttatggcttttcatcgcattcgagactgattcgattgcatgagctgtttatatatacttttttttttggaataaattggttaaaggaatcaatcaacaatagaaactcaatactagtactagtcaccagctgatggatggaggcgtggcgtgtccggatagacttttccaggcgaaggctacggaacgaaaccgattgctaatatggttatgtttagttcaacgtaaagtttgaattttaattgaaattagagataatgtgactaaaaagttatgtgtatgatagattgatgtgatagaaaaggactgaaatttgaatccaaacttcgaatctaaacatagcctatatatacacacacttcagacaaacagttaccagtctttttaccttcatcttcagtaggtcagtaaatattacaaacctggcattgattagattataaacgcctttgatctcgcttgaatctagtaccactgataagagattgaacaccaatctcttggtggtacttgaacaaaacacatttgcttcagctgtgagctggatggcaagttctcttactggacaaagggtggaaaatatttcattgcaccaaatagaaaagggaaaccagaatattcaggatatatattattatgcagcaagcttaaatatgtgctggctaccggcctgaaaccaaggttgcaggaaagaagacaagttcaatcaatgcctttaaacgtttgaaaccagaatatttcataacaaagaaggaaaaggaaccaaaatattcagaacattcagcatatattatttccagtaccacacagcgaatcacagttttgcaccgagcaaaattaagaccggaagtgaattacatgaggcgacgccatcaccaatccctccgtaatttgcttcctcagcagctcctgctccacgatgttctgcggataccttgacggagcaaccttgatcttgggatccaagtcttcacagcactcaagagccttcctgtcgtacagggatatgtcctctaggttaacagcagcttccatgatgtgcctgatgtatccaaggaagttctcatttggttggaaaccatagatggtaaacttagtcaggttgtaatgcctgaaaccatcacgtgcagatgacctccactccaagtttgttttgtcgcagtaaccctgttcttcccgttccaccttgtctgtctcaatctcacaccaatggtcccaaactgtgatgcacatctccttcagggagggtgcggcctcaagaaagaaacttgtccaagcgatatcacattcttcagggagttcatccagattcaaaacttgcagattctggagaacaggcgtcaacagttccgggcactccggatgaacccaaatctgcagtacatatcaataataaaggattcagatttatgtcaagaacaaggaacaaataaccagagaggattgcttaaagtaaattaccttctcacttaagaaattgaggtgcaggtcttttatgaaggtgatattagcaaggaactgacttaacctgataaccttatgccatctcatggctacattagtgaggcttaggcttgaaagcaatggaacgttgccaaaagacaagggttcttggggacaaacccacacactaaaaaccaatcgtttgaggtttggtagggagttgagctcaactaggtctaagttcgcagtggagatatcaagctcaacaaggtgtgggtgttccaactgtagctgcaatacactatcctctatttgacacgcggacaatttcaaatactctagccgtttgcatgtggcgatgatgtttggaatgtcagcttcagcaagccttaagttgcgtaggtggagacgcgtaaggccggcaaatgcatcagtacaggcaccgaaaaatgtcatgagcagcttgccattgtggcggagatcgtcgatagagcaatatagtgcccgcttccctgtcagaataatgaattcaacgctgtcgaggttgtggctgtgggtggccattgctcgggcaacagctttgccaatggcgagacaatcatagtacttgaggtagaaggttatgctgagttggcgaaggggaatctcttggtttctgaaattgaggatgttgtctgttgcatctgacacagcagcattcatctgaatctgaattgcatccttggaggtggcataataaccataataatggggcaaaaaggaatgcagcgaaatgtttaagtttgagagcaaatgtcgaaggtggatcgtcctcttagaaaggaggcatgtcctgacagcgtcgggggtgttgaggcgttcgaggatgttgagcaggacatcatcaggaagcttggtgaacctatccactactagtaggtggttattgtgagctgctgatttctgcatcaatataattttgcgaaacaggattaagcaaatataacaagtaaataggtaaatgcaaaatgaaggaagcgaaagatgaagaaaaaggcttacattgcggttgcggcgactacccttcttattcttcatgatgctgatgatggtgggtggttaattccaacgaggtacggtgtgagtatctagcttggctgatggattggacttccttgttggtttattattgctatatgaaggccaacggcggctcttcctgtcctgtatatacaaggatgaggaggcgtgggcgaggtctggccgacgggcaactactactccatctccgtatcctaaagagaaaatccataaaatgccatcgacaagcaccctaatcctagaaatgccatcgacaaagacaacttcccaaaaatgccattgcacaagcctctttctcccaaaaatgccatcaccgtcaactccacaccgttacaaccgttatttttttaataatgactattttgccctcagtgcaaaatatacctagtttttactgtcaaagaaaaaaaatgaaatttctaaccctaaccctaccactaccgatcctgatctagcgctctccccggcggcgtctcggcgacagcggctcggcggcgatcccctactgcggcggcgcggcgaggaggacgatggcggcgacgcgacaggacgcagcgaggaggaccagcgcggcggcggtgcggcaagggcacggcgaggaggactgcagcaaggacgcgacaggacgcagcgaggaccaggacggcggcggcgcggcaggacgcggcgaggaggtctacggcggcggcggtccccgacggtggctcgatggctgtcctcgacggtggctatggctcggcggcggtcccttgctgcggcggcgcagcgaggaagaccatggcggcgacgcgataggacgcggcgaggaggactagggcggcgatggcgtggcaggatgcagcgaggaggaccacggcggtgacgaggcaggacgcggcgaggaggtccacggcggtggtggcgcggcagggcgaggtgaggaggtccacggcggcggtggcacggcagggtgcggcgaggatgtccacggcggcgcggctattgcaggatgtggcgcgggggccgtagacgccggcgaggagaggtccgtaggcgccggcgaggagggggaggagaggcctgcagccgcagttgctgaggtccgtggaggaggaagctatagtcctagctggtgttgcaactctgatgttgaaattttcccttttgtttgatttgatttgaagactttgtttgatttgatttcagtgaatttaattatgaaataacttgattgatagcaaaataatgatgtttgtgaatttataaactaacagaaatataatttattgtgagcaagcaatgcaaaatgatgatgtgtgagtaaatggttgtctaggggtaagattgtcttttcatgcaacttaacggaaagatgctaacggcagtttgacggtgatggcatttttgggagaaagtggcttgtgcaatggcatttttgggaagttgactttgtcgatggcatttctgggattagagtgtttgtcaatggcatttcatggattttctctatcctaaacggaggaggagggaaaggaggactctgaattggagtccgtctcgtcctagtctggaattggattggaggaggcacaagggcaagtgacgcatggagagagattagggttaaccttgcagagattttgctccggctccggccctaaggtggctgggcggcggatcaggggagacgctggcggccaactccggggtccccagcccggagtaacttagtgggcctatccactggtagggaaccagtggatgctgctgatttctgcatcgattgcaaattgcgggaaactaaatatattagtggcaggcagcgaaccaatgtagtactagtaatatgctcgtgctaacgctacgataatatttagtaatacaaataaaataatcaaaataccacatatgatatatcttttgtatctcaaatattaaatgagatacatttatgatttaaaaggtagaggtccccaccaacgtcgcaccaagctgacacgcacaaaactaacaagattatacccaaacggcacgacgtcacaaagattacacccaaacggcacgatgttacaagttgggtctccacccacattagttgcaccaaaccaaatactacacatacaaacctggaacggtcatacgtgtcgtatgtccgaacaagaaaaaaacatatctgaacaagtgggtcatgaaccgtgcacgaacattagattaccatgtggcgcttttggcagcacaccatttttaagcaatcctatatgattattcaaaacaattacagtgattcagcccataacttatacagtttgatgatagtatgtggatacgggtcatttcataggaatgtcacaaataacaatgttgtgttacatataatgcgaaatctgtcaaatttcaccaaagattttcacaaggctatttgagtcaagcatctttctaatgttcttttcttgtcttccggccacttttgtttacaacacctctactcggtgcaggactccattcttttttactacatctgtcaaagttaaggaagttaaggggaaaaaaaagatggttaccttgtaacagccactgttacctcgatagtgccatgctgctctggcaaatcgccatggcctccatacagctgctcacaaagattagagaccataatttggccaagctgaaaataataaaaatatgaagtattaaaataataaaaaaaatcaagcactcggtgcagcaactactgaacattattgaaagaaccagcgagaaattctttttggctcaattaaccgaaaaaaatatttgatttcccctgttccacgtgtagtgatattaatttgtagttcagcagcttcagcattagaaagctaaattcaattcttctggcaaccatatgtttaatagaaaacagtgtacttgtttgatatccaatgccaaaaccattgataaataaaaggaaaacagtgtacttgtttgatatccaatgccagaaccattgataaataaaagaaacctgaagcgagctaaattaaaatactgtctggcaaaggatgaaaacagacagattacctagaaatttattgaacaattttaaatactatgtaacataagcaaaatagtaataatcactcatcaacaggtttagccaaaaaaaaaagattagctgtgctcttctgttccaattttttttttctagatttcctgcaaattttagaaaggaatacagccaatgatctgttagtgcaataaaatttgttcagtgtaattcctgatgacctggtaaacaaacagatggtcggcgacgaagtccaccggcggcggaggcagcggcccatcgccatggggacggcagcagctttacttccttcttcattcacctcaatcaccgccttgtggatgacttggctcacaaacaacggcaagccggagccgtcgtcttccaccatcacggataggttggtgagctacggtgagaacggcagccggagccccagctgcccgaggacgccgacgacgctgtcggcgaaggacaccttgaacttgggcaccatgaactcgccaacccgcaccgattcggacgaggtgctcgtgcaggaacccggccgctatgccatcttttccacgatgccacgcagcccgtcgcgtgcgtcggggaggaagatgaccatggcgtactgcgtgaggtcgtcggccgccgcggccgcgcttgcgcttgttacggagattcggcgcgctgtagtggagcttgagcaccttgaacccgtcatgcacggcgacgtactgtttggactttggagttgctcgacgacatgtacgccggcgtcgaggcggtagaacggcttcttcttggtgttcttcaccaatcaccatgaagggatgctcccagctgccctttaggtagatggcgttgctgagcacgatggccatcgtcgggccgacggatcccggcggcaggacggagtcgatgaggcccctcctcacctgtcgcgtccactcgttgatctgcttcctcgcttaatttcccggccttcaagaaaccccaaccaaatcaagaacagtgtacaaaaatttaaaattatgatttgcatcgccctgaattggcatctggatatgattcattgattcatcgtgcagattagtaatggtagatactaaccttgttcttgaaatcgacggtggtggcctcggccttgtacctgccgacgacggcgtcgcaccacacgccggacgtgaacgcgacgcgcggcccacccgacgccgacctgtcggccagcgcggtggtcgccatgtagaacggcgaggagctcatccagagtgcagcaatgggcgaggggaggcggagcgatctaggcaccgcggtttgccggaaggagagcgcgtggcggcgtggggggcgtgattttcggctcaggagcgatggtttctgcgagtgggggatgcgagaggaggttgaggcgtacgtgggacgatttgaggcgttggattggatgattctggaccgttggatttgatgaatgagtaatgtaggtgtaagagtgtgttggtgaattatagggtagataacgaacgaacaaaacacaaaactaaattgatgtttttacagctagcaatgacaataaataatgatactatatatatatcacagtataagattggcggcggcggcttacattgcgattacggcggctacccttcttgttcttcatggatgatacacccttgttcttgttgcgtattcaatccgatggatcggtgtgagtattaagactctcctcctcttcctctcgatcagtcggcccggatcctatgcgaactcgtacatggatcgatcgagacagaagtcacctcccttaccttccctttttcgagatcaaatctgatgccaatgaaacagcacacagctatacctctgtttttttttcttttattcccctcgagtactacgggttctgttttgaacgtttggaaattggaactgatgaagtagggtacggtagggtgtatggataaagtaaggaaagacaggccggccctaaactttgggaggcccattggaagcggcggcccagatgagagcagatcccctgtcacgccgacgccgccgccgccaccgctgttgccctaacgccgatctaatgctggagctccattcgcttgttcttatactatacaagtacctatgccggtgatgtatagctgctgctgctggtgcttggattcggttgaatttcataggtatggtcggtcagctggaatagcagtcggtgtgggtatatatgtagcctagttcgcatcgggcggaagctgggaagggaagatctagttcgcatcggagccggaatcgaatcctcccttcttttcctcttctcctctccatcatcagtatataaacaatacgcgcagcgcttgtccggtcaggcccgccgccgttcagaagcttaacattggaattggattttattaaccaccatgaagaacaagaagggtagtcgccgcaaccgcaatgtaagtctcttttctttcccttccttaattaattaattaatttgcattattattattgcataataataatatctgcctttcctgtcgatccatgaattaatttcgatgcagaaatcagctcccgtaaccgtaatggtggtggataggttcaccacgctacctgacgatgttctgctcaacatcctggaccgcctcaacacgcccgacgccgtcaggacctgcctcctctctaagaggacgctccacctcccacgcatgctttcgcactttcgaattgccctactttcattcgcgccagatcctgattatatcacttttaaggacactattgggatgaacgccgccgtggccgctgcaacagataatgttctcaatttcagagccaaagacatccctcttcgccaactcagcatatgtttctacttgaaatactacgactgtcttaccatcggcaaagctgttgcccgagccatgacaacccacaagcttgacagcgctgagttcagaattctgaccgattataagctacattattacactcttgatggtctccgcaacaatgggaaacagctcatgaccttttttggtgcttgtactgatgcatttgctggacttacaagactctacctacagaacttaaggcttcctgaaactgacattctcaatatcattgccacatgcaaacggttagagtctctgcgtatgttcatgtgtcaaacagagggtactgtgttgcagctgcagctagaacaccagcggcttgttgagcttgatatctgccacggatgtttaaaactagttaagctcaattctctaccaaaacttgaacggctggtcttttatagttggaaacatccccaagaacccttgtattttggcaatgttccgcagctgtcaagcctaagcctcactaatgtaggtctgagacggcacaaccttatcagattaagtcagtttctttctaatgtaacctccataagagacctgcacctcaactttgaaagcgaaagggtaattaaattcaagcaagcctctctctctctctctctcaggttattaacacctcatactcatcttaacctgcatccttcctttatgacttgtttgtattacagatttgggttcagccagagcgcccgaaactgctggtgcctgttctccagaatcttcaagttttgaatctggaggatctccctgaaggatgtgatatcacatggacacgcttctttcttgaagctgcacccttcctgaaggagctatgcatcacagtttgggaccattggtgtaatattgtgacagaccaggtggaacgggaagaagagggttactgtgacaaaacaaacgtgcagtgggagtcatcttcatctaatggtttcaggcattacaatctggttaagctcaccatctatggtttccaaccagatgacaactttttgggatacatcaggcacatcatggaaaccgcggttaacctagaggagatatccctgtacaacaggaaggtggaagattgctgtgaagagttggatcccaagatcaaaattgctccgtcaaggtatccacagaccattgaggagcaggagttgctgaggaagcaaattacagagggattggtgatggcgttgcctcatgtaattcacttccggtcttaattcctcggcgcaaaaatgcaattagctgagtagcaataatgtatgctgaatgttctgaatattttggtttcttcttctttccttttgtgatgaaacactctagtttcaaacgtttcaaggcatgcattagaattctcttgtttcctgcaacttggtttcaggccagcagcctggatatataatgtaagcagtatattttgaatgttttgaatatcctggtttcttttttttgttgttgcaataattccccttatccttttccctacaactacaagagagcttgccatccagctcacaggtgaggcattgttttgttgaagtaccatcaaggaattggtgttcaatctcttattagtggcactagatacgtttggagaatccatgccctggtacaggcaatggagtttatcttccggcattcctttgcgaacaaaggaggcatatttctgtttcttcagtctcaagatgctactcattgatgcctctgttccaggcgcatcattcctagagatcttgccagtggtcagatttctccctccctgtttaattaagagaagttctactcagtggctgcagggagatttggcaggaaatggagaccagactcctcagttgaggactacaatggtacatcgaaaacaaaggatttgagaacaggcagaggagatacagaacagggaggttttgggtgctgtgaggatcagaggaggcgtcacaagtcgaggggcgaatctttgtttaccaataaaaggttatgctttcatttatcttccattgttatctatttccttgtaggtagagatgcgaatgcgagttccaaggagtgctgtcccaaatacctgtgacttcaattatacagttttagaagttatgtttttatctaacttcaattgtgcttgcagttttagaagataatgcttcacaataagaagatagttgacacactagagggtaacattttatagccccccccccctaacattgaagtgggtgtttcacttaatatcttgccctgtatgtttgaaaagggaggtggatgatagccatgtttgataattgattgagcgcattctaacgaaaatatacatgaatagataaaaatacccactgccgtagattgatgcttagacactttgttaatttgaaattgccatagagagcttatattgatcgagttaaacagcatgcagctacaatttttgtcccaactttttctgctttatgaactcctaagttgaagaaagttggtttccatggtaaacttagtggataaccgagacttgaacttattcattaccttacattgtgattgacacttgagctgttcaatatattttgcttattccattttatactatgtatctctgggagaactattcggctaatttagttttattttcctttttagctgttatggcaaatgcaattctcatcaatatctttatattttattgatggttgacgacagactttgttcaaacacattgttgaaaccctatttaactattcgctctctcttggtagggaatcattgtgatatcatccaaacagttcaaatttgacctttgcattgcagccacatgcaattaggagctagcgatcaacatgcaaatacttagctggcatcactgtaatgattataagttcaaataaatatgaatcactgctttgagcttcaatttgttgttcactgacagtttctttacactatcttctctaaatatatctattctgtacttctattacagcttgtgatgtctgcgataacctgaaagtgctttgtcagagttgagccaggctaagccatcaataatggctcaggtattaaattaaaaatttattactcaaactctcatggatctgttgacataatccaaaactgttttgagaaataagaacccattcttcgtagttttcttgtcttcatgcaacactgaagctgtgaaggaggtgccaattgttctgaagctcctatatgatcgggatgccctggatgaagggtcaaggagtccctggttatgaagaatgccaagccaattcatggagtggctccggagtgtggagtatttccagttcgtgtcatcgtgtgtgattgtcccaaagtcataagtactagagcctggggcgcgcccgttggcgcgccgcctgagtggaacattggtgaagaggcagtggatgattaagcctgagtggaatgatggtgaagaggcagtggatgattagggatatagatgggaggaaagaataagcaagttttggttaaaaaaaataagaaagcaggcactcatagagaagcaaactgcagctaataagatatagacatcttaatacttagtggtctctagtagtaataggcacatatacagatggtctttaacatctgcaaggtagtgcagtatggatggtaagcacttatggtcccaatgacgcatatccaatttcatcacttgtcgcacggcacaatgggctcatcttaaattaaatttgaatatatcaatacacttctaatataaaatttaaacaattgaccagaatggtgttaggatctcaagtttttattgtcgagaccgctcatgttcagaattcaggtatgcactactaatttcgtactaacaaatgaatcaactctatgtaattgtttttcagtactgtataaatcaacatttatgctcacattcttctgaaaaatgtatacccacttcttcaatattatgtccaaacaaagggaaaagaaaaggaccggcttattctcagtctatcctgctgtcaatccttcatcagatgcatgttatgttctcacttccttccaatcttgcccttgcccattgtgatctactgatctgtaaggctgtgagaacctttcaagagagctattgcctgcacaacatacatatgaaccaatttttcattagttcctgggcccgtgaaaactgagtccatctggtcagaaagaggtgctccaaattgcatcatccccttccttcatcttgagtgcgcataagcttgctagctggattacaaaccactccacactgcacctctaattgttttccaccgaccgcatggttgcttgtttcataaagaaaatgttagcagttggtttggtattatagtgatcttcagaaatggtatagggtatacaaagcaacggaagaaaactgatgtggtggtgttccattgcgcatatctgtcattgatgcttcaatatttacactgcccaagttatagaccacctcaatttcttaaatggagaacaaccccaaagcatgttgcttgactgctattattactgaaggcatgtattttttaagggatatattttttacacggtgttcaataacatactttgaacctattattacttaaggcatgtattttttaagggatatattttttacacggtgttcaataacatactttgaacctattattactgaaggcatgtattttttaagggatatattttttacacggtgttcaataacatactttgaccattaatttattccatgttatgctcccaatgaatatgaaattagcatcatatgaaaggacttcaaagtatgaatatcacgagcttgcaaataagcagagtggtagctaaagcgacaacccacaaaaaagatcaatgttgcagtgctgatcaatttattttcactccttgctgcgaatcatctaaaaacctggactactgtcatattacctgaagatgaattattgcgagctgaacatggaaaattctggtatgcaatccaaaggtgtcaaacctgacatgaaaaaggaaaatgatcagatcaccaaagaggctcatcataccataccatcctcaatcttaagtcaaccaaactcatattatttgcaattgactgaaacctccgcatgaattcattattttcgtctctcttttccttatgtctatcaagaaaccatcagtgacccattgcagtcccatttaaagtatttaacatttaagaaaacattcagtacagtaaaatggaagattgagatttgcatcttctgaatattagtgccaaatataaacccatcctgctaccagttgtactaaaaaaaattgactgccaataaccaaaatgctaactactaaaaaaatcatccagtatgtgaagctcctaaatttttccttatgctactttgtaaaactatagtacagagtttctggcaagaaaattggttcccaggtcatccactcatgatggatcagcaagcaatatcactgcagtctcattttccagacaaaaaatatagtgttaggaactcatggagttgattttgtaagatgcagatgagcaacattcagccatcatacagtaataaatcgaaagaaactaagatttacgttgttaaagaagataaccttggatgaatcctaattcaatcataacaaagccaagaatcataatccagtcttaatgaagccaagaatcctaattcccagtgtaccttggatatgagattgatgtcaatggaggtgcgagcaacagtcgacatagtagttgaccctagttccgaggcacgcactatattgccaaaaatagaacatagacaaattacttcttcaaattgcagtgaaaattcatgcattattcattagagggtaaattaccattgattcagagatggcgatcgttgccatttgttcattttagtctatgaatcattgtgttcattttaaactacaagaaccgcatgtggagggagtgaaggggcttgtgcttcagaataattttgatgtgtttcgtgttgaattgaatcttatttaaccctagcagtggtggattgagcttggacttttgggggctacgaacaaacaaaacaagagaagagcttcatccagatgtagaagagaaggtaggcttaatgcaagcaaatttgagacaaaagtaggtgtgagagagagagatgaatcacagaatcagaaagaggatgtggatgctcaccgggatgcagcaggaccacggcgcccctcccctcccctgctgtgctctgcttaccgctgacattgccaccagcttcggcttctttttcggccttggctccagctgcggccactctcacgtcgtcctcctgtggatggactccaacctcgccccgttgatcgttgcgagatgtttccttaacaatagattatatgtgctttctgccttatggagcagaaattataagccagcagacagcaagcaaatataccatgtcaagtaaataaatggatcagttaattgatatcattgacacattcaagaggacaaacttacagggttgtgcatctcttcacttaaaccaaaattttccagaatagaagcaaccaatgtggagaaatagtgtacagcataggagccaacccctacctgaacatcggaataccaatgatatgtgatgtaaccagaactaattgcaatttcctgaagagtgtgccaacacaatttataccagaaagttgtgggcatatggaacttaccgcagatccataaattgtgaggtaaaataaacttttccttcccattggtaacaatttcatcccctataatgaataataggtcacaccaacaatcaatttgatagaacacatttttccataagcaaaaaaaaatcctagttaaaattgagtcactgaacgttccttatcaaaagaaaatggtcttacttcttggtcttcccacacagtttagagttgcctcatggtgtattttacaacaaactaacagaattacaacgaaaactatcttcgctaattagatcaagagatttctatgtttagaatggaaattctataaataaactcagagtgaggtgtttaataacaaaatacagtaagttaacttaacaatttcatatacttaataataagcttgatggaagttcccaataacaaaatgcagtcagttaacttaacaatgttgtctgctgataagtaatcaattagaccatcatgttatgtagaagactgtcaaaaaaacacagaaaaaaaataataataggacattggaaccataaaattttaagatacaaacttacaaggggattatgaaacaaaacaaatatgcgaaccatacgaaaat

SEQ ID NO: 9274 - DNA, 16304 bp, Oryza sativa
tcccatgatacataagcgttacaagtaaataatgatttacacagtacagcaagcagtgcaatggtttctacaaatataaccgaattttaatttcataggcaaatgaaagacaagcataaattctacaatgtcagataattcaaattgtattgtcatgctccactaactaatgattttaatggaagaatgttgaaaaaaaagtaataagatttctgccagaaaatataagtttcagttcagtacaaaccacccataccaagagaatagcaccagttttgaatgatccaagtgatagcatctcaattccctgtaagataaagagaatcagtaggtttatctccaagaagtttgggaggaaaacagaacatatttgtgaagctcttgaaccatagtcatttcaataatgcatattaaccttatatctcaagataagacaagagcatacctgaatgcagaaagcaatccccaaaacattgtttgctagccaatgcttcttcgcagaataccatatgcaaaagaaaaatcctgggattgatgtaacaacttgagacttggtaaactccactgagagcgctgaaataagaaattaatgaacttaaaagggccaccaagacataagcttgtaacatgattcatgattgcaccaatctgacagatacacatgcaacaatctgacatatgatacacaattgcaccgatgattgagcatttaaaaaaaaagaggtttgggtcctacagacatacagtggaaaaatgcatcatgctgaacgatgaaattatcattccattcttttggaagaaatcatttcatggaaggcagcaatgttgcactgcatcagaaaaaaaaaagcacataaacaatcttaattgcacaaatacaatattacgtagttacatgaatggaaaagctactatatcatccaacctgccagcttttgtgtacatcattgattcattttcctaatgatctgcaacaacaacggtgaaaaaaatgattatagagatttggtgggggcaattagatgagatgaaggaaggggatattagatataaggatgtaccgtgaataaggcactactggaactcgccttcgatttagcacaacactaatgaggtaaattagaacatggacaaccagacaactaccctacccctgcatcagaaatatgaagctgcacagatgagcttttatctcagctgtcataagcagtgaagaaaatcaagcaaaacttgtaattgtaccaatgagtgagatggacagatggttgcacctcattaaaaataaaaaggcccaaacctcctgtccccacctgatgctggcctcctcccttgttccccatcacatcgctccagccgctgctgccatctctcccgcgcaacatgatcagaaatccggccaccctcactgcatgcaaaattgaagctcatcagaaacgactctgtgcaacaaagaacaaccaagcaactcctctgagcacagccttgccacctcttaattatcagtgcatagtgatgtacacattcatgaaacaaaaaaaatatccacagctagagaaacacgcaacctttgatcgtgcgaacacgataaaggatcagtcattttgtgcacctccattatcctcatatactgtgaataatagaacccgtacaaattgggatcgtgctgcatcagtaaagaatcggggatgagaggagatttcttcctgtaacttaccgagatggccactgggaagagccttggggatggggcttggacgccgccagccacctgcctcatgaccgctatgagcagcggaagcagcagggcgaggaaccgccaccaaggttgagcggccattgctgtcgccgattgaaccggtaatttttttctctgttgtgaaagggatgaacaccgcggcaaagacaaggggaaggaggatctgagacccttagcctccctgttgcagccgattcatccccttgtcatcgttgacaatggcggcaagctgctcaaggagagctcgattctgtgtccgctagatcaaccacaagcaaaagtcagtattgcttgagatcacaacacaaaatcatcatagctgcacaaaagacaaagattggcatcgattaccttggcccttggggcgaggcagcccatgagagtggcagcggcattgccggcgttgttctcctcaataaaactgattgtggagttcattacgagcagtgtgatgatgcccacgaagtcctgccagcccggcagcttccctgaaaacaccaaacaaatcaaccctcgtcaattcaatcaaacctctcacaatccctcacatgccatgctctggaacatcatgattcattaaattcattactacttactcctccattggcaagagcgatggccatgatcgccgcggcctccatgacccaggacagcgggttccacatgaacctcaagaacttgctttcctgcacacacacacacacacaaacaaacatgaaaaaaaactctgcaccatcgaatcgattcctaaacagaacaagaaactttagtgatggatgcctgggttagcctccaaacataaaggccattactatgaaagagctgcaagagagaaagcagttgcgggtggtcccagaaggcttggattgcacagattctaccagaggatgttgagatgctcccattgcaactcactgatggagaagaactggagagctcagctagagctggaggaggtggtagtaccagttccctactggtaccagtggtggcttgatcacttcaaattggagggactattgggccaaattcctctactgaatcttgggagagaaactacggattgggtgggtcaccttcttctccttgagcttgttggggccgaagaggttgaggcactgctcggcattggtggaggtgagccagccggagacggcgatcgacagcgacgacggcagtggcaccgcgaggcggaggaggccggcgagagcaggaggtggcaccgcgatgggcaggcggcggcgccgtcggcgtcggcgtcggcgggggtggagaagagtgttcgcctcctccctttctccatgttcacctcgaagcccacgctcggcggaaaggcgtcggagcgaggggaaggcagaggtgaagcagtcggagactgcgacacgacggcggcgtcggtggaggtggaagcggcggcgcgagggcgaggcagatgtggacgcggtggcgcgaggcgacggcggaagtggcggcgctcgacggcgacggcgacgacggtggcggaggaggggaggcgggcgacagcggctagggttaggggtgagtggaccggcggcggaggaggaggatggttgagggagagggagagagaggaggagcggcggcggcgttcggcggcggcgcgagggggaggcggtggcggcgcgagactgcggcggcggcggtggcgcgaggcaaggcaggagagggagagggcgagacgggagcggggaggggaggggatgcaggcggcggcggctagggtttgggttagtgcgggtagtttagcgaaaagcccctcaagttttaagttttacagcgcggtcctaactcgcgtactttccttacttctcatgtaatatccatattttttaagggtctttacgaaaaataacacctcacaagtactattctcgggggactgcggacgaattacgcgtgaaccagagggctttcgcaaaaaaatacagtagaaatcctacgtggatacgcccagaactcaccccatccgccacacttaatagtctctaatttccagtctgtttgtgtgcgtttcttatcttatgagtaatgttggtcaatacagccagacagtcctgggaccggattatgtggtgccatatctcctggcggttgactttttatctatcgaattgttttactcctgaatctggtggagtatgtgtgaatggttaatacccgaatctcgtgtactttaggttcacaagaaaatattgatgacaagagcacaagattgacgtgtttctgcagtactaaaacttgtttttgggtaaccaggaggagcagcgaagcaaatctttttcggttccctggctatactcgtggagtgcaattgtaaaacacaaccgcaaaccaaacctttgaaacaaccaaaacacacagattccagggcacatcccaccagccaaggacaagtagctgtgcccttcgaaccacatcagaaaactagcaatcccaaacggagcaggacatcaacatatttccagagttgcaaaaaaagcagtatcacatacagcagcgaaatagcgtatggttcaaatgattgttactgctgctgaattgtcttcgtgggtaaccgagtggcgtggttcagctaagtcgctaccttatagttacaacttaggtatgttcaaaactcaaccacatagaacaaaaaacgtccctactacaagcggttcaaaattacttggccccacggccacgggcccttccaccagctttgacgcctttcttctggctcatgtatgcctttcccatcttccctttaccttcagctgaaaatattggtcgtacagtgaagagtaaatgagacacctagtagttaattagggggataaaaaccaagataaaataaattatagttgcatttaacaagcgaggtcaaattcagagtcctcaatcagtaatggcattcacaacatgaaaacatttcattggtccaattgtacagtgtgaagagtaaatgagacgcctagtagttaattagggggaaaaaccaagatacaataaattatagttgcatttaactgtgaggtcaaattcagagtcctcaatcagtaatggcattgacaacatgaaaacatttcaacacaaaacaggagaatgatgtccaaacattaaactaaaatttctataaaatggctgcatgtgcttagaatataaaaaaaccagcacatgaagatatatctataattctatataactagaagacactccagatagaaacaacagagaacatgaagatatatctataattctatttaactagaagacactccagatagaaacaacagagattaaaaaataaaatgttgttgaacccaatgaccaagttaactgttcacaacatgacaagttgaaaatttgaccagtttactattcccttcatccaaaagcttaaaacctattccttttgtcacgaataactcatccgtcatgtgacaaaaccaatgaaccattgacatacatgcagccaataagactattccttttgtcacgaacactaaggtaacccattcgacaaaacaaatgaactatatacataaatacagaccaatagatagcttcacaaacacagtgacttaacacagttaggcttattgaggaaaggcagcagcgtaccacccagagcggaggcctggtccctcctggccaccagaggatcgtcgaaatacccaactgcatgcaaataaacagtatgaggcacaccacaacgaagcaaaggtcatgtaagcaacgaggcacaggtcaggtaagcagtgcaaagaacttaccggagggcatggggtagacgatgaatgcgaaaccggacttagtcccgacgagcgctcctttgcggtagcgcgtgaacttgttctcgaacatgacctcctctgtgtcctcctccttggtggccatggcttccctgcaagtatcaaaaaagaaaaatcaaatcaaatcagtactaaaatgcatgagatccaaatccacgcccaccaaaacgcaatagcatacgagaaatcggcaagcaagagatccaaatccgcaccaaccaaagcaacaaatccgcacgagaaacaaacaaatcggcaagcaagagatccaaatccgcacccaccaaaagcaacaaatccgcacgagaaacagcaaatcggcgagcaaaagactagggagatccaagtcgcgaataccacttaaactcacagggaaacggatctgcaataacgaagaagcggaggccgaggacgagagacacacacagtgaaggcggcggcggcggcggaaggtggagaaatgatgctggtcgttccttttatacctataaaacctgggccggcccaaacctagtgcctcgtcttttgccttatgtttttatgtttgtaagccaaaatttaaattttctatcttaaatttaggccatgtttggttctataaaagttttactgttttcgagcacttttgctataatagatctaaacactagagttgattttagggttctttcatcgtagcttatttttcagcatttgcttttatatcgttaaaaacacgtatgtaaaaaatttatttataaattattttccgtttgcaaatatgccgtcaataagcagaacgatagagtcctaatatagttttgcgttgaataaaaaagaacatgttgcaccaaatattgaaaaaacaaaaaagaaaggaacatggatcaatggatggatagaacaccaaccaatctcgatagtacccgtaatatatcatttgatctctaatctaacaaagtctcgtgatcaaataacatatcatttgatcagagacgactttgtaagattggagtggaggcgcgaacgaggtccggcgccgccgcgcagatcgatgacgccggcggacggtggacgactgcggcggacgaatgaatcgagacaacttctcttctccatgatggatcgtggatgaatggatggacggactgaccgagtatatatagagccttcaatttggtgccttgtatatcgggtccccgtaacggaaattgaccatttaattcattctatttatttcaattcggtgccttatatattgggtcccagtaacggaaattgaccatttaattcattctatttattcgtatgccaaatcaaatcttcactaactaatttctttccttgtttcccagtaacggagtagtattgttattaaaacaccgcaatcagcgccacccaatcacaattaacaacacctacttataaggagtaccatagttgggctaacggcttggcccatggcccgtgtacgtacgcttagtacagatctgacaaattcgatatttctggcttagtaagttaaggctgcatttgatcatgcatattagaggttagtttttaggacgtgaaaccaaaaaactcattagcacttaattagttaagtattaataaatttttaaaaagatttattagatttttaaaacaacttctatgtagactttttattttgcaaattacgcaccatttaatattttgaaatatgtgctaacggagaaggagagagctgacgtttgaagttggagaaaagaagcatgcaatggtcattaatacatgtctcttagtcttactattaattaggaaaatatttcttcggtagaaaagacacaagaataggaaaggcaaacatcggttcaacattaactcttattttatataaaatgaaaatatggttgcacgaggatgaaaaaaaaataaaaaatagtaacaaaatatatatttttccatttaatgattacaatctctatatatgatctctaaatagggtgtgtttagttcacgctaaaattggaagtttggttgaaattggaacgatgtgatggaaaagttggaagtttatgtgtgtaggaaagtttatatatgtagaaaaattttgatgtgatggaaaagttgaaagtttaaagaaaaagtttggaactaaacaaggccataatcttgttcttatctctactttccaactcacctacctcgttttctgcgcgcaggctttgcaaactgctaaaggtgtgtgtgtgtatatataaaagttactataaaaatcatattaaccctttttcaaatttattttagctaatacttaattaatcatgcattaaacgctgcttcgctttgcgtgctagggacgatcacacccttaaacatgccctaatagcattcaacgaaataaaaaacttccttaaattttatcagtaatgcagtatatttttggccatgtatgtacaacaataacaataacaataatatgcctatatacggccggcacagctacgtacatactcccctcattttaaattaaaccaacctagaaaatgatttagtctgtgtattttaggttgatttattttaatattgaggaaatatgataagtagtactcccatattagggccgtgtttagttctttttcaattttttttaaagtatacggatatacatttgaattattaaacataggctaataacaaaacaacttacagattccgcatgtaaacggcgagacgaatctattaagcctaattaatccatcattagcaaatatttactgtagcaccacattgtcaaatcataacgtaattaggctcaaaagattcgtctcgtaatttacatgcaaactgtgcaattggttttttcgtctacatttaatgctccatgcatatgtccaaacatttgatgtgatagaatttttagaagtttgaagtgaactagtttagtttcacaccaaaattagaagtttgaagaaattgaaacgatgtgattgaaaagttaaaagtttgaagaaaaaagttggaatctaaacaataccctatgtgagtgtgacacatctaatatgcaatcaagatagatcgaaaagacagctacagtcaaaaacaggcaacagggcagtttcttcagtcagatatgatcgacgatggcagatgaccagatgtattgcgagcagaatttagagtgtgtttagttcacattaaaattgaaattttggttaaaattggaacgatgtgacggaaaatttagaaatttatatgtgtagaaaagttttaatatgatggaaaagttgaaagtttgaagaaaaagtttggatctaaactcgaccttagaatgacatcagtatatgaagtgtactacatacctttaccactagtaggctgtgtttagttcagcacaaagtttagattttgtttgaaattggagatgatgtgactgaaaagttacgtgtgtatgacaggttgatgtgatggatgtcacaccctgaagttctcctcccaagcttaaaattaaatttataaatgaccctaagaaaataccggtgcaaatcaagataaaaccctaagaaagtaatacaaataatacccgcgccggtcaccactcccgaaaccgctgccgccgcgccccacctcccccgctttccccgcgcccacgccgcgtcgcctgcgcccactccacatcgccgccccctctccccgcgtctcccggccgcgcctgcgcacgagaggggcgggattcaattttgaatcccctcccatcttctctctctccttccccacgtcgccggcgaaatcggagtatgacttgctgagtacagtggatagtactcagtcttgctctatttttcccccaaccccagagtacgagtatgtgtccgatggtgggttcttcgaggagtaggcttcatccgtgcagtcgaggatgcctatggagtgatgttcccgctgcagtttaagtcaaggcttagctcctgttacctttctttttcccgctgcatttatgtaagacttttataatgtttgtaagacgtggatctgtatgtcaacattgtcgtttgtgtaccccggccggtcctggacgggggttttaatgcatattctgcttggaattctattcgggaatttctgggcgtgacaagttggtatcagagccgaccttgaccgtaggacaagccaaatggaaaacctaagagccctctgaattcttttcattgcataagttctttgcaattggatttgttccaggaaaatttgggatctgttctcgtggttcaagggaaaaaaatcttgtcgctcgtttaagggaggtttgccaaaacaagtcggtctagggttttagtaaaattatttgagatgttttgaccgtcagtcgggattggatgggatttgatgggcgaaatgcattagttcttagctcaggaatatgagttgtaaggtatttatgcttttattgttattataagtatgtatctaatttccccattatcttatcgctatgtaagtccgtcttatttattcgctctcatgcaaaataatctatgcataaaatttcgctcttattcgattctcttatttgagtcctttattgctttatttaatttggatttgagcatgcattgatcctacccctttgtcttctctagatggccgagcacccacccaaccaccgcggagaaggcatggatgacttcgtggcagagttggcacgcatgacactggtggtgggctaccccaacgcgccggagtacacgactgttccaccgctcagtggcgagcttcctcaccgtgtccgcttggaggtccatggttacgtggggacttgcctcgctaacatggtggtcgaggcgtctggagccacagcagatcacgcatgtcaggaggcagcatatctgatgatggccagactgcgggagcgccacaactacatcttccacaacacggtgtaccgtttccaccctcgtcgagccaacgacagtgatgtcagttccttccgtccgacagccggcgagaacgacaccaccttcagtcacgtgcgctgtgatgagggggatggacaggatgcactcggacctgcacaaggcgtccaaggccttgaatgatgggaagctcatgaggatcgtcgctctgaaggacgagatagcgcgcctgaagagggagaatgctcagttgaagggtcttcccgcgccaggaggagtccagatccgcaccacgcctcgcaagtcgacaacggcacccgtgcgcatccagcttgcgcccaggaacccacctccgtcagcagctcccgcagcacctccagttccgcccgcagctccagcagttcctacagctccagcgccagccccagctcctgttcccgtgtcagctccagcatccgctctctccttcgcacctgcatcagccgtcaggggccccgccagtggcaatgggggttggttgcctgctactcccagtggcagtcgcgaccgcagcagcagcagctccagtggcatagagccgggcagcggcgagacttatctgccaggctccaggagtcgctcagaggacctggtgacgagcaggaggacgccttcaacttcaccgaccgcaggagccgttccgagcattaggctcgttttccattagcttatcgactgtctagcttctgcttgttagtttgtgtgtttaggttgcttgcttggggtcagttgacagtcgatatcatgtgcctatgatatggctgtcttaataaggatttttgcttgctgtttaaagtattttaattcagattagaacaattgcagtttaaatttctatataataaagcttagttcctgagtatctgtttttctccgtttccccgtctgctcttcctccagatggtctacaccaggactggcacccgcacgacaggcgagggcagcaacggcgaagaacgcgctgatggtgtgcaccccaacagtgattccggcaatggtccgccaccacttcccgagaatccgacgctagcccaagttatggcacatcagactcagatgatggcagccatgatgcagcagatgcagcagcagcaccagcagatgcaccagaggatgctgcagcacgctgaacagcagcaccggcagtttggtccccctccccctcagtccaagttgccagagtttctacgtgtcaggccacccaccttctccagcaccaccaaccccatggaggcgaatgactggctccatgccatagagaagaagctgaatctcctgcagtgcaatgatcaggagaaggtcgctttcgccacacaccagcttcaaggtcctgcgtcagcttggtgggacaatcacatggccacccgcccgccaggcactgaagtcacttgggcggagttctgtcgtagcttcaggaaggcacaggtgccagacggggtcgtggcacaaaagaagagggaattccgggcgctccatcagggcaataggacagtgacagagtacctccatgagttcaatcgcctcgcgcgatatgcaccggaggatgtccgcactgacgccgagaagcaggaaaagttcatggcaggtctggatgacgagctgaccaaccaactgatatctggggactacgctgattttgaaagactggttgacaaggcaatccgtcaggaggatcagcgcaacaaaatggacaggaagagaaaggcggcacagttccggtccaaccaaggaaaccatcagcgaccgcgtttcactcccggacagcagggtggacctaccaccatgatcgtccgccagcaccgcccgttcaactccagcaacttccaccagggcgctagtggcagtcagaaccaccatggaggtcagcctaaccgcggtgcagctccacgcccaccagtggcaccagcacaatcaggcccgtccgcacaagctaaggagaccgaagccaaacctgggtcctgtttcaactgtggtgagcttggccacttcgccgacaaatgcccgaagcccaggcgtgccgggccaaggtttgtctaggctcgtgtcaaccacgcgtctacagaggaggcgcaagcagcaccagaggtcgtactgggtacgttccctgttaactcaatccctgcaacagtactttttgattctggtgcaacgcattctttcatttcaaagaaatttgtggggatgcatgggttaaggaaagaagagcttagtacaccaatgagggttcataccccaggaaatagttcaacctcagtcaattttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccttgaccaacgagaagggagaaaccgtggtgtacaaatcactagtctcaccaaagcaaggggtctccttgaatcagatcgagatggaaatcccagtggtcaccgaggagaagaattcgaggaagttggaagagattcctatagtctgcgagtacccagaagtgtttcccgaagatctcactaccatgccacccaagcgaaagattgaattccggattgatttggcaccgggaaccgcgccaatttacaagagaccgtacaggatggcggccaacgaattagcagaggtcaagaagcaggttgatgagcaactgcagaaagggtacattcgaccgagtacttcaccttggggtgctccggtcatttttgtggagaaaaaggataagacgaaaaggatgtgcgttgattatcgcgcactcaacgaggtcacaatcaagaataaatatcatttaccgcggatcgatgatttgtttgatcaactgaagggagctaaggtgttctctaagatagacctgcgatcaggctaccactagttaaggatccgggaagaggatattccaaagacggctttcaccactcgatacgggctgtatgagtgcacggttatgtctttcggacttaccaacgcacccgcattcttcatgaatctgatgaacaaagtgttcatggaatttctcgacaagtttgttgtggttttcatcgacgacattcttatctattcaaagtctgaagaggaacatgagcagcatcttcgtctggtactcgagaagttgaaggagcaccaattatacgccaagttcagcaagtgtgacttctggttgacagaagtcaaatttctgggtcatgttattacagctcagggtgtggcagttgatccatcgaacgtggagtcagttaccaaatggaccccaccgaagaccgtgtcgcagattcgaagttttcttggacttgctggttattaccgccgattcatcgaaaacttctccaggatcgcccgacccatgactcagttgcttaagaaagatgagaagtttaaatggacagctgagtgcgataagagctttgaggagctcaagaagaaattagtatccgcaccagttttgattctgcccgactagatgaaagacttccaagtctattgcgatgcatcccgccacgggcttgggtgtgttctaatgcaggaaggcagagtggttgcgtatgcctcgcgacagttgcgtccacacgaagggaattatccaacccatgatttggaattggcagcagtggttcatgctttgaagatctgggggcactatctgattggcaaccgctgtgaagtatatacggatcacaagagtctgaaatacatcttcacccaaccggatctaaatctccgacaacgaagatggttggaattaatcaaagactatgatatgagcattcactaccacccggggaaagccaatgtggtggcagacgcattaagcaggaaaagttactgcactgctctatgcatcgagggcatgtgtgaggaattgcggcaggagtttgagcatctcaacgtgggaattgttgaacatgggttcgtagccgctctagaagcacggcctacgctcgtcgatcaagttagagccgctcaaataaatgatccggaaatagcagagctgaaaaagaacatgagagtcggaaaggctcgggatttccttgaggatgagcatggcacaatctggatgggagaaagattgtgtgtacctgacgacaaggaactgaaggatctgatactcaccgaggctcatcagacacagtattccattcacccaggcagcactaaaatgtaccaagacctcaaagaaaagttttggtgggtcagtatgagaagagaaatagctgaattcgtcgcactctgcgatgtttgccagcgagtgaaggcagagcatcaaaggccagcaggtttactccaacctcttcaaattccagaatggaaatgtgaggaaattggaatgaactttataacaggactgccccggacatcattgggtcacgattcaatctgggtagtcgtggattgactcactaaggttgctcactttataccagtgcataccacctatacgggaaagagattggcagagttgtacctggcaaggatcatgtgtttgcatggggtacctaagaagatagtatctgaccgagggagtcagttcacctcaaaattttggcagaaactgcagaaagaattggggacccgtttaaatttcagtaccgcctaccatccgcagacagatggtcagaccgagcgagtcaatcaaatcttggaagatatgttgagagcttgcgctcttgacttcggtggagcttgggacaacagcttgccatatgcggaattctcatacaacaacagttaccaagccagtctacagatggcaccgtttgaagctttatacggccggaagtgccgcacacctctcttctgggatcagacaggcgagcgtcaattgttcgggacagaggtattaacggaagcagaagagaaagtcagaaccatcagggaaaggttgagaattgcccagtctcgacagaagagctacgcggataaccgccgaaggaagctcacttttgaagcaggggattatgtgtatcttcgggttaccccgctccggggagtgcaccgttttcaaaccaaaggcaagttagcaccacgtttcgtgggaccctacaaaatcttggaacgaagggggaagttgcttattagctagaacttccatccaacatgatcggcatccatgacgtgttccacgtgtcccaattaaagaagtgcttaagagtacccgaagaacatgcagattcggagcatattgatatccaggaggacctgacatatgtggagaagccggttcgtatacttgataccagcgaaagaagaaccagaaacaaggtcaccaggttttgccgagttcagtggagtcaccattcagaggaggaagcaacctgggaaagggaagacgagttaaaagccgcccatccgcacctcttcgccagctcctccgaatctcggggccaagattccgtttaaggggggtaggtttgtcacaccctgaagttctcctcccaagcttaaaattgaatttataaatgaccctaagaaaataccggtgcaaatcaagagaaaaccctaagaaagtaatacaaataataatcgaatctggcatgtggaatttttcttgagttctacatgtcgaaattcactaacaagatttttagtggaatttttagagccctagaaataattttaaccaattaaaatggagcatgcaatattttaattccagggaaaatccttttctcctttttctttttctttttcccttccctttccgaatgggccgccggcccattctctcctttttctccccctcctccccgctgggccggcc

SEQ ID NO: 9275 - DNA, 20752 bp, Oryza sativa
aattcgcatcccctcgcgctccggtgagttcaacctctaccgccgccttcggccatgaatgccggtcgccgtggttcatctcccttcctctaatctctcttctccttccttagggcaccccgaatcccgtccgccggttgccgtcgtcctcccgtggctcgccgtcgccgtcgtcttcctccgcgccggccaccctcggtgaggcgtcctctcccctctattcccctccctttcccttctagccgccgctttagcgccgccgcccgttagccgtcgctttagcaccgccgcccgtcggcgccccctttgcgccgccgcctccgccgccggttgccgtcgccggcaacgcgtgtgcgcgcgccgtcaccgtcgccgtggccgcttggccggtcttgagccgagccgggtcgccaccgcccgtccgatcggccccgagggcgatctgggccgtcggtcccgtggaccggcggtggaccacccgcgtggtcccggtcctcggtgaaccgtcccccctgagccactgccgagtgggctcgcgtgccggcacccctttcctccctctcccgagccgctgaccagtggggcccgcgtgtcggcgccgccccaccccgtgctgacgtcaaccctggaaggctttattgcgcaataattcattagggtttttcttttatagtaataaacacagtgaatcttctaaaattcataactaattcatccgagctccgtttaagtccattcaagtctcagtaaatcaagaaaaatgtgtagaatccattaaaaatggttttgttccctgtttcagtagtcttatagcctgtttgcattgtttgccttgtatgtcgttagattccggctcttctgacgctccggtgtacttcgaaatagtcgccgaggttcctccagcagcagagcaaggcaagtcatgcttgtcacttgatcatgttgatcctacattgcaaatgttctattgttttccttcaaatactgcatttattttgcaataacactatggtatgattatctattgttacagccatgctattttgataccatgctcctttgttagcttgggttataacatgaatagactttggactaggaattgcttagccatgcttagttccactagcacacaatggggagatctcattaaaatatagactttaggttcaattggtaatgttggtttagtatcaccattttggtgttggttaattaaaatgaatcacatggtgggctgtgggtgcatggttttgctggtcgcacccatggcatttaaggaccggttcgcgggaaacactggaagaacttatcgtgcttaccacaagccagcgtgggcaacggctgggcttgtagtataacttttctctagctgacgcatccaggcaagggtgggcgtgatggagtttggatgggccctgcgacggcctatgtggcttccggattcacctaggcacgagaggggactgcccgtcgcccgctggggacgggggtgaaacataagttgtggtgtgcttggatagagagggttatgcgaagggtcctgtcacggcctctttccggtatgtcgtggtggcatgtcggcgcacggaaacgtgtcgtggggctatgtcttgtgggtacagttgtacacctctgatcagagtaaaactattcgaatagccgtgcccgcggttatgggcggtcaaccagactcaccgtgattagactcatcttagtttagtctaatgaaattggatggtataggtggatggttgggcctgttgcaacatggtggaacgttggacagtggatgattaatactacttaattattacaactgttttcgcatacgacttctgtttataaatgccagtattgtgcaaatgaacctgtttagctctcccttgttaaatccctgcatcataccccccattccggtatgacttgctgagtacagtggatagtactcagtcttgctctatttttcccccaaccctagagtatgagtatgtgtccgatggcgggttctgcgaggagtaggcttcgtccgtgccgtcgaggatgcctgtggagtggtgttcccgctgcagttcaagtcaagacttagctcctgttacctttctttttcccgctgcatttatgtaagacttttataatgtttgtaagacgtgaatctgtatgtcaacattgtcgtttgtgtaccccggccggtcctggacgggggttttaatgcacattctgcttggaattctattcgggaatttctgggcgtgacaatggaaaagtactgaagtttgaatccaaattttggatctaaacgcagccgtagtagagttttttttaaagaactgtagagttctttaccacgaggagtagtgctagtagagttaactaatatcagaaccaacatgtataatactgtatcttctagcactcaatctttccctccatgtttcttttaccactcactctttctttaagttgggtataaaattatctccatgtttctgttagcactcactctttctcttacttaagaatttaattaatgtatttaacttatatgtaatgctaactcttacatgagactgagagacaacaatatatattttcctttcttaatttctctcctttacataaccttctagcccactattatcactcgtataggagtacagaaggagacattcctatacgatctccgtttggcagagcatggcaaagcaggttcagctgaaaaaatatctcgttttttgttagtcagtttttcgaactgtttaaaaaatcacatcaattcatttttcaagttggcagccgctgaagtacacagattgatcagcacactaagacaatcggaatgattgttttttagtatactcaatgagtacggtcctcagcgagttcggttcggagatgcatttgataatgtaatgataaaaggtgtacggtttctaatcctaaagtctcgtgctaaattcttaacaaacttataatttactttataaatattggaaaggacgtctcttcctccgaatctttctttttttaaagaatacataagggctcaaggctcaagggacatctacgtactagtaacattttttcagcaaggctgcaaaatatacatatagatgtatatatttgccggttggccctcttcatacatacataggattagtatagcaatatcactcgtaccacagataatcttctactactccttacgacatgtcaggttaattatttcaccctttctgtctgtcgtttttatttttggtgctaattgctcctccgtatctaaatatttgacactattgacttttttaaataagtttgaccgtttgtcttattttttaaaaaagtaattattaattctttttctatcatttgattcattgttaaatatacttttatgtatacatatacttttacatattcataaaagttattgaataatgcgaacggacaaacatgtttaaaaaagtcaacagtatcaagtatcaaatattatttagggatggaggaaataacttactgttcggaaggctacaagagagagagaaaaaaaggcacacgtttaagcaatatgtacatgatgttaagtatatcgatctgctacacaggaagctagcgtacatcgatctatgtagccaagataataagctaacctagttaatttctttccgagttgtacgaaagcacaggtattttagctaattattaaagaaataaaatcccaagctaattaagcatacagatatatatatgttgttattaatttgttaatttgacagtgcacaaacgcatgcatcagcccaatatggagtagaaaattaacacatatataggtaaatctgagatatagtaacttactagcttagatagaggacttccaatccatcgccgatctgtggatccatcgagatttgtattaggtatagcttcagatccaaagaagagaagcagctagcgcgctgagctcgaggtaggtagcttgcttagctcagggctcagcttcgtcaagctcgatctgtgcagtctcgatccggccggccggacggcagcagggagagcacccaccatgggccatggccagcttgctttgctagctacaggtctcaggtgaggctgccggctgccatggccagcttgcttatgccggatgcgccatggcaggcagcaggcatggtgggtggtgggtgcaggtgagaagaggagaggaaagaaagaggcccctgcagctgcaggaagaagaagatgaggttgtttggtttgctttggctgctttgcttgcatacttaaatttggtgtggctgtggctgtggctgctcgctggtactggtgggtggagtggaaatggaatggaggactatttatactatattgattacactcctaattaaccctagccgtgctactgccactgactgctccatatggagtactgtacagtacagactctactgcaatactcctactatactccacggccgccctgagctttgattttttttttcttcttgtcgacactgagctttgatttgactagtccacaccccatccatgggtcccaccaatgtcaaaagctgctgtccctcccttgtgcttttgtttccttcatcgatactactgtaaatttgccactccgatccattcatccatcgcgccgtcgacgatcttatccttgccaccgctggcaagctcctcgacgatcgctgcaggggctcgccggcggacgaatggaatcgccgacgcaggcacggactgacgactgtccaagcagaaacggaggtctcgctcgctggaaaagcatcctcccaacataatttgaaaaaacaactcctaaatccttgatgaaaacctctgcatgcttctttccagatcacgatttcctctttacttgtgccaaagagctaggtaagccgccgatcgcacctgatttaatttggagcatccaacacacaaagaaaaagcgtgtcaaagaccctcctgtagctgatacgaaaatcaagtctcctgtagctgatatgtccctacctgattcggcgggcacttcactcacacactagtattatgagtcatgtactagtattatgagtcatgtgtgatagatagatagatagatagatactgtgatgtgtctgtctgttattcaagaaaccttcaaacaggttcaactgcatgtgccttcgccttttttttgctttgctgatcaaacctgcatcacaaaatgaacatgcattttctagtaattgcagtgaagaagcaaccatacaatcaactgaagagaggtttactactgcagttgctttcgcttttctcaactaccccctccgtcccaaaaaaaagtccaatcctagctatgaacctagatatatacgtgtccaagttcatagctagggtttggttttttttgggacagactagtatataggtaaaaagggttacctgaataactagtgtgacacctggataattcattccccgtgttgaaatatctgaggccaccagatcaagcgactagaatctcgaaattcttctaatatccgagttctatagtgctgaggctttcttgaatgaatttctcggacatttagcttcaaatctcgaagcatgatatacataaattcagtcatcatggcagttgtgcagaaaacaattaatcacctgggatgagaaaggctaagtaaatttaacttatttaagttcttagtcaatcatattgcctggtcaaaagagggatgagagcaccttatagtccacttcctgatcaccttataggctataaaccatatgaaaatgctgctcgtgtggcaaaacgagataaaactgctccacataagctcaagaacaccaaatatcaagggaccagtacgcaactaaaattcatttccatgggagaagataaaaaagagactatcgtaacaatattttacttttgagctaaaaatcattagaaatatagtttatattgccgtacaaagtgtacaaatgtcttaaatagtcaaatgataaacacaatgacaagaaagacatatggtctagaatatctatttatctggatgtcggcatctataaacaaaatgttttacagacacccctgtttgtgcatccatggaaatcaaaagtgctgaacaatgccgacccggcaaaagtgctgaacaatgcacgaatgacctaatggaagtcccttccatagatacaataatgcaaatgtgacctcttttaattggcacattaagatacatgctaacagatgctctaggtaatgcaaactaagaaaattgatcacagcacatttctgtacttgcaggagtcagaaaaaatgagcatattgcagatgagaaaaataaaagattaaggtgatatataatactaaatatactagagtagaactggaagcatagaccttagtaggagtttcaacagctcccaagcccattgtatcaacaaaaacatcatccctttttaaaactagttgcgaaacccttcgaacctttcattgacaaattcagatatgtggttgtcaaccaatacagaaacagatagataaaaatatagagactactagttctgttggccatgctgattacagtaccccttttgggagtagtgtttgtctttgacgtagcaaactatcaacaatcttttcaatgtctgtaagaaaacccaaatctagcaaatgaacagcttcatccaatacaagcaactccaatcccatcaagcgagcagataataaaaatttgttctcaatgtgatcctacagtctaccaggtgtaggctgtagcaactaaaatcttcaaggggggaaacacaagatatagttcagacaaacgacaaacagttgtctgtacatatcaagcatcagttacagtgagtgcttgtactgatgtcaatgaaacagcacaacttgtttgttagtcacatggtctgtatctctttacgcataaagtaaaaatgtaaaatcatctatcggtcattttatcatgatgagtgatgctgaatactatgttctttcattttattattgttaattcttgttgtacatcagtgcaataaaactgtaactccaagaagacaatctgtaccaagtaccaacttcttagttcatataccatgatacgtacaaaagtgcatgactcctcttcgctggaagctctaaatttcgcaaacctcaaatcattctttgatgtttttgttatatcttcatcatcctgtcaaatcgccctgctgccactgggtacaacctctctttgtttagcgaggaatagacttcagagctcctgcctttgtacatagttttttttccttttgcttttgtttcgctttgttttcaaggcttctcgccttgactcgacattctaatatcgagattcatgtattttcttccaatcttaatgaaatttagtcagcgtttcttccgccgacccatcaaaaggtacaacctctctttgattaaacagggagggagaaatccgaccactggaagacctctagagataagcagcatcagcatcatcgatgcatcaccatgcacctggaacggaggaataactgagcagcatctcttgggaccaaagaaacagaaagatgcctctgttcgcaaaggaatgccagaagccaaactccattgcctccaccagcacataaattagactccaaacttctctgatctaccttgaatcttagtgccaccgataagattttgaactacaattcctcgatggtacttcaaccaaacagttgcctttgcctcagcagtgagctggatggcaagctctcttgtagccttgtagccttttagggcagaaggataaggggaaaaatatttcatcggaaaaaaaggaaaccggaatattcataatatactgcttaaaatatgtcaggctactgtcctgaaaccaagattcaatgtgtgtgatgatacttaatgtaatacattttataattaaattcgaattccaaattaaacaggaaagtcgtagcattagtctctccacttaacctcctgtccacacatcaacaaaagctttcgtattacactattatatttatatgcaactaattttaaaatttatgaaaaagaattaaggggcaaaaaggataagattaagaataagggaacatatttcattaaaaaaaagggataccagagtactcagaacattcaaaatatattactattgtatagcacatgcttacattacatatgtccagtccatgctactggcctaaaactaagatgcaggaaacaagagaattttaatgcatgccttgaaacatttgaaactggggtagttcatagccaaaaaagagaataaacaaaaatattcagaacattcagcatatactattgctactcagcaaatcacaggaattaagaccggaagtgaattatatgaggtgacgccatcaccttagctctgatctggatggcaagctctcttgtagtagggcaaaggataagggaaaatatttcattgcaacaaaaaacaaagtaagcaggaatattcagaacattcaaatatattaatattgtatagcaagctttacatacggcctggaaccaagttgcaggaaacaagagaaatttaatgcatgccatgaaacgattggaacattcagcatatattattaccagtaccatacagtgaatcacagttttgcaccgagcaaaattaagaccggaagtgaactgcatgaggcgacgccatcaccaatccctctgtaatttgcttcctcagcagctcctgctcctcgatggtctgcggataccttgacggagcaaccttgatcttgggatccaactcttcacagcacttgagcaccttcctgtcatgcagggatatgttctctaggttaaccgcagcttccatgacgtgcctgatgtatcccataaagttctcatttggttggaaaccatagatggtgagcttagtcaggttgtaatgcctaaaaccatcaggtgcggatgactcccattccacgtttgttttgtcacagtaaccctgtttttcccgtttcaccttgtctgtctcaatctcacaccaatggtcccaaactgtgatgcacatctccttcagggagggtgcagcctcgagaaagaatcttgtctaagcgatatcacattcttctgggagttcatccagactcaaaacttgcagattctgaagaacaggctccagcagttttgggcactccggatgaacccaaatctgcaatacataccaataataaaggatccagattaagttgagaacgaggaacaaataacatgggagagaggattgcttaaagtaattatcttttcacttgcaaagttgaggtgcaggtcttttacgaagaggatattagcgaggaactgacttaacctaataaccttatgccatctcatggccacattagtgaggcttaggcttgaaagcaatgggacgttgcaaaaagacaaggttcttggggatagacccacacaccaaaacccagccgtttgaggttcggtagggagttgagctcgattagttctaagttggcattggagatatcaagctcaacaaggcgtgggtgttccaactacagcagcaatacgctatcctcagtttgacacaaggccaaacgcagatactctaaccgtttgcatgtggcgatgatgttgggaatgtcagtttcagcaaagctttaagttgcgtaggtggagacgtgtaaggccggcaaatgcatcagtacaggaacaaaaaaatgtcatcagctgcttcccatcgcggcggcgatcatcaatagttgaatagtccggcggcttctctgtcagaatgttgaactcagcgctgtggatgttgtgggtggccatggctcgggcaacagccttgccaatggtgagacaatcatagtatctcaagtagaaacctatgctgagcttgcgaaggggaatatcttgtcttctgaaactgagaatgttgtcagttgcaccagccacagcagcgttcatgggaattgtatccttcaaggtggcatagccacaacggggcacaaaggaattgatccgaatatgtaagtttgagagcatatggcggagatggagtgtcctcttagaaaggaggcaggttctgacagcgtcgggggtgttgaggcggtccaggatgttgagcaggacatcttcaggtagcttggtgaacccatccagcatcacgggatctgatttctgcatcaagatattgcagcaacccactagagcatcaatccatggatcaacagacaagagcatcaatccatggatcaacagacaagagaagattgagagatgcaatgcaaattaaggaagaggaagatgtaatgctgctcacgttgcggttgcaacgactacccttcttcttgttcttcatgggctgtctagttccgatgagcgaggtcaagatcgaactggcgacttgcgtcgactacctttccaccccttgtcgttcgtttgagacaacaaaaaggtcacactttgaattcaatcaatcgaagaagaggcatgcattcgcggcaatggtggtgtggtggcggaggacaagggaagaatggccggcgttaatggaggaggcggcggcggcggcggcggtggcggtggcggcgatggtagggaggattggggacggcgacgttaggttaggtacccttgttattatgggcctcctctcgaatcatcttcctaattgggctagcccattgtgtctgattgggcctttcaaacaagagatatcattggcatatagaaaataagtctactttgcgttcatcatctttcgtcccatgtcatcctcgctctcatcacatattttctcttcttttctctccatctcttgtcggcaaggagcagtagtgatttaataatatctaagtctgatgatatgcgagctcacgctgcgctaacagaatagacatgttaaaattagctcattcgaaccttccgtttcatctcttcatcaatatatatgtttggtgtttgagacttctgcaccgggagatcatttatctcatttcagaaatactcttcccatggggcaaacaagggttcagatttgttcttgtcatctctgacgtcaagtgacgaggacatttcaaggcatcttggttgctttacattaaaatgacttggctgtaaataacggttactataaaaatttacattagtattgataattgcttaattggtgaagcagttagctccttatttatcacttgggacttgggagacaagaatcgtgtcagcttattcacatatagcgtcacctaatgtggattatttccaactgaacattttggttgcagatgatgtcaaccagggattctttgttcatgcctgcttcatgcaatgctttatgcctccctggcaaagtatcttcttgcaaatgaatattaccagaaaaagctgcacttttgccggttccaattttagccttgacaagtacattttcacctacatgcatacagtgatgagtgaggggcaacctcttgatttcttgaaggtttcaatcatagcattttgagctagatcgagagatataatggtaccacaaggtgctaagtagcaagtgtggaactactgaagcaagtagcatgatctgtataaatttgtggatggtaacgcatattccaatttccaatgaaagaaaaaaaaagagtgctttcaagacacataggaaatgctgtttcctgcacaccagtagtttgtacatatccagcatcagtgagtgcatttactgttagcgcggagataccacattcatcaaatttgatgtcaatgaaacagcacagcttgttaatcacatggtaagtagtaaccatctctgttttgaagtacgctaggaagcaatacgcataaagtaaaaatataaaatcacccatcagagtgtcagtcattaaccgcaagttaaaagggcatctatcattgttttcttcctcatatcacagttcctcaaagcagaacttcgccatttcttcctgatggcacttctcgcctccaattcatcgtctgctgactcctcttcgctggaagctccaaattttgcaaacctcaaatccttccttaaacagggagggtgaaatccgaccactggcaagaactctagcaatcagtggcatcaccgatgcatcgctggactcctgatgtctcttgggactgaagagacagaaattaagatgcctcactaagcaagaggcgagcgtcaacagaggtgccggggaggagcaggccgccggcgcggtcgcaggagagggtgccgaccggaggcagagacgaggacccctaggacatttagtagcaaaattgtgaggttgaatgtgcataataggaagtttgatgcatttagtgttctgtgttttttagcaacaccctattgcagagaacaaaataaaactatctcattgttagcttcgctaattatgggcaattttctggtttatgtttcacactacccagagttgcagtatcaactaagagctatattttcctatcaataggtcactcttgtcgtcaaacactttgatgatccaaggatagtgagtgcagacttgaaagatcttcttctttttcttcaatcaatatcggttcttgtacagtacaaagaattcatgtttctatttgagaacaatcgggaggctataaacagaatgccaagatcacttctgtcagcttttggtaatagatcatggatacctattaccaacataccttttcaactctgcaaaggtttaggttttgcttcatccaagaatgctgaatcttcatcatctgcaactttccaggtttactttaatattacaatctcttttgtaattatattcattcttctatttctgttgtgcttatgttaccgtctgattgtgtgagaactatctatttgatcttacatttgtttttctctacgaatgttctactcagggagacatgtattcatgaagagaactgtttttatcctttctgaatcgacttttcaacacattaagttggacaatgacgaattctccatgtccatccgtgagatgcaagataagcaccgggtggatttttttttgttttatattcctcttggtgcagaacttaaactctttgctgattaatgctttagtactcgggttacattttcagtttagttactaaacgccatcatttttcacatgtcaaaatgcattaaaaaaactgaactttatcttagctctgcaatgaaggtatacactaacaggatccttccttttttctttggagaacactaacgggatctcttgacaaggataaattccagtaatttggttgcttcagttaattgctttttcaatattttatcccaaggggggaaatctgtgtccgtcccgggtgtagccatgcatgtggaggtaaataattgtaaccaatatttttcaggttgccgatttgcagcaaagaaagtgcagtgttattttttacatatcagtagtcttgcaaggatcttggagttctgcgccagagagatccctcatgcgttactcatggggacagatatgaatctgcgaagattgactgaattaattgtatttattctgaaccacatcatatcagcaactaatgcagagtggttttacatgcaagtccacatcttaatctgaattctgaagtctgaaaattagcagtgttttagttattttaagttgagacggtgatcttgaaaggttgctcagtttagcgtcagaatctaaaacgcactgcttctattgttgatttgagctaactcaagtataaaccaatattgttatatcatggtatctttttttccacagtacagttgtagaatcgcacgagaccaaacaaacctaccagagggggtgaatggtagggaaaaccaaaaacccaaaaatcttttatggaattaaagattaccctcgaacgatgtcgatgacgaagtccagtcgccgccggtcgaaccgcctacctgccgccggtcagaccgccgctatctcaccggtcagaccacgcgcacacatgcagttagaccgtcgggacccagaaacaccggtagatgacaaactcgaagatatagattgaaacttttcgactttattgcatcaactagtgtttacaaagtgcaccaatagcactcctcaccaaaatcttgaactaaactcgaaatcctaactttctctcaattctagtctctctagaatcgataccaggacctcaccctccctttctatttatacaaaaaaatcccctactctatataactcctataaataggactcaattcctcaatttcccttttctccgaaactgcagccgcaccggccatctgaaatcctgctccgggtcggactccttcggatggatccttcgccagctcgcactcggtctcctctcgccgcacgtcctggaccggctccagcaagccgcgcgcctgcccaacctgctgtccaaccgaagccgctgctgctgcctgagccgccaacacatgcacagcacaacatgcatgcatcgatctccatacatgcacagcacacgtgcatgctacatccaccgagcctacacacacatacatgtatcaacacatatatgcatgcatatacttctcaccgatttcttccaatctccttcgcgaacaccgacgcttgcacgcacacctcgtaaaacccgttgcaaagatctctcccacatagtgtccatccaccgtgtgccatctcgtatccaacttcgtcacccgacatccttgaccgtctggacctcaactcctccttgagtttagtcccgatcctcaccgttaccgaagttgacctccaagaatcctgactctagtcaccttctcacatggtatcccgatcgcactagacatctgttcctccctgaacatagttccggtcctcaccattgaccaaggctgacctcaagtcacatgcacacaatcagacaaaacaaccgtttctgggcacagatatcacaacctgacccacattagtgacacgcactcacaccaacatccacacatcttttcaaaccaattcatcgattaaatcatttgcatagccaattgttcatcacaaatattaatcatgacaatgatttgacagtacaccaagatgcttcctcattttatcggtgcatatgataatctttaatgtactaaaaaaatgcatgtgcgttacaatgggaagaaaagatgacaaaattgaggagaatttgagaaagatttacattatgtaattaacttaaatacacatttactggaatacttgatttttttaagtaggtaggtgtttaaattaatttaaaagtaaagtaagtgtggaaataaaatgatatggctgaatttaatttttatgaagttctccatgattaattacactctttggaattttcttgaaattttcagatctcaattgctaattttaataatacaaaatcatttcaacatttatttaaacgaaaatctaaataaaaactctccattatctatgggccaatttcagcccatttccttcctcagcccgcagcctagctggcccacttttctcccttctcctctcctctgcctcggcccgcaagtacgcatccggcccagcaaggcactacaagtctaatcagactccctcactccttccctcactcctttcactgtcatgtgggacaatgctacagggtcgtctcctacctccgtccgtattgcttcatctgcctgactacgcctgaatccgcctctttcgtgaaatacggccacatccatggagataatccgaaattgactgaggggttttgatccttatcttctactctttatgttttttcaagaatcaaagcaaaaccacatcatcgtatagatgtcggaagggaaaccagctttgtgctctgagtttgtttctcttcaaaaccgcccacgcacgtgctgagagggagggaatcggataatacggacgaaaacaaatgtgactaaaggaaaaatacaaatcttttaattaggtgtagataagtatatgtcaatgttatttttcttcagttgtatatgtcgacgtgccttgcacgtgcacgttcactagtagtatgctattttacctactctaataacatttgtctcgtcttcttacaaaaccatcataatgaaaagttttctagtcaaaaccatacatctaccgctactttcataacactttttcacccttgttgtcaaagccatacatctaccgctactttcataacgttttttcacccttgttgtcccagctcgaaggattcactgtgccaggtaggccagggttccccgacgcctggctttttccaatgccttacacttgtctttcacagatgtgaattctcttcttagacatgtgcacaacaaaaaactatcacacttgcaaaacaaataacttttgaactttctagtcaaagccatacatctaccactactttcataacactcttacacccttgttgtcccagctcgaaggattcactgcgccaggtaggccagggttccccggcgcctggctttatccaatgccttacgcttgtctttgacagatgtgaactctcttattagacatgtgcacaaccaaaaactatcacaaccaaaaactatcacacttgcaaaacaaataacttttgaacttgtaagcaaaaaagaaaaagagtgatagcaatccgttaaaaaaatttgtttcaatgatttttttactgtagactattattactaataatagtagtgatattccactctaaccgcttgtccctacggattcaactgacactcatgtagagtgttggcatactaagattcgtaaagtaagacaatatttaagaggttggaacaaacagactagcggtatttataaaaaagagaaggtttggtgagaaaaaacttaattttgttggtaaaaaagttttgattttcttgataaaaaaacataatcaacttatttggcttattataggctttatttgaggaagaggttatcctatttgataaggaagaggaaattaaatggtatcaacgagctcggactaaaaatattttggaatggtactcgaatactaaatattttcatttggtagtaaatgataagtatagtaaacaagcatttcttagctacatgatggtgatcgggtaattaatggtgatgcgaatttaaaggcgcatatcaccatttattataaaggtctttttggcccttatgaagcttcttctttaacgttagatgaaagccaaataagtgatattccccaggtttcttctttaacgttagatgaaagccaaataagtgatattccccatatttctcaataagagaataatgctttagtacaagatttttctgagaaggaaattagagatgcgacttttcaaatggaacataataaagctccgagttagaatggattcccagctgagttttatcatgttttctggaaagtaattaagcctgatttggttgatttatttaatgatttttatagtggtaatttacctctttactctcttaactttagtactgtcacgccccgaactagtcccgaccggaactagcccgtgacgctccaatttaacctgttaatcgataccagtcccaggaaacagtgctggtatcacagggagacagaagatcacagcaacagaggtctctttattatagagtagaagtacagtcatgttgggctgcggacagatcccgagctcacaactgcattacaaaagggaaacggaagccaggacttggaccaaacacacaggcgcgacttgggaactaggccgaaaccctaaaactcatcgtagccggcttgctcctggaagaactcctcatcagcaggatctgcttcatcttcttcagcaactggggggggatatttatatagagcaagggtgagtacgggagtactcagcaagccatgggaattaagtgtttaatgcaggcttcaaggaaaggctgttgtttttgcaattgattttatttgaactctttttctaaaacaactaggtgagtgcttctcaaacgacacggatgagaccgtgcgtctcgtccggtcggagtatgtgcaatgtgtcagttctttagaattgagacaaggttggcacccggccaacagcttttcaaacggccacccgggccaacaactttccaaacggccacccgggccaacaacttttcaaacggccacccgggcctagctgattccatcagctaaagatttttcaaacattgaaccccttttcacaacagtaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcaaccacgtcgggagacctccaagctttcatgacaaggcatttcgaaagccgacacaggtttaccatatgccaacgagaggggtcccagaccaacaacaggttaggtcacagaccatactgtgccaggaagcccaggggtcctccccgacaccaccccggtgaatccacatgtctctcggcatcaaggctcccccgattagcaatttactcagccaggggcgtcccattccaccaatgtggtcgtacttgtcttatgttcggatgaaattccaaggaaacggtccttaggtgcaagagcgggaaaccgtacacccggtacgttccccggtccgcggttatggaaattcatttagttcgcaagcaccgacccaggtgtcgggtttttccaagtcttttgtaaaactccagttttacccaagttgttactcagattttaagtttgaaggcgaccgtcgatactcgcacagagtgcacgagtatcgaggcgcaactgggtggttacaaggggacatggtatagcaattaacaaaggaaggatcaaatgcgacaaattaggtaggtccgccaatctgccttgcagacgggacaaacagattaagtgcgatcctatcaattcataatattttgcaagcaacataattaaatttcaaatataggctcaagatgttcaaaggtggcttgccttgcttgagatctggagcttgatcctcgaaatcctcgcactgcgggtcttcgggctctgaaactatacgcgaaacggaacaactcaacaaacggcgaaaataaagccctattaatgacctctaagcgtgccattagatagatctcgagatttggggaattttggaagttgaacggagtcaaacggatttacggttgggaagatattgaatttctaagattattgaatttttgatctaaaggaaaaggatttaattaaatcctttttggaaaagaaaaagaaaagaagggagagagggaatatagacttttctcggacggctagggcgcggcccaagagaaatggagcggtccggccaagctaaacgggccggccggcccaaggcggcccaaactcgcgcgcgcgcgggagggaggagagagagagccggtggaccgggctcaccacgcgcggtcccgggtgggacccgcttgtcagcggctcggctcaccgtgcggagggagcacgcgacgcacgcgcgcgggcggggaagggacgcggtgcatgcgcgcggtccgcggtggacgcaggtgcggcgggcccacgcgcagcctcacggctcgcggtggatcgcgcgcacgcggagggaccgaccggggtcggcccgacccggtctggctgagctggcgccgacgtggcgcctacgtggctgccacgcgggccggcgggaggtagacgacgacccggccgcgaatggacggggggcggcggcggcgagcggcggagcgaaccacggcgatacgggcaacagcgagcacaccgggcggttgcacgtgacaaggagaggcgagccaacggctcggattcgccggaggttgctcgacggcggcggattgcggcggcggcaaccggcggcgggagaagagggaaacggcgacgaggtcacgagaggtcgattcccggcggtgagagcatctacgcggcttcgggaactcgacgctagcgtcggattgggcggaactacgccgagcgaggccggcgacgagcgggtgctacggagctcaggcggcgacggcggcgagcacacggcgagcgacggcaacggtcggggcggcgccggctaactacggggagtctactcaagctactaccgaaagctagggggaggagatggagcgaggaggaagaacggagagagacactaccgtgcgggacggggcgcagtgacgagaggccgacggcgcgggagtgatctctccggcctcgggccgaggaagaggaagaagagggcgcgcccggagtccccttccgcgtccacgaacgcaccggctctcccagcgcttggcgatggacggcggaggcgaggtagagcacgggagcggcggcaacggtgaggaggcgaatgggagaggaaaggaagggagggggaagacgggtttaaatgggcggcaatgtcggtttgagagaggggaaccgacatgggtggtcaagccggcgagctggcgctccggctagcgtccaaagcggcgacaggaggtgacgccggcgagagggagaaaaagaggaaaaggagggagagaaaggggctcgcccctttgccgattcgggaaaaggaggaaggagcggggcgactcggcagagggagaggggctctctgcctccgccccttggaggctagcgcgcggagtggcgggggccaagcaatgacgacggcaatgacggtgggatggtttggagcggc

SEQ ID NO: 9276 - DNA, 15638 bp, Oryza sativa
ggggccgggaaagagatgggccgagcggaatttggcccatcgaacccgggggaggcaaactagacttttgcggagggattcgatttggaaggaattggattcggaattgaactcgacgatagatcggggattgagatcttgagatggcacggacactagacaacaatcaaagaaacaaatttcgcaattagggttttttggagataattttcccgctaggcgccacgacggaacgggcgctacaagtactattattttactgccaattgcaaagaggctttgaaaatttaacaatatatgcctatttgtttacttactgtcagtttcaaaatttttactaaaattgctacaaatagaatttctggagtggctcaaatggttattagtcctacacatatagcttttatacctgggaggaatattatggagggtgttgttattcttcatgaaacgatacatgaattgcgttgaaaaaaaaggaccggtgtactttttaagattgattttgagaaagcttatgataaagtaaaatggtcttttgttcaacaaactttgagaacgaaggggttctcgcaaaaatggtgtgactggattgcatcttttatcaaggtggacatgttgacactaaagtgaatgaccaagtgggatcaaatttttaaacatttaagggtttaaggcaaggggatccgttatctccaattctttttaacatagttgttgatatgttagctatattaataaagagagcaaaagatgatggtcaaacttctggagtggtcccacatctggttgatgatagtttatctatcttacaatatgctgatatttttttagagcatgatttacatatagctaaaaatataaagttaattttaactgcttttgaaaatttatctggcctggagataaattttcacaaagaatgaattattttgttttggccaagcaaaggaatgtcacgagcaatattcatttttttgggtgcaaactaagagattaatatttacatttatagatacccatgtagccaatattgtgtggaagaatgaagagtcacgcattaaatccgataaagttattaagtggattggtagttggattgaaatatgcctatcaaaagtaaaattttcagatttgaaaatatgcctatcaaaaataaatggaggtagtaacttcctgtttggaaaaagaaagaaaaaaaaaagcacacactttaagtagtatgtacatgatgctacatatatcaatatgctacgcaagaagcgtatatctatgtagctaaggctgtgtttagttcgtgtgccatattttttttaagtatacggacacacatttgaagtattaaacgtagactaataacaacacaaattacagattccgcctgtaaactgcgagatgaatctattaagcctaattaatccatcattagcaaatgtttattgtagcaccacattgtcaaaccatggcgtaattaggctcaaaagattcgtctcgtgatttacatgtaaactgtgcaattggttttttttcatccacatttaatgctccacgcatgtgtccaaacatttgatgtgaagaaaaagttggaagtttgaagaaaaaaagtttgaatctaaacatggcctaagataataagctaacctagattctttccgagttgtacgaaagcacaggtattttagctaatctctactattataaaaattaaaaatgtttttgtcggtattttggtacgtcatccgtgtatgagtcggtttttaagttcatttgcttttggaaatacatatccatatttgagttggtttttaagatcgttcacttttggtaaatacataaggaatcatataagaaatctgtttaagaaaactcacatgctaacttgagacgatcgggctccagcgaactcccacagtgaatttcattttaactaaaccatataacaataataagtgtcgacaagtgatactcgtagaccggatgattagggtattgggtatgttggaacgaggatctacgtaatacgacatcaagcaaacaaaagacaaggattatactggttcaggccctttatcaggtaatagccctagtctagtttatatgagattgatgatggaaaaccacaggttacagtgtaagtagtttcgtaaactactcggcgacttggctccgtgtactccggctacgtaaactatggtgggtgtgctggcgatcagattcgatgccttgtacccctcgctggggtcccttttataccgtggattatcttaaccctcaagtaagacttgagacattggatcttgtacattataatagaaactatatcccttccaagtagaattttagaaatcggttgactcgaggagatattttccataatttgtaatagattccaacaatgtccacgggaacaatccgtatacgtgaaagtatgccatattcatatattccataagtcgtaggatatgaggtatgccttatctgtaaccttgataataagattaaaatagacttcatccgttgcaacgcacagatattttttctagttatataaagaaataaaatcccaagctaattaagcatgcagatctatatatattgttattaatttgtcatgtacggttaacttgactgtgcacaaacacatgcatcagcccaataatctatatatggagtagaaaactaacatatcctataatattatacaagtggtcttgcttagtgtagttattacttattaggatttttctgagccgtggttagccacgtcaccctttttttccggtcgttcaatcaaatgctcaccaaccgttcgattgcaatccatcacacagcgcacatacttttgcctcccttcgctcgcttctctccttcccccgtccctggcgcactctgctagccgcgccacgccgcttctcctccacacccccacccccgccgccccaggtcgtacagacgctgccgctccgcctccctctccccggcgattctttctccacgcccaccaacgagctcctatcagagtatcaatcattaacctcaagttaaaagggcatccatcattgttttcttcctcatatcacagttcctcaaagacgattcatcgtcttctgacctcttcgctggaagctccagattttgcaaacctcaaatccttccttgaagttgatacatcctcatctgaggagtctggtctccatttcctgtcaaatcatcctgctgcaactgattagaacctctcttaattaaacagggagggtgaaatccgaccactggcaacaactctagcaatcagtggcatcaccaatgcatcgctagactcctgatgtcagaaagatgcctcctttgttcgcaaaggactaccagaagcccagctccattgccgccaccatggcatggattagactccaaacttctctgatctatcttgaatctagtgccacttgatgacacttgaagttgcctcagctctgatctggatggcaagctctcttgtagtagggcaaaggataagggaaaaaatttcattgcaacaaaaaacaaaggaagccagaatattcagaacattcaaacatattactattgtatagcatgcttacatatggcctgaaaccaagttgcaggaaacaagagaaaattaatgcatgccttgaaacgtttgaaactagagtatttcattgcaaaaaaaaaaaaacgaagtcagcatatattattgctactaagcaaatcacatttttgtgccaaggatttaagaccggaagtgaattatatgaggtgacgccatcaccgatccctctgtaatttgcttcttcagcaactcctgctcctggatggcctccggataccctgtcgaagcaaccttgatcttgggatccaagtcttcgcagcactcgagcaccttcctgtcgtacagggatacatcctctaggttaacagcagcttccatgatgtgcctgatgtatccaaggaagttgtcatttggttggaaaccatagattgtgagcttcgtcaggttgtaatgcctaaaaccatcaggcgcagatgactcccactccacgtctgttttgtcacagaagccttgtgcttcccgttccacactgtctgtctccatctcacaccaatggtcccaaactgttatgcatagctccttcaggacaggtgcagcttcaataaagaagcgtgtccaagcgatatcacatccttcagggagttcatccagattcagaacttgcagattccgaagaacatgtgcaagcagtttcgggcactctggctgaacccaaatctgcaataaaagtaataatggaagaatgcagattaagttgagaatgatgaacaaataacctgctgaggacttgcttaaagtaattaccttttcgctcaagaaattgaggtgcaggtctcttatggaaaggacattaggaaggaattgacttaacctgataaccttctgccatctcatgctttcatcagtgaggcttaggctcgaaagcaacgggacgttgccaaaagacaagggttcttggggacagttccacagactaaaaacaaggcgtttgaggtttggtagggagctgagctcaactagttctaagcccgcactagagatattaagctcaacaagccgcgggtgttcaaacttcatctgcaacacgctatcctctgtttgacacatggacaaacgcagatactctagccgtttgcatgtggcgatgatgttgagaatgtcagtttcagcaagccttaagttgcgtaggtggagacgcgtaaggccggcaaatgcatcagtacaggcaccaaaaaatgtcatgagctgcttgccattgtggcggagatcgtcgatagagcaatgttgtgcccgcttaccagtcagaatactgaattcagcgctgtcgaggttgtggctgtgggtggccattgctcgggcaacagttttgccaatggtgagacaatcatagtacttgaggtagaagcatatggtgagttggcgaaggggaatctcttggtttctgaaattgaggatgttgtctgttgcatcagacacagcagcgttcatctgaatctgaattgcgtccttggaggtggcataataaccataataatggggcacaaaggaatcaaccgaaatgtctaaatttgagagcaaatggcggaggtggatcgtcctcttggaaaggaggcaggtcctgacagcatcgggggttgacaatattactcccctagcctcacaaataaattcctaattcctttatgatacttcaacaaaacagttgcctcagctcttagctgcatgtcaagctctcttctagttgtagggcaaaggataagggaaaatatttcattgcaacaaaaaaacaaaaggaagccagaacattcaaacatattactattgtatagcatgcttacatatgccttgaaacgtttgaaactagagtatttcattgcaaaaaaaaaaggtcagcatatattattgctactcaacaaatcacatttttgtgctgaggatttaagaccggaagtgaattatatgaggtgacgccatcaccaatccctctgtaatttgcttcttcaacaactcctgctcctggatggtctccggataccctgacggagcaaccttgatcttgggatccaagtcttcacagcactcgagcaccttcctgtcgtataaagatatgtcctctaggttaactgcagcttccatgacgtgcctgatgtatcccataaaattctcatttggttggaaaccatagatggttagcttagtcaggttgtaatgcctgaaaccatcaggtgtagatgactcccactccacgtttgttttttcacagaagccctgttcttcccgttccacactatctgtctccatatcacaccaatggtcccaaactgtgatgcatacctccttcagagagggtgcagcttcgaggaagaagcatgtccaagcgatatcgcgtccttccgggagttcatccagattcagaacttgcagattctggagaacaggtgacaacagtttcgggcactctggctgaacccagatctgcaatacaaagtaataatggaaggatgcagattaagttgagaacgaggaacaaataagctgctgtggttaaagtaattaccttttcacttaggaagctgaggtgcaggtctctaatggtgggggcactagaaaggaactggcttaatctgataaccttctgccatctcatacttacatttgtgaggcttaggcttgaaagcaatgggatgttgccaaaagacaagggttcttggggacagagccacaggctaaaaaccaaccgtttgaggttcggtagggagttgagctcaactagttctaagcctgcactagagatatcaagctcagcaagccgcgggtgttccacctgcagctgcaacacactatcctctgtttgacacatggacaaacgcagatactctagccgtttgcatgtggcgatgatgttgggaatgtcagtttcagcaagctttaagttgcgcaggtggagacgtgtgaggccagcaaatgcatcagtacaggcatagaaaaatgtcatcagctacttcccattgcggcggcgatcatcaacagtgcaatattgtagcttcttatctggcaaaataatgaattcagcgctgtcgagcttgtgggtggccatggctcgggcaacagctttgccaatcgtgagacaatcatagtagttgaggtagaaggttatgctgagttggcgaaggggaatctcttggtttctgaaattgagtatgttgtctgtcgcatcagacacagcagcgttcatgtgaatccgaattgcatccatggaggtggtataataaccataataatggggcaaaaagaaatgaagcgaaatgtttaagtttgagagcaaatgtcggaggtggatcgtcctcttagagaggaggcaggtcctgacagcgtcgggggtgttgaggcggtccaggatgttgagcaagacatcatcaggaagcttggtgaacctatccaccactggtaggtggttattgtgagctgctgatttctgcatcaatataattgcgaaacaaaattaaaccgtgcatgcatgcagacggcaggcatacaaatgcaaagaaacaacaacaacaacaacaacaacaacaacaacaacaacaacaacaacaacaacaacaacaacaacaacaacaataataataataataataataataatatagaaatatacaagaagtaaatagagaaatgaaaaaaagaagaaaaggcaagcggcttacattgcggttgcggcgactacccttcttattcttcatggtggtggtgtaagtagcttaggtgatggatggattgggtaacagtttattgggctattgcgcttattgtttgaggtggatagtatgaacgcgaacgtcagctcctccattatataaggaggaggagccgaggagaagaccgacgggcaactactcatcatccgtctccgtctccaaaacggaggacgactctggattggagtctggattgggattggaggaggcacaagggcacaagggcacagctcagggtgcgcctgcgccatgaccatgcacatactcctagctagcttgccgtccgtctggctttaatttgacacatcctatacggagggctttgcctcctttcagaaattttaaaaatatatattactccataattgttcagcacagatactactactctctcactcaatctatctgccatctttcagtaaaagaaaaggaaagaaatgcaattgctatttcctgattcgaatcccaggtacatccttaaggcccatcttcagagcagttttcctgtacagtgctggaggcttttccaaaccgatggatttacagaacctgttcgctaggtcaacaagcatggtcttgtctcttccaacatcacctattgaattgtagtagccaagccatgcgtgatatgctgcctccttgatgctcatatcaactatctttattgaaccatcaacctgcattacaaatggaacatgcatgttcgttcaagctggagatacaattgacaacgaatgcacaccgctgtaggggggaaaatgtcctacttatatttactcaaatccccatagacggtgtaaaatggttatactaacagaatggaatttaaaatgataaaatggttattcgtacaaacaatggttcaaacagaaactaaaatggtatagttcatagcatatgtcatggttagtgcaaaatctatgcaacagcatttagctataacttatgaatctttagattagactcctatccataagcgatatataagtcccaggctaattagtgccaggctcacatcaactgttttttgaacaccatagtacgtctctactcattcaacctaaatacaacgaatcgtatcaaagacagtaaacaatatggcatggaggctaatgcagtctgcaaaaacgaaacatgacaaaagcaatagtgctaggaatgctggttattttgtgcaaaagtaagaaaaatattcctccaaaagaacgtatcaaagcaaacaaagagaaaaagaggagcttaaactagctatcacctatcagtagttcagcctcaaagtagcaaatttggcggggtacaagacttgtatgcccgagtagcagtagtgatttaataatatctagctctgataatatgctagctcatgctgcactaacagaatagacaagttaaaattagctcattcgaacctttcgtttcatctcctcgtcaatgtttggtgtttgagacttctgcaccgggagatcatgtatctcatttaagaaatactcttcccatggcgcaagcaaaagaatccctttaccagatttaccttctcttccggtccttccaagtcgatggatgtagtgctctctatctgaaggaacaccaacctaaaccaaaatagtatatatgttaaaatagtaattgcagtgaagaagcagccatacaatcagctgcagagaggtccactacagcagttgcttttgcttcagcaaagtagcaattctgtcctgaactttcacaactacatttttaaaagaaaaaagactacctgaatgactaaggtgacacctggataattcactccacgtgttgaaacatctgaggtcaccagaatcaagcgactagaatctcgaaattcttctgatatccgagttctatagagctgaggctttcttgaatggatttctcggacatttagcttcaaatctcgaagcattatatacataaattcagtcaccatggcagttgtgcagaaaacaatcacctggaatgagaaaggctaagtaagtttatcatattttaattcttaatcaattgtctggtcaaaagagagggatgagagcaccttatagtccacttcctgatcaatatgttctcggagaaggcgataaaccatatgaaaatgcagctcatgtggcataacgagatacaactgctccacctaagctcaagaaaaccacatatcaagggatcagtaagcaactgaaaaattatttccatgggagaagataaaaagagactacgcagcaatattttacttttgagctaaaaatcattagaaatatagtttatatgttatacaaagtgtacaaatgtatcaaatatccaaatggtcgacacaatggcaagaaagacgtatggtctaggatatctgtttatgtgaatgtctgtatgtgtatccatggaaagcaaaagtgctgaacaatgcagagctaatggaagtcccttccatagatgcaataatgcaatgggacctcttttaattggcacattaaaataaatgctaacagatgctctaggtaatgcaaaccaagaaaattgatcacatcacatttctgtacttgcaggagtcagaaaaaatgagcacattgcagatgagaaaaatcgaagattaagttgatatgcagtactaaatatactagagtagaactggaaagtatagaccttagtaggagtttcaacagctcccaagcccactgtatcaacaaaaacatgatccctttttaaaactagctgtgaaacccttcgaacctgtcattggcaaattcagacatgtggttgtcaatcaatacagaaatagatagacaaaaatttacagaatactagtgcttttgcccatgctgatcacagtacctcctttgggattgtagcagaaaatagtagtgtctgtctttgacgtggcaaactatcaacaatcttttcaatgtctgtacggaaacccaaatctagcaaatgatcagcttcatccaatacaagcaacttcaatcccatcaagcgaacagagaatgaagatttgttctcaatgtgatcgagcagtctaccaggtgtagcaactaaaatcttcaagggggaaaacacaagatatagttcagacaaacgacaaacatcagcagctattaccttgatctatagtaggtcagtaaacattacaaacctggcatggatcagattctaaacgtctttgatctagcttgaatctagtgccaccaataagagattgaacaccaattccttgatggtacttcaacagaacatttgcctcagctgtgagctggatggcaagctctcttgtagggcaaaggataagcgaaaatattggagacactcgatgatttgtatggctcttcatagcattcaagactgattcaattgcagggagctgtttatcaatacatttatgaataaattggttgaaggaaccaacaataaaaactaaacatctcaaagtatctccttgcaaaatagtattaccagaaaagctgcacttttgccagttccagttttagccttgacaagaacatctttgcctggatgcatacagtgatgagtgaggggcaacctcttgattgttgaaggtttcagtggtaacatgttcagataaatcaaaagataaaatggtgccacaaggtgctaactgctaagtagtatgtgtggaactactgaagtgagtaacatggtcagtataaacttgtgttgttagtagcacatattcgaatgaaaataaaaaaagaaagtaccttcaagacacataggaagtgctgtttcctgcacaacggtagtctgtacatatccagcatcagtgagtgcttttactgttaggggagagataccacattcctcaaatctgatgtcaacgaaacaatagggcttattaatcacatagtaagtatctctgtttcggagcatgctaggaggaatacactctctatttattatggttaattcttgctgtagatcagtgccataaaaaatgaaactccaagaagactatgtgtagcaacttcttagttcatataccatgatcggtatgtttcaaattcttttgttgttttgcctaaaagttcataataacaatacatatatgatgttctaaagctaataagctccagaacaaataaatcaaaactacatgagcaaataggcagcaatagaaggtaaactaaagtgtaaccttttattggtaaacaaagattcgcccctcgactcgtaacgcctccgctcagcacccaacacttccctgttctttatctcctctcgcagctctcggaagctaccagcgagatcgttgttttcttcctcataggacttgagcgctctcctctccttcttcatatcacagttcctcaaagcagcactgctccatttcttcctgatggcacttctcgcctccaattcatcgtatcctgattcctcctcactggatgctccaaacctcgcaaacctcatatccttcttcgcagttgatatatcctcatcatcctcatctgaggagtctggcctcaatttcctgccaaatcgccctgctgcgaacgagtagaacctctctccattcaactgcgagggagcaatccgagcactggcaagacctctagcaatcagcggcaccatcgatgtaccactggactcctgatgcgcctggaacagaggcatcactgagtaggatctcttgggaccgaagaaacagaaggatgcctcctttgttcgcgaaggaatggcggaagacgagctccattgccaccaccagggcgcggccgtctggaaatccctcctaggattgaacgcagccagacgcggctccttcccacccctcggtagctcctgctttgtagagtccaacttacggcggtcgccgccattcccgccaacggagacgatcctcctcggcggccgcggccggtcggcgcggtggatgggcccgtcgtcttcgttccagagatcctcggcgccgggcaagaggaagcggtcggcgagggcgcggatgtgggcgcgcgaggaggtgggcccgtcgccgtcgtcgggaggggaggcgccggcggcgggcaggcgggaggcgcggatctcggagcggaggcgggcgaggtagagctgcttctcgtggcggaggagcccccgctccttgtgcctcgcgagcttctcgtgcatccgcttgtgctgccacttcgacagcccgcccgggaacgtcctcggcccgccccccatcccaccggcgtcctcgtcggcggcggcggcgagaagcagtagggtttatcaatcaattatcactcgctgggatttttcccctatccagggagggttttgacttttttgactctgacaggtcgccgtttccgccttctgagaatacgtttccgccttcgcgtggggtttgcagaaaatgggtaccaactgaatcctcaactcgcagatctctcgcggggagagcagaagcagagatggagaggaagcgtgtgctcgtcgtcgggggcagcggctacctgggccagcacctcctcgccgcgctcgctgccggcggcgaggtcgacgtcgccttcacccaccaccgcgacaccccgccgcagccgctcctgcacgcgctccccgggcttcgcgccttcagagtagacctccgctccggcgatggcctccgcgccgtctccgagtccttcggccaggtacctgctctacgtttcccatttcaagttgtgatgctactgctagtcagaatgtgcgttgctacttcactctctttgcagcatggaaaatgtaatatgttcttactgcgagaatcgaatcgtttcctttcctatgaaaatccctgcaaatgtcttatgaaattgtgtagattttagaattttctagagctaatatttcaaaaggatggaacacttgacacaacgcctttgctgtatccagtttggtggaatcttgaagtgctttattactaaataaataatgtatgagacagaccgctttattccttttctaaatggagaatttagactatttaccatcaaattcacgttccttaatttttttaccacctaatccgtatgccctctataatatgtcattaggactgctaattagcctatttggtaacactttatctatttttactgtatttttcttttcttaattttatttgtatatattttcaagatttgtggacatttttaccctggacccacctgtcagatcaaagagagatactctgggtctagatcgattcgctccctccaggcgtagcgccaccgccgccgccacacgcttcttcggcgtcgcgtcaccaccgacccgctgccctgcgccaccaccgagcgccgccccaccacccccgccggcactgtgcggcagcacctccagccgccccagctattaggcagcacatggcatggaaacgtagtaatccttcacaagaacatgccatgttttccatgttccatagctagctaagctttttagctttagcagcatcatggtgagtgagtgacaagattcattggcatggtagcatctagcgatgcatgcaaagctactaacacagtgatgtttgtgtagccacagcgccacagatcgtgcagtggggccgtcgagttggggcggcgggggcgcacagtggcgccgccggcactcggcggggtggtggcgctcggcggttggggcggagtggcgtcgagtcagctgcggcggcggcagcgctcggcgattggggcggcgagcttgcgcaccctggcggtggcagcgttctgcggcggggtggtggggcggcgccgctcgggggcggcaagctgggggcggcgctcggtggtggggcggagagctgaggcaagtggcggcggcggcgatcggcggcggggtggtcgcggtcgatggcgccgatgccggtcgggggcgttgcctggagggatcgatcgatacggagaaatatctctcttttggatctgacaggtgggcccgggggcaaaaacgtccataaatcttgaaaaatatacaaatagagttaagaaaagagaaatacgaaaaaaatagataaagtggtaccaaatagactaattaacagtcctaatgatatattatagagggcatgcggattgggtggtaaaaaagttgaggcacgcgaatttgatggtaaatagtctaaattctcttctaaatgagtttaattaccatgttcagccgcatgtgattgtgaactgtgctgcaatctcggtacctcggcaatgcgaaacggatcctgctgctgctatggctactaatgtaccttcatcacttgtcacttggttgttaagctttgggaatgacaacactcttcttatccatctctcaacagatcaaggtgcactgctctctcaactctcatccttgataatctgacgctatcgaaactcttctgcaggcattcatttttttcgtttaaaagcctagctagagacaaccgaggatcttatgaaaacccagagtttataggttacttgctaatttatgcatttgtggtctatatagtaaccagcaagtgtaggaaattccttcttttgatcttaccaagtcactctcttgtggtaccagtttacgagggagtaaaatccttctacaaagaggatgatgagaccttgccagtgaacatgtacggaaaatctaaagttgctgcagagaagtttattattgaacaatgctcaaactatgcaatcttgagaagcagtattatttatgggccacaaacaatttctcctgtggcaaaatctcttccaattcaggtatggttaaatgactaatctgcagcagctacaatacttcctccttaaagcaagttaaacttttagtcttatcatagttgtttagaaataagaactacacctcatagattggattgtctaactaaaaaagttcttcctctgtatgcagtggatggatagtgttctttcacaaggccaacaagttcaattctttaatgatgagttccggtgtcctgtttatgtaaaagatatggtggatgtagtgttgtctttgacaaaatcatggttagcaggtataaaaaggttaccacatagtgatgttattgtctttttatttgacaatttttaaaatcattatttttgcctctcgaggaacgactatttctcatttattggctccattgatgctgaggtactgacatcaaagcacatgctgcagatggtaaagctgttcaagtactcctgaatgtcggtggaccagatagagtctcaagactgcagatggctgaatctgttgctgatgttcgtggatatagtcattctataatcaaatctgtatctgcttcatcggtattaatcttctccgtgggtcacagtaatcaagaatgcatatttgct

SEQ ID NO: 9277 - DNA, 1558 bp, Oryza sativa
ttaaaaaacggaggtagtacaatttacagttatgatgtttgcaacacaagtggaactagcctttcctaatttattgatttgttgcttgatcgatgagttcagtttaggtactatgcattgctatgactctttactatttattatccaggttgaccggggtgtagcttctccaccagacatatccatggatatcaccaaactaacccaaatgcttggtatcaagccaatttcatttcaagatggagtcagagctacacttgctgcagaagctagtacatgacactttgtctgttcattttgccaagagagctgcttggatttgtctgtgaaagtatgtgagataaagagccactttcagtttgttgaacagtggcaaatctgtgttgagtatatgtgaaagatgtaactttcgacggtgtgaaaaaggaaattttgcgttcacccgacatcaatatcatgtattactgtctggttttatacttccgaataaaatcatcattcattttgtactctttttcagtagcctatgattctatattaccacatattatactgttatgagttactacctccgtcccatattacttgtctttttcagtttcttgtttgtcaatgtttgattattcgtcttattaaaaaaatttggaattattatttattttatttgtcaattgctttattatcaaaagtactttacatatgacttatctttttttatatttacactaatttttcaaataaaacgaatggtcaaacgttgcaaataaaaagtcaaaaacgtcatctattatgggacggagggagtatcaagctgtacttaagactagttagagccatcacctactttagtcaagcattggatcatgtgcttaaaccttgttggactttgcagcaatactgctgggagaagcttccacaaactttgcagaaaactgtggcagcatcaaaactgtgtcaggacctagtgctacatcactcatgcaggtaaaaagcaaaactgatatcaatgaaggtttgaattcttatgcttgcagctgttaaatttaaaattttacacttgcgaagcactgtatcaggtaaattgcagccatcctgctcctgcagctgctcatggacatttattctcacaccaaagcatgaggtgtacacatagcatcactggatgtcatctataggtgagcatccatattaataagtccgtgtatggttagtagaattccagtcaatctccagctaaagcagcaattgttaatcaacagtaaattggttgcttatattaaattgctcttaaaatctgcttgcttcgtgtggcgttattaatgaaaccagcagtgctgtcacgcgctattgacagaacatacatcaactggagtaactttttttttgctgggaattggattagcaatttgacatgtcacttgcaaagatattgatgttttcctgctgaaatgcatggtgactagtcccaacattccaaagagctggatgaagtggtaaacgatcaagcttcaactgtgcattcataaacctgttcattaatgttactgtgggcacccga

SEQ ID NO: 9278 - DNA, 31887 bp, Oryza sativa
  unsure (1)..(31887): unsure at all n locations
cgtatatggatcccactcatccaaaattatgtagtggtcacaaattacactggacgatacattgttcgggtgcccacagttactacatagttcatgaaatgaagccattttttttagttgatacatttatgttttggtccctgcagtctttaaaaagatcactgaacacccttttttgtgattttcagcagatggaatccatgctcgggaagatattgatactctaatttagctttagctaacatgcattgaaagtctaatggtagggtggttattggttaacagaggcagaagatgtcactttttcaaaggtaatcatcggttgcttgcttgcttgcatgagcaggctagcagacaagattgtcaatagtctctgttcactctagccatttctttattcgacatgagtttcatgaatccttctatagattccttggagaaaagataacttgtctatacaaaaatcaggcaagtttcaactgaccaaaagaactatggctgtctttagatccaaaatttggatccaaacttcagtcattttccatcacatcaacctgtcatatacacacaacttttcagtcacatcatctccaattttaaccaaaatccaaacttttgatccaactaaacacagcctatatcgcattgagtccatatgaaaaaaaaaaggtgggctccacatgccaaattatcagtgatccaaacacatcatcatctaatatgcagagttaactggaccataggatggaggatcatgagctctacttgttgtcactcctgtctcctccctacaggaacatgacattgacactggcctgcctaaaatccatattaaaaccctctcatccttgcccctctctgactccctctctctctctctcacacacacacacacacacaaactagagacttatgccatgaggaggttctccaagcagcacctggtccctttcattctgctcctgctacttgtcatgtctcacttgccaatctcaagccttggttcaaggagagcattcagagaagaagctgtcagtggtttcagaagccatgagcttgctccaaccatggctccttctcaagagaaagaagcaggcgtcgtcgccggcgccggtagcatctgtggccagaagtatgctgtctcaagaagaatggttcctcagggaccaaaccctctccacaactgatgaactcatgcactgcaatctgccgtgatcatcagcttctccaatacaggtgaatggtgcagccatcattggttacctttaagtccgtctgcttaattaactagatatttcatagtattttatcacacaacgaatagagatgttcagtagtacaagtgatgtacctctcttttgcaatgttagcctttgtgtatagaaatatgaagatgcataagatggattgtgctgtagcataaattgaaatttgaaggctgactgatgtgaagatgactgtttgtttgggttgcttgtgctgtcaagctagtctcaagcaggtgtaatgtatctcggttggatgtgtgcattatcttgtggtggttgaaggtcttccatcaccagctaaaagcaaacttgtgacagagatcagtttcagtctgaacactcgttaattaagctcgtgcatgtttgtatggctaacatgagaaaatctggaaatttttcaagcacacattttccatctatatctctcttctccctctggatggttaagttttggccatgtttgaattggataagggattttagaggaggaaatggtggcatgtatagtagctggtgcagttggtcagcaattcccggaggactcgctgaagagacaggagattaggtacgtagctgcatttgtttagtgatttcgttcacgtggatgtcagtgcttggtcatcgataatcggcgatggcgaagcatagccatcactactccaagtgtttgtactcctgctgcagttgtagacatgtagattgtagtagtcatatttagtcaaaggtgtgtttagttttttgtgtaaagtttttaaagtatacggacacatatttgaagtattagcctgtgttcgacatccagttttattcaacatctagtttttccgacccttcttcctcgttttctgcgcacatgattttcaaactgttaaacggtgtgttttttgcaaattgtttctatacgaaaattacttaaaagaattaaattaatctattttttttaaaaaaaacttagctaatacttaattaatcacacgttaatggacagctccgttttccgtacggagggaatgagtttccaacctacatatgcaaacacagccttaaacgtagactaataataaaacaaattacagattccaactgtaaactgcgagacgaatttattaagcctaattatttcgtcattagcaaatgtttactgtagcatcatattgtcaaatcatggtgtaattaggcttaaaagattcgtctcgcaatttacatacaaactgtgcaattggttttttttccacatttaatgccctatacatgcgtccaaatatttgatgtgacgtttttggccaaaattttttgggatctaaacaaggccaaagcaagttcgagatccgaaatggatactacttctacctgtaaaagagtacacttttgcacacaaatttaaataagtgcatgtatagatttgtgtagaaaatgaactccttttttacggaaggtagaatctggtaggattcgccattacaaaacagtcttcctacgctttgagattttgcaggcatcagtagaccaacgaatatagcatgttcatcgcacagaacgagctactgcctctgcataaccaaacgcacattctgattctccagatacttcagataaatcgaacaagatctaagtattgcattcctttcttatgaacgaaacgaagaaagaattccattcagcaacatgtaaacagatcgtcaagaacgattacgacagcaagaggcaaacatctcaaggcaatatattgcaatttacctacaaatgcaagtctgaaacgcggactaatgatcaccccaacgcgtaggcaaccaggacaattaaaaaccttaataacaatcaattctatcacagtactagcagtacgaaatgtacgacgattagcagcaggcatatatcagagccaggtgaggtgtgagggcaggcgtacagctcatccaataaaagagagcagaagaacatgacgacagtgacataacttcacattgaagggcattgcacggttcagacttcaggcacaggccgacaggcgcctctcatctcaacgcaacaacgcgttgtctgctcccaaacacaagagggaaccagtgattaacatttaacagcatggcaccacctatgtcaccagcaattcagacatcatagtttccagtcacaaatgattctgacagtattcatgttttttttttgaaaaaaaaaagaaacagctgattctgatctactggtttcatcagcgtctcagctcagtttcagcaacaaaagattctggtttcccatgagtcatggtcagcttgttcccttcatcactgtccaaaactctggaaaaatccagtagtgatgtactcatttctttcagtcatgcacagttgttatgagatttcatggcaaaaataattgcttgggaatcaacattcagtgataagcactcattgtcagaaacgtccacactcatctacaggcatcagccaacaaaaagagactgacaagcttatccaaataagcattttggggaagacatggaaaagacatgaaatggacctaaattccttcagcacttcaataagttattcatcatgtctatcgaagattgaacccaggaaaaaaaaatcaagcaaccataatacacatggttatcgaaaggacttggagtacatgtctacagacaggtccagaaatgtgcaaaatagatgaattttgtgacaaatgtgcaaaatagatgaattttgtgactaagtaaagtcttgaggaaattagtgcaaaaacaaaatttactgaaacggagaacaatccatatgccttcctgcaatagcatgatcaggcaatagacagaattaaatttgcaagtgagcaaaatgtacttggtcatatgcaattgtgaactgcaacacatcacaacaatttctttgttatatttcttatatagcacaaggaaggcacaatatataatcaccagatgaccatattttatatttatatgaacaaattaacccgaaagatttggttaaacaggggatccatcgtgcgaatggaattacacaagtaatattgctcctcggcttgttcatttcacaatcataaaaccgcaagtgatgaatatatatattgcatactaaacaaatagacagaagaagctgatggatacgggtgatttcatgttcataatcacaagatagcagcaagtaataatagatacgatgatttgattgattagatataacgcaatccagtacaaaaggcacacggatattcacagccggaggcagaaatcacgataggaaagacagatggtttattgtttggtttgtcacaatggctaaagatagcattcactagcagatggaattggaagacatggagaagaccaagacacatactagcaggcggcgtctcaagtaacagtagcgtagtcatacgggcgggagcttgtcgtccttgtgcttgtcggcgtcggcggcggcggcggggggatcgggatgggcgtcggtgtgggcgtgggcgttggcgtcggagagcacgagggggcggtccttggattcgtgggcgtcggcgaggtcgtcgtcgtcgtcggtggagaggttgatgcaggagcagcgctcgagggaggcgaagaaggcggaggtgacgctggcgcccacccagcttgcccagctctccatggccgccgccgccgatcgatccgcaaggctagggtttcgtcgtcgtcgtcggtgggtgagtctagtttagtcaaaggggaatttgaagcgaaggggagaacgagcaaagcacgactcagccaaacacgccaacggagaaagcggacacaaggcgagcaggcccatcggcccaccaagcccatagatgtacttcatgggttgccttggggattttgacctcctccatccgaccagtagtagtacatgtataatattttttttccattttctctgaaacaaaaaggataatcttccaagctgttttcacatccacacaaaatggcttcgtcggagaaattaaccatacgattgcaatcctacggttaatcaatttctatgttcgcttttggctgcatctctggatacctgtggcctttcctttgtcacggtcacccccaccatgggtagacacccattcccaacttcccaaggcaacaagcacaaccacaacttctcagtaaatccacatgaaataaacataaatgatgatttggcctcaggccggtaaatgttacatcggtgctgcacgatacagatatatatgttggtgtctttctttgtagactcgctgtctctgtatatatatcatcactggctctagattaagacttgagcatcttcttgtagtccttgaacgtgcctgcgaaaggcgacaccctgccttccgacaccacccaaagctcatccacgctccccgttatcaggtgctcgtcgtgactcacctgtaaaagataacaagtcacccatatagcttgtaattagaatgatgccaagtcatcagcttttacaccaaaatgaacgatcttagttttaccattagcactcctccctggaaaacgagtaaaccctggatcagcgcctccacagcatccagatcctgcaacacacacaaacaaacatgttaagttgtttccctatcctcgcgtgtaaatcatcgctactgaaactcccttacaaagaggggaaaaaagatatccacctaaaagaacatataaaaaaaaacagggtgatttacttacaagatggttagaaggctcatcgagaagaataatgtgtggcttcttgaaggtgatctttgcaaaggcaaccctacttttctgaccacctgggattggaaaggctctaatcaggactgacaaatttaagattctacgagcagatgaatcattgggcaagaggatagttctcaatttctcatgaaactgggaaaggccatatgcagcctttaatatgcttaagacatctatcaaaacgctctcattacctgataaagtgtacattggttggagggcaagatttcctgtaacaccgaaagaacccaagtgtgccctcagtttctgttcaggtacaccctgcaaagagcatataatacattttttatacttagatcaacgttaaatgacaaacagactgtatgtttggtgatccatacactgtgaacttcatggtgcaacctagcaattgttgctggatgtaaaggaaagataaaaatgatgcttgaacttacagggtagcatctcatcatgtacaaaagggggttcactgttaaatcaagcccatcaacatggtgttgattgaatacagccatgcgaacctgcaaataacagccgcagcaataaataaatcaacaaaccgcagataagatgtagcagatgaaactctggcaataaaaggttatattataacaaaattatcactagcaaagtggtcaaactatacaggtaagaggcaaaatacattcaaatataaaggtccaggttcagagttctctgtttaattcagtaatgacattgatacagacaggagaatgtacactccagaatctcattataaaactattgtgaacctccatggctccatgtagaaactatgcaatcatgccaatcagaattaatgtaatatcggtaatgctaagtagtgaaatgtcatgactgtagcttcagaaggataaaagaaccttgggagagcggaacactgtccctgaagttggctgaagatctccagatattagtttaagtatagtggatttgccaataccatttggaccaaccactgaaataacagatcaaacatgagaccaaaaaaaagatgtatcgtgcagaaatactaggtatcattctttgttagtaagatgagtgaagcaaagcaacatacttgctatgcggctgtccaggtcaataccaaaattcaagtttttaaataaggtggggcctccaggataaccaaaagatgcgtcactgcacaaacagatcgtaacataaatacctcagaatgtactaactgctagatcttaataagaaagctagaaagaattacaaatatagtagcaagccagagaacaagaaaccatggttgcacatgggaagagaacaaatttcgttaaacattgaaagaaaacatatcagaaatgaaacctgaagctgatgattggtggtccagggcggtcatctggtgttggaaattcgaatttatagctgcaaagaattattcaggcaactatctaagctgattgcatataaaagaataaacacaacagatttaagatgcggtgatatactctggatcactgacgaccgcatcaacatgctccattcgctccaatgccttagtgaatacagataaataaatattaaggcacagactaaagttatcactggacgactcttaagtgaaacaatagcaaaggtaatatttggatttgcagaaattcaatggagtgatgggggatgtgagcaagcaaagtcaccttgattcttgattgaacaagtgatgctctctttgcattgtaacggaacttgtcaatgaatgcctacacagaagaaagaccaataaacttcacttcgatttttcaataaggatttaattgcacatagtagttgaatgttttcagatagcccaattaagcttttgaattttagcttagactagacaaacagttcttctgagcttagttaggtctctcaacgaatttttgaggctatggtacttgctagaaagtagaaacagatccaacctgcatgtgggatctggccttctcatttgtttcaaaagctttctgctggttcttaaggtgctcctcccttgtcctctcgaatgtgtcataatcacctttgtaagcatgtagcttttgtccatgcagatgaagaatgtcggtgacgacctaagaatttattgctatcagcattaagtgatttacatgacaaggaaaaaaatgcacatgcaaatatactacatatgaattaaggacgctctgtcaaaattagctccttcatgataatatgacatgatcataatcatcatactgcataccgtattaagaaactccctagcatgtgatacaacaatgaatgtctttggccatttcaggagatatgtttctaaccataacacagcatggagatcaagatgattctgcaaaataatatcttgttagcataggccagaaagagatgaaacaaattcatgtttttaaacttactgttggctcatcaagtagcaacaaatcaggctcaatgaagagagcacgtgctagagcaattctcatgcgccatccaccagaaaactgttttgtgcgtttacgttgcatttcaggagtgaaactaagaccctggaaagagttccaccaatcagaacatataataaagtgcgtactctggcaagggcatattctactggaataatcaggatatgagttatgaaatgttcaatttcatgcaataaccagcaagaaaacgtgatagcctgggataaagattatttgttgttgaaagtatattgataactaaatgaatgataggtatgcaaccaatgtaactgcaacgagaaaattggaagtgaaacaaaagatacaatcctacatagtacaaattgtacaagcaagaaaaaataacaggtattggatgcccagaaacagaccgccagaattgatgctgcacgagcctctgcagcatcagcatcaataaactcaaggcgtttgtatatctcctcaagcctcttgctgatagcatctttgtcaagaccatccttgcttttggacgcgctctgctcaaactcagcctcatactctagatctttctgcacggaatcgccaaactattagcaaagcaactgaatggctaaatataacaggacatacatatcttaaaatgttaattctgcatttgtcaacctgccgttgaaccagatgagcttcttcttgcaaaagttgaacccgttcaatatcagcattcagaacacactgcaaagctgttgtgtcatcgcccacaacctcttgctcaacatgcaatatctggcagttcttgggaatcccatcaatcgcatgcatcgccatagctctgagaaaagaggttttccctgtaccatttcttccaacaagacctgaagtgtgcatggaaattatcgaaatcattggggtaaaaaaaaaacctggaacttatacagaaaactttcaaggcaagaggtgatgaaaagtgcaaagataaaaagcacatcgagggtctgaaccactgactagtacagacagaattaacaagtttggcatttgtgcaatttagttttggcttttggtaaagcatagacagttaggcacgctattaaggaaaagtgttgcagagatatgtgtgacttgacatatacgattacaaatgtttcattcttcattcctaagttattcatgccagctacgaagtgaacaacagctcaagaagaaacctatgctgtaactcaccatagtgcctcccaaaagcaagtgttacagtgcaatcttgaatgagatcacgaccaccaacagtaacactgaagttctccatatggatatccctaacagctggcccaccagagttattgtgatttacaaatactggaggcattccagccctaagtgcctccatttcagcaacatgcgtttggtattgagcctgcaccaataaaaggacagtgtgcaacaagataacatcaggaaggaaagcatctccagcagcagatatacttttgtcacaaaaaaaaacacttccaccactaatctttttttcttcaccaaagacaagcacatcatcctctggtagtgtaaaatgatcaattgccaacatagagaacagcttacctctctttgtctctcatcctttctcttcttccgttcaatcttggctttgtcacgtgatgaaagcaagggtccatcaaatacatcagcttgctttttgggggcaaccttatcgtccattccctcgttcatacgtaaaggagtgacaaggcttcgcatagcttgtttaggttttaccaggccatgctttccaaatttttcacaaatcttactgcagacctatattgaaaacaaaagaaaatgcatcatggtcctgctaaatcagaatcagaatacaggagttccttgttttccctctcaatgtttcgtctttcaagatagttgttgcagctctcttctggccaataaaaaaattatggaaacaaatagaggttgagtaacatagatctaacagaccactacagaacataagcagtgattgatctacattgttgttgcccttggaagccaactgaatattattcataaaatgtgagtgctaaagaaggttctctaggcatgtggaatccacagaagatgagtcaagtgcttattaaatggatgacacaggcacaaaaatcgaaacaagctatagcgaattttagtagatgagaagtagccatacaaactgtgggatacatgacaagcaaatctaaagctctgctcaaacgggcgatgaaccacataagcatccataccacctcaatcacagcactgatcaagcgaagctctacccaattagacaaacatttaggctactgttgggcggacgacgatctgatcggtggatgggggattgcagcacagtaataaaaaataaaaatcaacaagcgggcggcgatggcgtagggtggcgggcgcgtggtacctcgaggcagtgctcctcgtcggcgacgcaccgagcgtcgatgaggaggtcgccgagcgcgtcgaagatgccgtggccgtcgggggcgccgaagtcgaagtcctcgtcggcgaggacgttggcgatgtagtcgatgatgggctggtcgacctcgtcgacgacgtcgctccccagcacctccgtcaccacccccatgctcgccgccgccaacgtcgccgccgccatctcgcctctcgcgacgcccacgcccaacgaaggagaagagaagaagaggagggtttgctacctactcctctctcccgtctccagtctccacacagatgagatgggtgccgtccgatgtggaaatggacggtccatattgacggggcctttgggccttgatttgacttcgggaaggacggcccaatcttatcagaattgtaggcccagtattgaaattacagcagcttcgtgatgatatgtgatatactaggatgacaataaaaatgccttcttagaaaatggatggatgtttatacagtgaaagaatttttgcaacaaaattttttttggaacaatggatggatggatgtgaaattttattgcgacaaaagaaaggactaagttggagctaatttttgacgggatatcaaactaaacactcttgtcaaagtcgactacaaatcgttcacaactattagtgacttgttccaacccctcgatataaacaaattagataccaaattctaatttgtagtaattaactactaagacctgaagtgaattacatgagacaaatccatccccaataataaccccttggtcatcttccttcctgagcaacacctgctccttcatggtcctcggatatctcgacggaacaaccttgctcttagtcttaggatccaaataagaacagcacctacccaccaccctgtcatacagtgatatctcctccagattaaccgcggattccatcacgcgcctgatgaatcccacgaagtgttcatcgggttggaagccgacgatggtgagcttggccagattacggtgctcgaggttagccaccgatggctgccattcgacgttcgatttgtcgcagtagccgttctcctgccgtgtcgtctcgtccctctccatcttgcagcagtgatcccacactctgatggagagactctccagcctcggtgcggcttccacgatgaacattgtccaagcgatgtcgcagccttcagggaggtcgacgagagtgacatgtcgtagctcgcccagcactggggctagcctcttccagccttctggctcaacccaaatctgcaaatcaacaggttgttcacaacgagtacgtgcaaattaacttgcaaagattcagatttcagaatgagattaagttgatgactaagtgtgtggcatgcagtcaaatgatcatgtaccttttcgctctggaaattgagattaagttaatgcagtgagggggcattagcaaggaagtgacttaatcggatactgttcttccagctcatgccggtgtcgacgaggctcaagctttggagcaatggagtgtaaccaaaaaacagtggatcccgataagagatccagccctgacatttcatcgtctggagcttgggtacatggacgagctcgatcgtctcgaaattgccgtgtgatatctcaagctcaacgagatgattgtgctctacctgcagcacgctgcgtctcaccgatttgcagttgaacagccgaagaaaccgcaggtttttgcaggtgaggaggatgccggcgatgtctgaatcgccgaaccagaggcgggtgaggccggcgaagacggccgggtaggcggtgaacaaggtgtggaactggccggcgaagtagacgaggtcgtccgcagcgcttctccgtcaggatcgagaactcgacggcggcgccggcggcgagcttccgggcggccatggcgcgggccaccgtgccggcgatggagatgcagtcgtagtacctgaggtagaagcggagggcgaggtggtggacggggatctccggccgccggaattcgaggacggcggccgtcaggtcggccacggcgccgttcgtccggaccacctcgcgcagggtgaggcggcggtggtttggccgcgagaaggcggcgacgtcgacggcgatccgggacagcatgtcggggagggtggccctcatgttcttggagaggatgcaggttttcatggcgtcagaggtgtccagcctctccaagatgttgagcacgacatcatccggcaaatcgttcagcctgtcctttccagggactaaacttggtgtctgcatcgcattgcattacatgcagatcaaattaagctagattaatcaaatcaaattagtaaatagtagtagcagaagaagaagaaggcttgcattgcatgcatgcgtacattgcgcgtgcggcgacgctttctgttcttcagggatgatctgagctcgaatgatggaggccggccggcaactcgatcgggcacgcacgggggaattcgatttgttgatgatcgccgacttaaaccctaaactgaaaagagacccaaaagcttccgacatatctcaaacgtgattggaatttgaaagagactccaagaaatcttacaagtccattggcgttaagataccaacacttaacgtcgattaccctaaatattatagtattgttttggaaacgattattcggcaaagatagtaaatttcacttggtgccgtgcggctgaaattttgcacacatactgagctttccctgttctgatcaaatagatatgaaataactctgcagtctgcactacggtcaagcccagatcttgcatacacacggttacaaacatgcttgagcttatagagttatcatgcattctctggggtttcttaatccattatattatctaaaaagaatagcgacaaaaataacagtggaagtttacattctaatttttcccaaattcagacaatggaaactgaatacagattcaatctggtacagaaggggaaatttggtaggggtagcaaactgaacacactatcaaagtcgagtacagattcagacaatagtgaaatgttccagtccctcaaaaaaaaaagaaccattccaaattaattgaatggcaaagcagctaagaccggaagtgaattatatcagaggaagaagccatctccaataataatccctccgtcatcggtgcatgtgtgacttgcaagttactgacgggcaggacaggagaagagaggagctgcttacgttgcggatacggcgactacccttgttcttcatggttattactcgtttcgatcaatgcgggcaccgatggattggatgctttgcaaggaatccgattgctgatcacctgctgacctaatcctgattatgtatccatggacttataagccgtaatcttaataactgaagggagaagagctccatgtcgattacagaaccaaaagccttacgatatctcaaacgtgacgggaagagactcaaaagaattctcaaacgaaaaaggaatccagtggcgttaacattaacataccagcactccacatccaataatatttttttttattctttaggaacggcttctttggcaagaaacaaagtttcacttgtggcggcagattttttttcacacgtgcgggacttccagtgtcaaaatactacaacataaccgaattctgatctgctgtatactgcatacaaggttggttatacacaagctgagaagctttcagtgtgacagcaatccgcggataaaatgaggagaatgataacgatcaccaagaagatagccaagcaaaaattacatcaatcaaggaaaaaacaatttggggataaatggactccaggaaaaggtaactgcagttcgagagggccgaactgatcaataaacatcatgcagcatacattaattcccaccagaatttattcagcaggtagcttttctttgagatacttcagaattgctttcgttcctcgctccagcagagtccgccgtatgctgcagacgaaatcaacaggaagttcagtgatttttctgccggtgcatgtctgaactgcaactttcttttttttttccctttcatattctaaatatgccctgagaaaattatggcattacgatggtttccattttaatgttctttcacatgtagttccgaattatatggtgagcactgcagaatcctatggttatgcacgatataaaatcggtagcagcacaggtctacatggttccatgtgagttgggtttctatttcaatgtatgcatgcatgcaatgggctcaacaatttgttcctacttcttacctcctgaggggatttccatcaagtttcaagacttgcaggttaggctcaagcaaaccctgctcaaaatagtgtccacaagaagattagagatttcagtgagtttgagaatcgtacaacttcaaaacagtactttcagttgatgtcggtgcatccgatacatcatcattaaagccaataacttaccagctcaggtgggagtgttgttatattgttgtccgacagatcaagctcaatcaaagaagttaaatctttgataccctgtgtaagtgcaacggattttgcataagcaaataaaaagggcgcacgtgccattcaaaactttctaaatgcacctgggaatgtgaaaagcatttatagaaagagggggaaaatcatattccttaaatagagaaccaagtgtttacctctggcacagatgtaagataattctgactcagatcaagaattcgcagcagttttaagcccaataaactatcaggaaatccatggagtttcattcgtctgctcatatatagagaaaaataaataagcttccatagaacactccatagcttagatgttttgcatatgttacaaccttaggtagagttcctttaggtgaggtaatttcgaaaccgcagagggttcaggtagagaagaagcactgccacttaaatctagtacttcaagtttagacagggcctcaagatcagtagccaatatctgcaggaaaaacaagtgtgttacaatatcacagattagcatgcagattcgaagtatgtcagctatatataaataatcactcttttggtaatgtgtcattccaactcttgaaagtaggaacaagaaatacatgcagcacattacccccacacacccaccccccccccccccaaaaaaaaaaaatcttgtctaagatgtcttggcacatgagaaaacattaactgtaaacatggtattaaagctaagaaagaaacaatgtgacaatccctaaaaaaatgtaaaatgacttgtgtctaaacataataggctagatggcttataattatgtcaagtctttatccatgttgcctctgcaccctgtagttcaattcttctaagtgttgtaacagctaaaccatcaacttcttcaatttcaataatcaacgttgattaacttccagagattaacccatcagggaatcatgatccaataccaagaaatttgcaaaagaaaagatatgaagaccatgacattacctctgccaaaggattgttgtctagctttaacaaagaaaggctggcaagggaggagaatacggtgccaggccaccttttaattttgttgttagacaaaatcaaagactgaaaaaaatggtagattaaaaagagtaaggagttatatcgaaacacttttatctcacacatacaatggaattgatcaattgaagtataacaacatcaatattatatctgtaattcagaaactcacttgaagtgacgagcataatgacaactcgtttggcagatcttctattgaattcttagaaagatctagtttcatcacatcatttgtctcccaagctgcaggtggtacactggtcacaccaagaccactcaagtccagttcctgatattgcaccaagttaggggctattgtggaaaaaatgaaacgatcattggttattccatgaggctccataagatccaatgaccaagatattttattcttgcattggtagtcatgagaatacattgaaaaagtcgacaagtttttgtaaaaatacaggaaacatggcagatagaaacacacaaatcagttactcttttggcatgaatgagacaatccatgaatggcaaataccacatgtgggtgaattagctccttttaaaaaagacataaaaagagatctatcttatgatatacaaatatgctgtcgaaataattaaagtaccttagaagataaagacaatcttcttgctgcagcaatttgatcatcttttgttggagtgcttccagatcctgatgctgcacaggaaatatgttgagctttcgagtgatcatggataatggttctcaaatcagaaaaaaaacaggagacgtggcaaagcttgaagcagataatgtgcactacaaatacatcattatgaacaataaaatgcatggatattgattttgtgtttttggttacctccttcatcagatgaaagccgactgcgcagatactttaataatgctgttgttggtccagaaaccaaggaactggtaaccaaaatggaacactgtattattatgttggcagttctgtttagaatcctgacaacctctttgtgaaaaactaggacaatggcatgggcatcatacctccgaagtgtcctcataggattaccagtaagcagaagctttcttagggttgtcatagtaccttgaatatagcatgccgaagcatatgtgagtgtccatagtttcgaaagttcattaagatagtagcacacttgcatagagcatgctaagttttcaaagcagataccccatggaaaaaaagaatcagccctatgatctatccaacacatagagatgcatgcaatcatttcatatcataaaatttcagctaaccaaataggaaaataacaaaagtggcatcatcgagaggagcattgcacagcagaaaaaccaacctagttcagcaggcagaccagataatgagttgtttgatagatcaaggaaagagagcttgagtctacaagccccgacaggatactcctttagctggaaaagtgacatattatcagaaaataataaaaaaaacagaaatgaacttatttcttctgtaatgttctgttaattctagcaggattggttgcagaagttaagctcaatgttacaacatgagaagtttgttgttgtctaataaagtggttttggggatcaatatttacatcaaatattctgaacaacactgttccaccattccttccgaacatgtaagtaactgagttaataagaactcaaaatatatcatagcgccatccctctaacaaaacagacaggattagacaagcctatagatggtgggagtgactatggtaaatcacatgcagtttacatacactattaatgaagctcttgggatttgggaagtgggaaaatgttaagggagcgaaacattcatgaaattttctggactggagtgtatcctagccatcccgagatgatccttttttctcaaaaaccatcccaagatagtcataagcaaaaaagcctcatgttagaataaacaaatgatgtactaaaattttgagccacacagctacagatttgatgtcccagcaacaaagaaatcaaatcaagagcctttctcccagtatcttcagattttaaaatggtgcagaataacaagagtcaggggaataatagactattaaattggcagtatctgtgaaaataaatggagtaagacctggttagagtgtagatcaagtattcccaagttcgatagcatgccaatatcctctggtatggatgtcaacaagttatttctggaacataaaagtacaaatagagtgaacttgtgctgtttaaaaataagagcatggtaaagaagtttgtccaaaatagataaccaaccccatataaaactctgctagagaagagcaatcttttatggaaggaggaatcagggttatttctacataacaaaagtagaaagccatcaatacagataaaaatgaataataaagagctagcatatgcgatagtatggtagactaactgttctgatgcaggtccagacgaattagctttgacagtgcaccaataccatccgggatggctgtcagtagattctttgctgtacaggtttgaatgttaatctcaggtagaaactcaaggatatcacataggttcgacattatttttggtactgtggctgtgtggcataccagcattcatctctgtaagcattgtccatgacataaacatcttgtctgatagcgtcacgagcttgttaccctgacattttgcagtaattggagttttcaagaacaaaagaaatgcagcacgaaaatatgataaatccagctttgacattctctataaggagtatatacctctagattcaatctgaataacttggaacagccagcaagttcatctggcagtacggatatagtgttgtttgacgcctacaggtagggcattacattatatttaggacagaggatgaagagggaagctataaagatgagctgtatatatcttcatcaaacaaagaaaccttatggagaaaataaggaatacatcgatggtggcttacattgagttctgacaactccaggcatctggcaagactaactgggagatctgtaaggcaattatttgagcagtcaaccctggcaacaacaatgcatcaacttacatgaatataatcatacatagtctcaaacattgcttcttgtatttaggcgtcatactaattgtcaacatcataacatctaaaatatgtgacagatggttttagaaatatgaatagccaaattttgagcttgttttaacagtacattaatgaaatcaattagaaaagggacatagaagacatacttgactaaagcggtcgcaaaaccaatctcttcgggaaaagcgtttatttgattagaagatacatccaacgattttagcaaaggaaggctgcatggaaaagagccataaaaaagttcagatgatattagtggtccacggttaacaatggaaattactccctcctgtcacaaaaaccatgcctgcaaacttgaccagtaatctctatcgaaaaacagttgaaaatcttgatagaatgataatattatgaaactggttttgaaggcagtgacttcaaacatgtccacaaacgatatgtttccatgaccggagggagtagtaaataaggatagtccagtacatactctccaatagctgcggggagggaagaaatattgttgtgactaatgtttaatacaacgagcgaagacaaatttctgaggtcttcacgcaacacctcaaggttgttatgagccaatatgagcttctgaaggtcaactccctgaattacaaaaggaaaaaaacagaaacagaaacaaatttgattggcgttgcttgatatcccttgtttatgcagcatgtagggaaatagtcatacaggaagggggcgaatcgatttacctcccaccatttctcatcctgagcccccgtgtccaagttgttgtacacctccttgggtacctccctggcagaacaggcagaggtgtggcgtcagcgagacatcaagaacaagaagagcgaagctgtgtgcgcgcgcgctggaatcgattaacccatggtcccctagtacaccggccataatcagacaatgcaatgcagtaaactgatgtgagaagcaggtgaaggcgtcatggcgggaagggattggattgcgtcgcgtccgagcagtgggcggcggctacagactaggagagatcatcgtccatgtcgccgatggcgatccaaccgagcgagcagagagagacaatgcacctgagggatcgattggagaggttgagggagcccgactccctggcggatttgagcacccgctccatgcaagcagaagcaagcagcctccggcctcagatcgccatcgccggagacctgatctgatctgctgcaccagcaggcagaggcagcacgagcctacccacgaagaagactagaagagagatcatcaacttagcaaggacggagagctcaaacaaatcgagatgagatcttgttttcttttttttttctttttctcctctcttctttggccacacacacaatggagcgagaaattaattaaattaaaaggaaaaaaaaacagtattagtcaggcccactaatcctgttgggccaaaatcaacattgaggcccaacgtctatgtgatttggaccttggggtgaacaaatcaaggaataagttcactttaggttccttaatatgtcggcaagtctaaaattcatcctgtattctgaaaaaaaaagttactttaaaacaatcatattaatacatttttactttttactaatattcaattaatcacgtgctaatggataacactgttttttgtgttgaagtactttcccaacttctacagagttttctatagaaaagttatttttgaaaaatatattaatctatttttcaaggtttttaatacttaattaatcatattctaatagatttcgtgacgcactttctcaactgttactccctcgacttcctcacgtacccttcctaaacgattaaacggtgcggtttttacacaaattttctattaaaaaggttcttttaaaaatcatattaattttttttaaaaaaatttaaactagtactacatccgtttcaggttataagactttatagcattgcacatatttatatagatgttaatgaatctaggcacacatatatatgaatgtaaacaatgctataaagtcttataatatgaaacggaggaattacttaattaatcccaagctaatggataacaccgttattggtgtggaacgcagacaaccgcagaggcagctcgtccaatgaagtgtactacatacaagtatacaacatcataatttctccccaaaacagttatttctccgatgcaacatttgcaggtataccatctctttttttgcatacgtgcacaatgctggtgcacattatacataacacaagctggttccacgatgctacttgacaaaagcaaagaacaaaacaagagtttaaacacaccgaaacaggtaaaatggtctttaattattgattttcaaatcgaactaagaccggaaatgaatgacatccgggcagccgattcccaatccctctgcaataatctgattcttgagcaactccctcttctccatcgtacacggatatcttgacggggaaaccttcatcttgatcttaggatccagatcaccgcaattctcacagaccttcctgtcatatagggatacctcctctagattaactgccacttccatcacacgcctaacgaatcccaccaagttgtcgtcgggttggaagccatagatggtgaccttagataggttctcgtgcctgaaaccatcaggtgcagatgattcccaatctacaactgttttgtcaccataaccctcctccctcctgtcctcttcagttttcatgttgcaccaacgatcccatattgtaatgcatatctcctttagggagggtgcagcttcaagaatgaacattgtccaatcaatgttgcatccttcaggaacatcaacgagactcacacgctgcagcttgtggaacacaggccctagtagctttgggcattctggacgaacccaaatctgcaacatgagggtaacctaaattaattcagaatgcttacacgcttcagaattaatatgctttttggttttatttctctattttgggctttattctaaagccagatcagtaaggttgatcttccatgtaaacaaatactccctccgtattttaatgcatgacaccgttgactttttaatcaacatttgacaattcgtcttattcaaaatttttgtgtaaatataaaaatatttatataatgcttaaagaacatttgataataaatcaagtcacgataaaataaatgataataacataatttttttaaataaaacgaatggtcaaatgttaattaaaaagtcaacatcgttatacattaaaatacggagggagtatgaaacaaagcgtaagcataaaaatgaccggaacagcaagcagctagctagtaccttttcgctttcaaaattcaggagcaggtcgcttatggaggtgacggtagaaaggagctgactcaactagtgaggcttagacttgaaagcagtgggacatccccaaaagacaaggggtccccgtgacagtcccaatgaacataggccatatgtctaagctttggtaggcacttgagctcaacaaactcaaaatccccatagttgatgtcaagctcaacaagttgcgggtgctctatccgcagcacggccgggtcatcttggttgagacaagagaacaaacgcagatgcttcaactgtttacatgtggtgagcaggttggggatgtcaggttcagcgaaatgcaagtgttgtagctgcaggcgtgtgaggccagcaaacgcatctggaaaagcagctagaaaagttctgaactgcttgccaaagcagagcatgtgagtttcttcgcaacagcctccttgcttctcggttaggattgtgaactcaagagtctcgaggttgtaggtggacatggcgtgttgcacagctttgccgatggtgaggcaatcatagtatctcaagtagaatcgcaagctaagttggcgaagggcgatctgttgactcctgaagttgagtaatttctctgttgcaccagctaaagcctcattcatctgaaccacatcactcagtgtcaaaagatcgggtgcaatcttattgggcgtgaaggaattggcatcaacaacaatgcgggagagctcggcagggagcttagtcatccttttgcaaagggtgcaagctctgatgtcatcagccgtgtccagccgctcaagaatgttgagaagaacgtcattaggcagagtggtgagcctatccttatcctttacagagtggcaagctggtttctacattgaattatcattgcattgcatttagtattgccgaaaaactaaactaacaaagtgtaggagaatcaatcaaatcaatgcgaaggaagagaagaaagaggctacttacattgcggcgacctttcttgttcttcgccatttgatacgaggcttatcaatattgacttgacttgttgtacaagtgtcggtgggtgttgtttggataccgggaacacctcgcctctctatctattttatttagtttagagaaagagaaataaataggaatcctattccaacaaactgattgcttctggacctcctgccggcacccaaacacaaacgaaattgttgttggaagtcgattctatttcgaagagaccttttacggtgcttgaaaggtacccaaggtacctctcctcaacttaaacatccaccgttgattctcaaagagtatattaggaattggattaacataaatatgggcagtttagtaatttttctttagccatcgtgattaactgttctttatctttggttatatcttcctgcaagcttgcacacataccccgaccttcttttcactgagttttgaacgctatatgatggatgactccaatttcaaaactagaatttatacgtccatccatctctattgtctttagaaagtaatccatacaaagagatggagggacatcgatcaatttttcatttagaagtctttacaatcacttgcaaatctcatgtatatatatggaaagacgcgcgaatcaattacctagttctaatcatcaattatgtggtcttcaattagcatgtagttatacgatctgcaaacactaatcaagtactcctaggcatgtgcattggcaccaacggactgaagacgttattgtctctccgcgctccggccggaccaaattacatatctaacatttatgaaatatataaaccaaattacatatctaaccttttcctagtaatacctggcccacacttttaagtatcttttcataggtaccttctactgtgaatcgttagattggaagtcatcaacggatttggtgcactccaagcacggtagaaaatctacatagcaagtggcggcgctcacccctcgaactccaagggacgtggatggggatgggttgggctcagtctccttgcctttggcccaacacaattagtcggcctgctgcccaatagaatcatccgatccgacgacaggcggccgggccgacgtcctcctgctccgcctcttcaattcacgcgccaccatgtcgcgtcgccgcctgccggcttccgcgctcgcctagccgtaccctgttgtatttacttgtgattcttgtgattttggatgtccggactgtaagaagtataatttctaataaaatccatcgcattcgtcccggacaccctgtcgtaccagccattggttctcctctccctcccgttcatggaacgtgagcgaaaccctcttcttccacgggcagtgagccccgtttgcctaccacgcgcacggctggattcgaggaaaaggtgccaacccaagtcgaaatatcagcaagtcgagttgagttcgtgttctaactacaaccgtatctagtcagagcttctttttcttcatgcataacactcgagccgtcaggcaggcaggaggtcgatcaagcaacaacagagcaggcatgcaggatcacccgcatcgcccgatgaagaataagaaattaaggtcaccgccgccacaacaacgtaagctagctgccctcttccttccttcgagttgatttgtttgattttcggcgacctatactatatctgaatgcaatattgcaacggtaaattggtgatgcaacgtagaaaccagcttgcaaccccgtatagaaggatgataggctcaccaccatgcctaataatgttcactcaacatcctcgagaggctagacatgggtgatgccataagaacttgcatcctgtgccaaggatgctaagctccctgccgagctcccccgcattgctgttcatgtcaattccttatgacactaggtgaaacatcgcgcgtgctgatgtgagagtttactatgataacaataagtaaaagttgttggaattaatgaatgggccttagcccactcgaagattaattctttggaaaaatcacaaaagcccacctcatgggatggcatgcatgtggagtttagtaccaccttgcttattctaggagagggggacctccttaaaaggaaggatgccctcctagccacttgaagcatgtgtggtggagagaagaggggaaacacacgcgcgcgctcgctcgcctcgccgggccgggtcggcggcgcgcgtgcacgacgtacgcgtcgaatggtccgacgaaaaattggctcctcacccttgcgcagatgcagcctccttttgcagttttgttttgctgcaaattcggattagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacttgccgtcttcacgcaacacttgcgaaaacaatctagggtttgtctcctactctgtactgcgccgtcgctcgtagactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatgtctataatctcaacaaaagtaatgtgtaagatagcttaaacaacatttgtttacataagttgatgtgatttaaatttaaatagtacgtagaataatgattcaaatataaaactaagatgatgtggctttacagagaacaaattaaaatacgaaagataatttagaccatatgtctaagagctaaaaaaaattgagatgatgttgcttgatgagagaagaaaagaagaaagataatttgaaccatagattaatcatctaaggactaaaagcaatttatgtaatatgacttaataagagaaaagaaaaataatatgaactaagtgagtatgaactatatagatatatagcatattataaaaaaaatgatggagagatatattaaaatattatgtgggtttgatttaacatgcttacattttaaatctctaaaatttaataaattattaaattatagataatataacatgtttgcatgatgcttacatgtaccagttgacagcgagacgtctgtggtgacttcgtcaatctcaagaatatgtcggcccagtcttcgaagatgctcataggggtagggtttgcgtgcgtgcgttcatatgggtgagtgtgcgtgcgttgcactgagtaattctcaaaaaaaattgttagtggatgatgatgtgacatctttgcatgttaagttttaggaattagtaggttataactatatagtaagagatgattaagtggtgtggttcggatgaatgacgtcgtggctaatgcaatagacaaacttctcaactccaggagtcaacatatcatccttcgtcaacttagcttgcgattctacctggggtactacggttgtcttaccatcggaaaagcactgcaacaagccatgtccacatgcaatctcaaaactgcgagttcacaatcctaccagagaaggaatgagacccctgtgaagaaacgaacatgctctacattttttttgtggaggctaacttgttttccttgtttctgttcctgttgtcggcataaatataaattagctgattcctgtaggaacataacctcggcatggtgtttcagcatcacaggccaaacgacggagccctgcaatattgaacgatgtccaatatgatgcttaagatgaaagcgttgcttgtgcatttaattgaaataagcatacaagttagttttgtgtgtttgtacttcaaagccagaagtttgtatgttggtaacaaacaatataatccgtcgatgggattgatgcaatggcgttaccaacaatagaattcgtcaatgaccgcgatgtgatggtctcaaataatacccaaggtaaacactaaagctaggaggcagaaaggttccatgggccggtgcaagccaaaatccctacaaagcattcaagcgagatactaggtgtccaccgagttcacagtcctaactatgaagtgaaactgctgagctcacaatcctaactgaaaagcaaaactactcagctcacaatcctaactgagaagcaaacagaccgttatgagaaactgacatgctctaaactcaagaaaatgataatacatttaccatatgagtctttaacgacacatatcaccttctccaaccacgacattgacaattgcattcatgttgatcatctgaggactatagctttgatcaaacaccattagtcctctctaatcgcaagcaatctcatgcatggaagtcatgtggagaacttgatgaaggaagcctggagcaagattgaaggtgaactagtaggatggttgccatgaccaaggtcgagcatatgacgtggatgaaggaaatgataagtttagatgatgaaggaacaattaaggtcattgtgggtatttgacatcatgtttttggtaaacaaatataaaaaaaggaaacatgacaattttggatggaatgatatttcaatactatgaaccaattctaatctaacaaggaggaaacctacataacaataagatcaatgctatagaactaaaattgtgatatctgaatgctacaaaatcaaatttgttaaacttttaatgattttagacattgtacaagtttgtgaaattgttccttagtttgtagcctttcacaaacaacaactttgtggctctaaaactattctattacatgtgtccatgaaaattgtgttttgtatagattggagatattcattaggtgaaagatatatttatatacaatatttagaagcagataaaaatgttgttgttccaagataattgataatggatatatatttggttttggtatactatgtgacacatgacaaaaatccaactgctgagtgtcactataaattattccatttaccatatgaagtcacttgacattaaaatcgtcatatgatctattaaggacccaagtagatacattatcaaaacaattgaatgactatatattttttttctaaattggtcgggttcaacttatctttatttatctcatactaatattataggttttatataaagtaaattgcatcagtagtacaagaacttggcaggtgggtgcgatttagtgcaacaacttgaaaaatgtgcaggccggtacatgaacttggcaatcaagtgcattttggtcaaaacgctgttacatataaatgattcaacatattttgtttcttctattatatttgtttcttctattataagcatactactagattattggtcatgagtacaattgaatatgtttgactaataaaatcacttggaaattatgttacaaccatttttatgcacttagttttaacgattattatatttttcggtttcaaatgacatactattttttagttttaacgatcattatatttttcggtttcaaatcaacatgctactttttattataagcaagcaaacttggaccatgatagacgtcattttgatgggtagacaaacctggaccttatgttatgttgccattttgattactgtatctcactgagtaggcaactatgatggagtataatctaatttctgtcgtgctttttctttggttactgtccaataatactttttttatttatgttgcagtaaatttttctttggttagtaattcaataataaatgtcaaataatacttttttgtatttatgttgtagtaaatttttctttggttaataattcaataataaactttaacggtaaacaactcaagtaaaagctcagcctgttcatacgctggttgggttggtttagttggttccgcagccgaaccagcaactggatggttttagccggtttgggctggttctagcaaatttgagggatgctgagttggtgggttggtttgggtggttgaccggtttagacggtttgagcccgtttaaattgtttattagaactgcacaactacactagctactacgatagctcttatatccacacttttataatctatcctgaaaattgagaaggaagaagcaattggcactaaactcgcaatgcaatgaccaatatatatacctcatttgcatgaaagttcttgtctaatgctctctgttttgtaccaatcaattctgatacaacagaaggttcaacctctaacactggccatccagaatattaagatttctttcacatacacagatgagctgagttggagattggttcatggtttacctgaaagtgtgagaggatggagcacccgctgcaatgctgcactaggttcgccgcctagagatccgtcgcaaggttgcctaccagggaggcaggaacagcttccctgagcccaatttctaccgcgccgccgccgccgcacgctcgcacgagggtttcgatgggagtatcaaattgggatgggttatatagtttcgctggttctatctctccctgaacacaacccatgtgatgctttaatagttttgacctaaaaaccgatgaagctggtaaaatcgctaagaacgggttggtccagtttgggttcgcgatttgtgctgagttcgcttgacctgtgaacaggctgagtaaaagccatatcacaatttcctggtaaaatgctagaatcttggccactgcttcacaattctgtacactcctattcatgtccaaacattcatgttgtgttttaattgttgttgttgttgctgatttaattttgtccttgaatttggtgtgttttaattgttgttgctgttactgatttaattttgtccttgaatctatttgtagaggagatgctcaacctggggggcctttcttcaaaggcaaaggcctgggagaagcgaggttagtcacttattcagttcctgcttattttccttttaatggtcacatgttttctgccctcaccgccctttatccgctatccgcagtgaagaagctgaacatcagtaacaatggtgtgtacccggcggcatccgcgaagaagcacaggagtagcgagatgttgagaactctgtcgttaggagtagcgagatgttgagaactctcattaggagtagcgagagatactctgttcctgactattgatgttgagaactctgtcattaggagtagcgagatgttgagaactctgtcattaggagtagtgagatgttgagaactctcgagatgttgagaactctcattaggagtagcgagaatactctgtccctgattgttgatgttgagaactctgtcattaggagtagcgagatgttgagaactctatcattaggagtagcgagagatactctgtccctggccataaatagtcgttgagaactctatcggtctaataagaccttatatcttctgctgcagtatcagctatttatgtgacgtctcattgttggtttgcttgagaaatgagaactagttatttaaatgtcagttttgcttggcttgagttcatttcagctttgcccggtgctgctgctgtaggcatgtaggagcatgcaggaggagctagaggtgttattctgttatgcggtgttattctgttnnnnnnnnnnnnnnnnnnnnnnnnnnnnnnnnnnnnnnnnnnnnnnnnn

SEQ ID NO: 9279 - DNA, 26687 bp, Oryza sativa
  unsure (1)..(26687): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttaatcctaatgcaatacttcaggcactggcaacccgctgctcctagatgtcgctctactatgtacccggactgggaggacttaagtgatctcgagggctgtcaccacctctacacctacctcaacgtactgtggaatatgcagcaattactggataataattacctaaataccacatctaagtaattaatatctactttagtgtttataactcaccaaagcaatcactatattttagttgattataatgaacaataatctcgtatgctatttaggaactaaccaagagataattctcacaagataaatctaaattactcaggaagaatattacattgaattcagagtaataaacagaataaaaaaataggagaagattactgacaactccaggattcttccgacttcttctactctactctcttcctattctaatatacaatatagtacaatagagcctcttataatttagctcaagcttggaagtgtgggagtgaagggagggagtgatgtccttttatagggcagttatgacggttgtgagaaggagaaatgtccgaactgcctcgcaaccgtcactgggagagcatctggagcgtccacaccaaaccccaggatcaacggtgatcaggggcgtttggccgaacctgggctgggccctcctggcctggccttcagttggtggactccctggactctcctctatccatttctcatagttttgggctgatttactgatgttttgatgaaattcacatcccctccttgtatggatacataattctcctcactttagtctaatttcctcccatcttcaaggtttatcatctgcatacaaatagacaccatcacttgtggaatatatgagattaagcacctatctctatgttgaatattttattatctggactttatgcagatgttggtggtatagaatcggcatttaacagccgccaacaatgtggcaatgagaacatagtggtatccatgaatgcacttcaagaatgagccagataagcaaaggacattcctgagttcgtgatgcatatagcaggatgaaggtacttctttgtatctgttaacaacagaattttgcatgagatttggagaagaaggaagaagatcgaagcggatttggtataaggtcgagttgatttccatgtcggactgcgcattggctgagtaccgtatcggctaaaaactggacaaaggcttgacttgccgatatggcaagtcgccaatatggcataacttgggctcggcatgggcctagacaggataaccgcattgccaatcagagatagagctcatgtaaggcaattatatctattaattaggttagttatgtcggtttgttagatattttgtaagagaccgccgtatatggtcttgtttgtatcttatctttagaaaggtttgagtcgtgtctataatggactaagtttgtactcggggtataaatatgaaacccttaacattgtaatatgggagacaatccaataaaacttcctcgcatcgccacccttttcgcttttacttttcaacgagttcacttcacaacaagtaacccgtctcgatggcttgtgctatcggggctattatgtcattttatccttgtatcatgaccattgttatcttatgtctttgttaatctagtcttagcatatcgatttagctctatcgactgcttctcgttttaaagtttctgccggtatcggctaaatcgtcttgctagattagattagcttagacatccaccaccctaaaaattcagtcaatgggttgactgtttagatatcgtgtttcttttcatacttagtgctgcatcagtacattcgacttactaaatcatgtttagaacaataatctctagcctgcttcttgattgttaataggggtagcatcggggtttcagccgatcttacctaatatacatgcttctttacctgtttcatgtatatttgccatctctatagacagatcatctaatattaatatattaagtctaggtcatattggctaggctatcattattgactattgacctctatttggtatattactatagattgatttgcttatatatttttgctctaaatattgttccatcgactactttcataatattgtcttaaacttctttattaaatctgatagacagtattacagctgatgaggcatgtttaggtttaatattcactgatatatccagtccatagccgatttggtctagctaactgcattggctgagaccaccaatgataagctatcggtcgatcggctatcgactgactaactctgcttttgtctttcttgctgattgtaggattaaatctactggcacacccttggtacactcgagcctaggcttagacctacactagagttaagcagatctcctagtgtggagattatggataccccatacctacacggcatgtatagtccgactgggtatggggtaccatgtttagatagaatatctttaagaggactcgggttaggttctaaacttgcatatcaaggaaatatctgagatcctagtcggttacgattgtattttatctgtaactacatattccgttaaggatatggactgtattttgtaataaggaccccttcccctatataaggaggggtccgggtgcctctaggggcacgattttctcccagatcatacgatcaataatacactcggcggattaatcctcggacaggagtagggtattacttcttgattaagaaggcctgaacctgtataaaattccttgtctctaaacccatccacttttccaacttgatagccaccccttttagtattgctgaaatcttgtttcgacagttggcgcgctaggtaggagtagcgtcaagttcttcgccgattggtgcgatgggttccgtcttcggcatcgacgacttcgtcttccctcccgggcaagtgttccggttcggcaacctagacttcatcaccaacgacttcggcaagatttctctcctcgactcagattcgaaccagtcgggaagaggccagatctccgccccgttcggtatcccgaactcggccgaggtctaccccaaggtcatctccgccgagttggtttcaaaccactcggacaagatccaatctactccaacacgaccagatcaagacgatggggcctatccgccaatcttgatgaaactccccgacgatttggctgctgtcttcactacaagggcgtcttctccccgtaggcctaggcgggatccggcttcagccccggtccggcctagctccagcgaagtcggcatcatactccagccactcggcacagtttcgacggaccaactggacggctaccttagctcccccggcgtcgagtcacgaccaaccgagaacgtagagtacgatgacttcggctatcgctacgacaaccgcaacctcgacgacttcgacgagggctttgaagataactacacccctctctacctcggtgttttcatggctgacaacgagacggaagaacagcgccaagcccgagaagcagaagggcgacatgtacaacaggaagccgaacgacgccgattagaagaggagcgctaggcacaatagcgagaacggctgcagcgtgagcaacaggaacgcgaacgggctgcaaaggaggctgaggaccgacgacaatgaggcttggatgccaggcgacgagcgcgagaacttatcgggcagcaagacgtcgagggaacagcagtctttcgcacccctcaacaaaacgcggttgcagcgatcactctcctcgacaccctcctcaaggaagacgcactcaaccatgctgatcacgtcatcaacatcttgaaccagactaagaccatgatcgccgcctcggtcctggttaactccgcaagcgtccgcacgccgactggcagccgagttccccatcttcgatctcaagattatcaccagccaagcctcagtatcgccggcgcgggatccaattgcaggagcaggggccacgaggagcgatctgtccactcgcctcccgaacgacacagggagcgccgagttgaacggccacgctccccacctcgcaggcgccccgtcgatcttcgtgatactatcaaccagcgccgcgcggcacgaggctacgccccccaccattcaccgaatcgctatgacgacgacgtggatggagtcgctgccttttcaagtgacctgcgtcgagtggattggccagctggcttcaagccgactagaatcaagaagtatgacggcaccaccaatccggagtcttggctcaccgtctacggtctcgcgattcgtgcagcaggacgagatagcaaagccatggcaaactacttgcctgtggctctagcggattctgcccgatcctggcttcatgggttaccccatggcacaatcggatcatgggcggaactttgcgaccacttcatcgccaacttccatggcacctttgaatgccctggcacacagtttgatctctacaacgtcattcagaagtctggagaatcccttcgagattatatccgacgcttttctgagcaatgcaacaagatctccgacattaccgatgatgtcatcattgctgctttcaccaagggaattcgtcacgaagatttagtcggcaagttcgggcgcaaaccgcccaggacggtcaagcagatgttcgaaaaagccaacgagtatgccaaagacgaagatgccattatcgcgtccaagcagtcgagcaccacttggaagccgaagaaagatacgccgactacgggagggagtggaagtaccaatcgcaaggaccgtaagcgtaagcccgaggaacttgttgcaactactacacattcctcccgacaacgttcgcgcgtcaacacttttgacaagatcatgaactcccaatgtccgcatcatcccaattccaatcacgcgaccaaagattgcttcgtctacaaacagattgcagaacaatacgccaagaacgcacgaaaggcctccgatggagatcaaagtgcatcgaaaaagaaggacgatgatgacgatgccccgacaggttttcaagaccatcgcaaggagctcaatcacatctttggcggacccttggcttatgaatctaagagaaaacaaaagctgaccgaacgggagatcaacgctgttcagcccgatacgccccaatatcttcggtggtcggagacaacaatcaagtttgaccgctcagatcatccagaccgagtggtccacccggggcggtaccccttggtactagacccagtggttcgtaatgtcaagcttcgcagatccctcatcgatggtggcagtgcactcaacatcctcttcgccaaaaccctagacgacatgcaaatccctcgcacagaattaaaaccgagtaatgcgccctttcacggagtcattccagggctatccgctatgccgctcggccagatcactcttccggttactttcggtactcgggagaacttccgcacagaaaacgtctgcttcgaagttgctgatttcgagaaaccgtatcatgccatacttggacgcccggcgttagccaagtttatggctgtcccgcactatacctatatgatgatgaagatgcctagtccgcgaggagtcatatccctgcggagcgacatcaaacaagctatcacatgcgacaaggaaagctgcgagatggcccaaacccgcgagatcacgatcgcccgagaagatatccgactggctgcaactacggcaagcgaaggagaagtgcctgcaaccaagatgccaaagagtggagaaagcgacgccaagaccaagaaaattcctctagatccctctgattctactaagaaagctgtaataggcgctgagttagattgtaaataggaaagcgtgctcatcacctttcttcaaaataataaagatatctttgcatggaaaccatctaatatgcctggtattcctagaaaggtgattgagcactctttacatgttaaggaagatgctaaaccaatcaagcaacgactccgccgcttcgcacaagataggaaggatgcgatcaaggaggaactgactaagctgttagcagcaggcttcatcaaggaagtccttcatcccgactggctggccaacccaatcctggttcggaagaaaatgggacaatggcgcatgtgtgttgactacaccgacctcaacaagttctgtcccaaagatccttttgggttgcctcgcatttaccaggtagttgactcaaccgccggctgcgagctactcagctttttggattgctactcaggttatcatcaaatccgactgcttaaagacttcattcatcacgcccttcggggcctattgctacatcaccatgcctttccgattaaagaatgcaggagcaacctatcaacgcatgatccagagatgtttttcaactcagatcggtcgcaacgttgaagcttatgtggatgatgtagtcgtcaagaccaagcagaagtatgatttgatcacggatctagaagaaacctttgcaagtatctgcgctttcaggattaaattaaaccctgacaagtgcatcttcggagtaccgtcagggaagctgcttggatttatggtctctcatagaggcatacaagccaacccggagaaaatcaatgccatcctcaacatgaaaccgccaagttcccagaaagatgttcaaaagctaactggttgcatggcggtgctcagccggtttgtttcacgactcggcaagcggggatgccctttttcaagctgttgaagaaaacagacaatttccagtggggacccgaagcccaaaaagcctttgaagacttcaagaaactcctcactactccaccagtcttagcttcaccgcatccgcaagagccgctgttgttatatgtatcgtcaacttcccaggtcgtaagcacagtcctggttgttgagcgtgaagaagaaggccatgttcaaaacgtccaacgaccaatctacttcgttagcgaggttttggctgactccaagacaagatatcctcaggttcaaaagctattatatagcgttttaattaccctcaggaaactatctcactatttccaaggtcactcggttacgttggtcacatcgttcccattcggcgatatacttcataatcgcgaagcaaatgggcggatcacaaaatgggccatagaattgatatccttggatatatcgttcaagccgcgaacttcgatcaagtcccaagctttagctgactttgtcgccgagtggaccgagtgccaagaagatatgcccgaggagaagatggagtattggaccatgcactttgatgggtcgaagaggctttctggcgctggggccggggttgttttaattttcccgactagagaaagactgagctacgtattgtggatacatttttctgcatctcacaacgtagcagaatacgaggcgcttcttcacggactaaggattgcaatctctttgggaattcagcgtctgatagttcgtggagattctcagttggtcgttaatcaagttatgaaagagtggtcctgccttgatgataacatgaccgctaatcggcaagaggtgcgcaagttgaaagacaaattcgatgggctcgaactcacccatgttcttcggcacaataacgaagcagctgacagactggctaattttggttcaaaacgagaagcagctccttctgacgtgtttgttgaacatctttacgaaccaaccgtaccaaggaaagaaacaatcgaagccacggacgctcaaaacgtaggtatgattgaagccgactagagagagcccctcataagatttttgaccaaacaagaactcccccaagataaagatgaagccgagcggatctccaggcgcagcaggctctatatcattcatgaaactgagctgtacaagaaaagtccatcaggaatcctgcaacgctgtgtatctttagaggaggggagacaattgttaaaggatatacattcaggcatctatggcaatcacgctgccgcacgaaccattgttggcaaggcttatcggcaaggttttttctggcccacagctgtgtccgatgccgacaagattgtacggacatgcgagggttgtcaatttttcgccagacaaactcatctacctgctcaagagttgcagaccatccagttgtcttggccgtttgcggtttgggggcttgacatggttggcccgtttaaaaaggcagtcggcggttatactcacctctttgtggctgttgacaaattctccatgtggattgaagctaaaccggtcatcacaatcacggcagacaaggctagagatttcttcatcaacattgttcatcggttcggggtacccaatcggatcattaccgataacggcactcaatttactggcggagtatttaaagacttttgtgaagacttcggcatcaagatttgttacgcctccgtagcacaccccatgagtaatggacaagttgaacgcaccaatggcatggtacttcaagggataaaagcgcgagtcttcgaccgactgcatccctatgccgacaagtgggtggaacagctgccatctgtactttggtccctgcgcaccactcccagtcgagccacgggccagtcaccgtttttcttagtctatggagcggaagcaatgttgcctagtgaggtggaatttgaatctttacgtttccgcaacttcagcgaggagcgctatggagaagaccgagtagatgatcttaaccgattggaaaaagcccgcgaagcagccctaattcagtcggcacggtacttgcaagggttgcgttgttatcataatcgcaacgttcgatcacgagcttttttagtcggtgacctggttctgagaaaaattcaaactacacgagataagcacaagttatcccccttataggaagtaccattcataatctccgaagtcactcggccaggttcctaccgacttaaacatgaagacggtactcctatcgacaattcttggaatattgaacatcttggtcgtttttatgcttagccattacctttgtatttccctattttgactgctaacatcaagttttcccttgagttatcagtcgggggctactataataataatggagtgtgatttttatcaattcaatttgcttacttgatttatcattgccttgcttgatttttttggcttagtcaatgagaattgaaagttttttaataacttttgtgggttttaggctcaataaggtttgacaaaagcttttaagaaattaggagctaagttcgaaatatcaagcacagcataaattcatcagtatagtacaaattgtgccgccatcatcttcatcatcagaatcattgttataatataacatcactcggtgtcagttttttcctcatcggaattatcagatccagtcggccgaaggtcgttgtcctggaatctctcaactacatcaactgctatcttatcggcggttttctgcgcatcgttgatgaggtcaagggcggcttcttcgctcgtcccgtctgcaaagccattaatggcgtcaatgtcgatcttcgggtataaagacttggtcattgccaacgccaggcttgcccccatactcccagcctctttgatattcgtaaagtatgtatccggagcaactctcagcttgtcgaagatttcggaagcatcaaatgtactcggaccattgttattaaagaacatggtttggacgagtagggtagcagtgttggcgacttcatccctagacccttcaagcctcttgattttgttgaccaagacatcgaattgagcttgagacttgattttgcgatctgcataaatagatttatatcaacaaatgggcacaagggaaggcatagtttctagggtattagtcaccagtaccttcgacgtctttcagagccgagtccctttgtctcgccaattcggccttgtcattctccagagcttggatccgtttttctaattcagatatcttagccacttgcactgcattgcttcttgttagttgatattgcaagaatggcagcataagtaagttggatagagattgtattcaccttttgacgaaccgctcatctcaaagttggagtcttgaagctcagcgattcggtcccgtagatcatgctcagtttttctggcaagctccttggcttcgtgcagctgattcctagtggcttcaagggttttgagatggggaaccaacctctcaagagttgcagtcttcgcttcgttcttgagatggattctctgcaatacgaatttgtttgtatttgagcaaagtagtaagcaggatagttgaagccgtgcataaggagacttacatttacgatgcgagtggcttggccgagtgccttttttagcaggcatacttcttcgtcttccttttgcttgtttattataattccctgaggttgcatgtcatcgtcccaccacttgactaaaatgggcgggcgagaatcctcagctgattgtatctggaggatctcctcttcgtcgctgattattgggccttgagcatccatgaataaaggtgaaacaattgaagaaggtctgtcagattaaaacggattttggagaatgtgttaacctgtaataatttctggtcaaggacgagcaggctcttgtactttgacaggagagctgggccctggatctgcactggcatcctttctgggagggctgttcgtttgagtttctacttcaggaatatctttacttggctctgtacccgactggtttccagtcgggggctcttgattagcatcggctccagcttgggccgactggttcccagtcgggggttcgttgctagcttctacattgtcggttgccggttgtttgtcacttgaacaatcctctgcagttggcccggtttcttttgaaggacctgtctccacgttagtcggctccgagtcttttccggaaggatctatatcagatggcttcctacaaatttgagttatgccatcattattatttcaatagtgagtgagcagcactacgaggaagatggtcaaatgattcgtacctggaagatttcctaatctttggcattggacgactggatgttttcttctaaggattggtttgccttggctgttttctagtcacctctttattgccagattttccagcatcatcgccttcatcattactcagaaccaatttcctcttgcgcgagtccaactggatggctgattttgagatgtttgattgagtatcagaccgaatttttggtccaccacttgcctgaccagtctgccggcaaggtgatcggcgttgggcaattggagggtctgatttcatcaaggcgaattcctgggcatgatgattcaagttttctatcaactttgcaggtgataaaagcatgcttagatataggctgggattttaaatacataccggttgagggggattgaaggcattgtatggcaccactggcagcaagtgcgaatagctgactacaattgcatttgagaagattttatacattctctccttcataaccttgaattcaagggattcaggatcttcacggttagggtcatgtttgccgtcgaattcaaaggctgtgcgagatctttctttgattggggccaaccggctcttgatgaaatgtcgggtgatttgttctccttgcagaccttgctcctttagcttcagcatacgatccatcagggcgagctcttgggcggcttcctctcccattggtagtgaattccaagtgtcctgataaactggaggaagacaggagtactcggggagtgccggctcgaggttttgtacataaaaccaatttgcatgccagcctttgtttgaagttttacagggcatggagaaatacttttggctcagagttcctctcagttggaatctagctcccccaactacgcatggcttgcttttgttcggctggggtttgaggaagaagatacgatggaatagggcgaaatttggcctgatgcctaaaaaagcttcacaggcgtgtatgaagttggcaatatgaactatggagtttgggtttaggttatgtaaactaatcccgtagaaatccaaaattccctggaataatcttgaggttggaagagaaaatccgccatagaagaaatgagaaaataccacgacttcatgggtatcaggggttggaaatgcttcgccgcacgccgcacgccgcccaatgatctccttcgccggaagaacgccgtgcgccaccatctccttcaggttttcctctgttacatcagagggcgcccattgactctcgaagctttctctctcttccgccatgacagtgaattagatggtgtgatttggttcgagatatggctaggaatggatgggaacttgatgtggtggctgcgcggaaggtttttgtggagctcaggaggatggatcgaagaggatttgttaaccctagtttccgccggtgtggttttgcactgtagcaagagaatgggggaaaatggcgagagtttcagcagggaagacgaaacgacactgtgcctgcggcgtttatttcgctagggtttcaggagtgctaatgggcctgggcctgtacagtacttcagcccaattctattaccagcgtggctagttgtgatccttagggacttaggcatttttgctcacaacaatatggcccaatgctgtcaaaatcctttttgaagcagttagatgattctttggaattactacgatgcaaataaaaaggtgcccaacagaaaagtgttatactaattttgtaagtctttttaggctgcaaaagttgtttgggtttgttgagataactggtttttgaacagttatgtgctcggcatattatatgcttattcttctggtgtgagtcatagcctaggctattttgacttatcacttgttatgttatcacatttatatcacatttgatggatctttttgagagttcttactcagattcttatcaaatgtgtgaatttatggacctttagagtgtttttcacgcaggcctttccatattttcatttttggtatattaaagctaaaagcagtcggctggatgttttattgaacgccgcatatgctttgctatatgatgcttggttgtaaaaccactcggttcttgactatatgtttagttttatttaactaaccacatagtcgggggcttagacctgtactggagttaagcagatctcctaggctgtcgtgtttttacatctacagtatctgaactggagaattgacatcttttttttttactctgaatatatgtgcttcaagtggagcttaatagttcgttgctttcaaaatgaacaaaccaattcttcatgaggtattctgttcaccacaattgcatttgattctagagggactccatgagggtacaaaaatccccttctactggacttccttgattcccatctatttgtagttacacaagaagctggcaagtttgcatggattggtataagttgcaggttggcatttaagaattttattcactacgcagtacgcacacgattctatatatcaggatctttatttgggtggagcctttcttttttttgtgcttttgctaatagcaggacctgcacagttcttaaccattaagctcagcaactagatttcccatgcgaagatgtacaggatttttagattttccacaatttcttttcctcgtgtttctattgttttttcacagccatcctcaaagagtgatcttctattcaagcgacggttattatttttgaactataaaggatattcatcatttcttgtcacaactgatcgaaacatgaggaaaaacaaaaatttcagaccaatagaggttgatttcaggtagattaccaatctactaactttataaggatggattttatctctgctcagggttaggcattgcaatggtttatcttcttcctcatctgccttttttttttgcataggcacgcggcatcaaccactgctctgccgcacctatgaggtccagggtcacatccagttattgtctttaaatacaatcttcattgagggcatgcttggttgcctggatggcacctagcctgcatccggcgtgcaactagcggatacgcctaatgggcgatcgatcacctcacgacaggggcagcgatcgattcccccctcccccctcttctccacctggttttcttttttggcaccgtattactttcctattttagtaaatttatgcacctaaagtttatacacctcaagtttacacatctaaagtttagaccaaaagtttataagtcaaaagtttatatatccgattcaaatttgaatttgaattcaaatatttttcatatatagtatttctatacatctaaagtttatacacctaaagtttatagacctaaagtttatatatccgattcaaatttgaatttgaattatgtctgattcaaatttgaatttgaattcaaatatccgattcaaatttgaacttgaattcaaatatttttcatatatagtatttctatacatctaaagtttatacacctaaagtttatagacctaaagtttataaacctaaagtttatatacccgattcaaatttgaatttgaattcaaattttttatatatagtatttctatacataattttttttaacttttttgttttttaacaaaaattgtggagatgtgtaaacttgaggtgtacaaactttaggtgcataaatttactaaaataggaaagtaatacggtgcctaaaaaggaaaccaagtggagggagagaatcagaatctgatcgcctcctagcaacccctagcgatcgatcgctaagtagcattctcggcaactagcagcctgtttggttgcctggatggggctcagccaggcccatgtgatgcaaaacacaatgtaatttataacctctactatggattaaccttaccatccataaacagttttctttttggaaaaaaaatcttgctccacaaactttcgggggtaacctcaccatccacaataataggtatacacataagatgtatccatccaaccaaacaacatctcttgtatgcaaccatcccatccgcccgttgctacaaccaaccaaacaacatctcatggtatccaactttatgtcatgcgagcaatcaaacacatgcatgtgtatcccctaagccaggctacactcagtctggataagagagatcgaccatactagggggatacgagcaaccaaacacaccctgagtttcttcacccaactaataacctttgcacatgacagatgtgtgttgacagtcgttatcaattagtctcgcgtgtcaatattactaaaataaagagagaactagttatgcttgcaatgcatatttatgttagaataaactattttccactagcatttggattctaaccttttgcagagaagaagtacaaaatggaggagaatcaatagcaaagtagatgatcaatcaatcaggcgctgatgagattcagacttatggaaatatgggccaagaactcttaaatgacaagatccaacaagcccaaaattcaaaagtctgtggagagaagaagtcaaagaggccgccagccgaaaatgggttgtattgggccagcccatggttcgaccgaaccccacctgcgccgttggatgcagggtttggcgtggacgtccaggattgcatcctaatgacggttggagggtatttctgaccattctaaccgtcacaactgtcattggggagctataaaaggccttcacctcctcacttcttccacacactcaagcaaggagcttctcatactctctcaagtttagatgagtcctctagagctagtggaatagaaatagaatagtttctttagtccttagagtcttcggaagaattcaggtacggctctagtagctcttccttcttttgtgagacttgtactatttatagaatactcttctcaatatatttatggtactttacttcactctgattactttccgatatattattcgggatataattgtctagctagcttacctgggagatgcattggtgtgggtataatattcatttatatgattgctctaagtcatgacgatgattgtacagtagtatttggtagcataagtgaggtgcttaggctattgaatatcattatttggggttataggctacgagttagtagaggtgggccgctgatggtgacagctcagtatgagtattcctccacgacagtatataatcctaagttactttcttgggggggtactcctccgtatttagccctggttggatggccatgatgggttgtcgtaaggaactcggaaattaggggtggtcactcgaaaccccaggagggcattgtaaagggggtattgattatataattatatagtagataatattatctgaagtggtatgtatgtatattagaagtataggaaatgattattttcttattcttttccacttagcctagaatttgtatgtatgagaatattgagtgcttttgctttgtggcactctacccttgaagtaaattatcccctgcttatattttgatattagcatggttctctctattataatcttcccacgagattaaactaatatgataaccttgaaatactctcgagtgaaatactacaatggtatacccgtgcgcttgcggatatgatctataaccataatataccatgaatatttctgcgccattactgggaattatatttttagtaatgtagttaagaaataccaacaatgtggtcacctactggtgttgagcataagtcacattagaagaacgaaaaaacatgatttttttggttaggaattgccgtgataccataagtaaacattttgaaaagtgattggacaaagttttgacattgaatcttaatttaggtgaaggtgcatatctgtaatttgttatgacacacactctgaaaggtactaccgtactacgacgctcctccttttaggtgctaaccccaccatccgccatcctctattgaacaaaaatgtggagtatttttttaaatttaacaaaaaaaatgtggagtaaatttaacaaagctaatgatatcgtggcttaaatttgttcacgagtttcggttttgaaacattaaccgtgccaaccacaagccagcgtaggcaacggctttaccttttgtataacatagttcattgcggggcaccatactgagaagtggcggagataaacccacgggggtcgctggggagtccatgccttgaattataaggaggtgattatgatccaggaacggtgcgctgtgatggattgtgttatgcgaggggtactgtcacagctcctttccgaggtaccatggtggtattgaggcgcgtggtgacatgttgtggggctatgtcttgtggttacagtggtatatctctgtccagagtaaaactattcgaatagtgtaacatactaaaaattagctattttctaattatgcatcataccggttcttatgtttttattaacctcctaaacctaggatattataattaaagagacctcctaaatttaacctgcataaaatctctttctggtatttaatttcttttgtgtctttcctttaaaaatatatttagttaaattaaggtgtttcttgattttgggttttaatttaaaaaccttcctttgacaaaattccttttattcaaatttagtttgaaaatcttttatgaatcatggtccaagaaatcctccaacactatccttgaacctaaaccgaagcaattccaaatttgttggaattaattgtcaacctatcctttgattccaaacctatccttagttccctttccaaatttcaagtatccaaattccttttttcaatctagccaccaatttaatttccgtggcttgatttcctcctcggcacaaaaataatattattacaaatattgtgaataattgctcttgtgctaagagaatagactttatccctccgccccaaattcaaaacctcgtttagcccatatctaattctctaaatttcataccacatattttgggctagaattctatttactctactccctccatattccctccacatactcaaaaatattcaaatctagagccatattatttatggtattgaatattttgaatttctatttgagtgcattaaataaactccatctctaaagtattgcactcaaaccaactatagaaatatctcttttggaaattatattcaaatataatttcctttcaaactttcctagtcaatctcctccaaattctattcaaaatttagaaaatcatctattgggccaaagtctcctcttttcttccttttggcccaattgaccagggtcggcccagccaagcccagccggccagctgagccaacgcctctcctcccgtgggcgcacagggcgcccaggccaccgctgccgtcacggcttttgccgccgccactcgaagttttgcgccgccgtcgtcttgtcttcgacgctaagcaaccgccgcccgacgtcagcgccacctcacgcctctgatgtcagccgccgagccgaagcgccttccccggccaatcaactgacagaacgggcgacgtgttcgtcttctccatgccgccgccaatttttttccgtcgctgctaagaaacgaaagccggcgccgcctccttctcctccactccaccggcgccgtgaccctcttgccctcctcctccaaaccgacctctccctcctataaatagcccgccaatccctccccttctctgcatacaaaccaagctccatctctctctctctcctgccatgtccggccgtcgccgtcgtcggtcgatctctttctctatagctcccctatcaatttcctcgcacctccggctttgcctacctccgacaactccattttgcccctttcccccttctcttcccctttgaatcaagtcaccaccgtctccacccatgccggccggaggtgagcccttaccgtcgccgttccggccttatctctcactccttctaccagccaacggcctccccaggtgcgtggtgctagggaacaccacccgccgccggcgtcgccgccatccagccaccggagcaccggcgccccacctccctccctcttctctgttgccggcaagaaagagaagaagaaaggaacgggaggaagaaggagagaaggaaaaagaagaagaaaaagaaaagcctgacaggtgggtcccctgcacagtgacttttctcattttctagatttaattcaaaacccaatctttagaagcccatatttcctaaaccgtagatccgattccagtaaaacttggacctaaatttatataaattcaaaccctatcttttgacaccaaattttgtattttataattttatttgaatttattcaaatatcgtttgaatttatatttgccttttcaaatattttcttttgtcccaaattacccctttagccactaaaaagccgccggttggaactttatgccttccatggggacgtttgcgcggtctacggacctcaacgtcgaaccgttggttataaagcccggcaaagcctaaacccaaggtcgaagtgctgcttctggcaccccacgccttgatgcgtatagcggtcggagcttcactattccctcgacctccacagcacgccgcacagttagctctcgagctctgtgtgatcctagtcgctccgccgccactcacggttgtcggagtaacacttccgcccaactaaacccacacaaacctcctatccctctaaccgttatgctgtctgttgacaccggctagagaagataccaaacctagtcgttatgatctagcatcgactaacacacaaccaaaccctagccctcctaaccatttatcgttttcttgttattttatggcttttattgaatttagttcttcgtctttcttagtagagtctattatcttttggatggcaacttgtgatgttttgaggatcggataattaggttgcctatcttggatttgtttgcgttggagcaaggcaagttattattcctcccctttgagcattattatcctatattctatatctctattattccatgcattagccattcatgattttaaatgcataacttgaacatatagtaaaccagatatatgctagattttgcttagccatgcctagttagattgcataaaatataatgaacttagattggaacagtatggtagaaatggttgattttcgggtggctagtactgttccaaccgacataagattgccaagtacatgtgaagaacgaactagtacgaccgcaattctagaatggggacagacttagcaaagtaggttatctagcaaaggtggtacctctgtacagtggttcttctttaagtccttgcgcaggaggcaaatttacgccgagcagagcgattataatatttaccgagacgcaggtaaatatattgattattgcgcactgtgtgtgtattgtgaaaacctggttgggatgacgggggtctctcaaccagttctctctaaagacctcgggaacgccagaactcctctcgctgctgataacgttacgttcagagcgcgtggggattatagttcatggaacaggtaccgttgatgttagtaaccgaaaagctttgccatgactaagctgatgaatattagcatgtcatggattgcgggtaaagcgtacatctactgcagtatgagtatctctgaaactattcgaatagccgtgctcacggatattgagcatcgggactcactatggcatcttggttagaaatataactccagattttattaaatattgttgcatttcaaaacattatagactttctccttctactttctcagctttctgcaaatagatctagctctactcaaatactattatttcatacattcatacttgaatataatagcttgctgagtacgttgtactcacccttactttaacccccttctttcagagttaatttggagttcttgccgaagccgagagttcaatcatataagttagttttcatttcaatctagttctcaagtctagattagttagatggtttaagtctatagcaatacactagagttggtttattctatagcttctgctgtattagttagccacaagtttgtaaatacccatatattttgtaataacatctcctttggagccttattcaaatgtatgcaatgaagatccagattgttgaacctgtatcaatctactgatccagggcttgatacagttaaacatgtcggtttccgaatcattagttttgggacccaacaaatagccatacccgtggttgtgggcgggtctaacaatgtctttcgtgattaggctcacacttctcaccataataaatgatgatataattgctaataatttgcttagctcctggtttggaatggtacatttctggtttggagatagatctgtacagccgggtatggttgttcagttttggttaggcatatgcagcatgggtgtgctgttcagtgttgattaatattaatgatttattattctactgttttacaattctcaaatgtttgctaaatgttgcttttgcaaatgagccctatattatgccattctttggtatccttgtgcacttgcatttttgttgtgtggcttgtagagtattccatgtactcaccttgcaataatcaatcaaacctcggttgaagaaaagttgtgaaggagaagacgtttggcttataccccagttgagctgcctatgggagtggagctgaagcttcactagattttatttttccgctgcagtttttttcgtggtggggactaagtacctcttatgtaggtatttattgctttagttattttgatgaatttgtatattaaattgtcagtttgtgtatctcggctgatttctgtatgaggattttatacacaaataagttccgaaattaccagtgaatttctggacgtgacatacagtatccaacccggcacggcactggccaacgagcttctgggttgtgccgggtcgaggccacagcccatgggttggtatggcatggcgtgtactgggtaggcatggcccagcacggcacgaaaggcccaagccaccagcccaccgcaggtacatgtccacagtgccgcacccagctgccaatgtgtgcgcgcggcacgctcgcacgcacccccgtgcgtccccgcctcccttcgcggctcacgcgggccgcccgccttcaccaattgcagcatgcgcgcatcttgcctcccgccctctcctcacaccgcccgcctgcgccaagccgctagtcgccacagccatgcctgccaatagtgctagtaggcgcccgcccgtctgcaccaatccagctgagaagatcgttggagcacaaaaaaaatataaaaaatgcgaaaaatatcagaaaagttctattttttttacaaataggacactcactatggagattttgaatcatccaaaccttccattttgtgctatcttttgttcttttgtgtgctagttcaattttcttatctaaacaaaatttgttcaaaatcaaaaatactttgtgaagtccacttttttttagcaaaactgcatgcacaaggtgtaaagaaggtaagaaagaattggagaatcccttttttattattcgtattttatgttatatgtatatttcttttgaaattccgtccatgtggttataatattcagcatggacgatccgagcagtctgtcattcaatttgggtgactttgaccctaattacctatcagcgtcatacataaataacgagtatgatgcctccggatcggttccaacaccgtcagttttggacgaggtaccggtggcttcagatggatcaggaactatgagcaggagtccatcgacgaacaccagctcaaagagatcacgaacttcggccgtttggcaacattttgatgaggtggctgtgacatgccctggtggaaggcaagtaacgtatgcgaaatgtaaaatatttaaacgcgacaaataatctgctacagaattttctactcctttatatctttaatttcaaaatcaaattcttggagtggaagaacccatctaattaatcgaagttttgcatctttcttagtgagcaggaattttagagcagcatgatcaatgtacacaataaccttagcaactaagtaagacttgatcaccccttattaccccaagtgcattttctatgcgagaaaccaaagaagtgcactcaataggaccggaaaacttgaaattttctaaccattggcgaatcatgtattacataagagaaacttttatctttctaaccatgtcaaataagataatcaacttatcttcacgaatgggtctaagattagctctaggaaataaagtcatgccaagccatttatacatgagtctaagagtaggattatggatgccatctaggccttctacataacttgtttttctcagagttggaagctgccttccaaaaattaattttgcaagttttgtcaaaacctaaaagcagactcaattctttaaaagagagatagaactccttacagaaaaaccaaaaagaaatgccatcatctacttctagcaaagtagcaaggtacataaaaaatttctaggtaagtaagcgagaacctggctcatctaccacagcaaatttctcccatcctatagccttccaaacaatacgaaaatcaacatccgtacctattttctgaagaagttctaggtcgtatgctggggtgtcagcaaatggccgatccttgagcatgtgatagccctgcatctcccggtctcctatgaggtcgaggttggagtcatcgagaagccttggcgaggtgtccacctcctccatggagacatcggtggaagagtgtgtactcgacttatcttggtgatgacttgaacatgagcttgatcccttcttgaacaaacccgtgattcttctcttcatgactgcagaaagagcaagagcacacactacaaggaaatcggcctagcaccacggcgccaaatcgttgcgatatgggtgttttcgttgcaatacagagaaatcacaacgaaaaaatttcattggcatgcgttgcaagtacctctgatgcgatagggtatcgcaacgagtgctcacgcgttgccataaaatcgggctgttgcaacgagacgaagcatggggaaagattgaagaagcaacgatatttagcgttcgagttgacattgcaatagttgttatcgcaacaacgttagatagttgcaaacaagaattatcacaacgtttcagtttcgttgcaatcctgtatattgcaacgatatttgcaagtggcaataacacgtacggtgttgcaatatgcttaaaggatatcacatcgacgtaggactcgtcgctatacaattaaaggatatcacaacaaagtaaatcgtcgctattcgcttgaaggatatcgcaacgaagttagagtcgttgccatacaccaaacgtgtatcgtaacaacatgtaacccgtggctgtacgctcgaaggatatcgcaactaagttcaacatgtaaccggtggctatacgctcgaaggatatcgcaactaagtatggattgtggctatatgcttctaggttatggcatcaacatgcatcccgtcgctataggctacaactataggcaacaaagtaaacccgtcgctataggattgaaccatatcgcaacgattggatagaaccatatcgcaacgaattaggagtcgtcgcatacggtaggatatagcaacgaagcgaaatatgtcataacaatgatttatttggttactgcaacatatatattgaaatttttgaggtagcaaactatcattagtcttacagcccattgaaataacgagtacataaatatgacgatacattgtaacttgtccattcatccattcaacaataaaatgtccataaaccctatattgttccataacccctctattctttgttcccatgtctaccaatctttgagtcttaatgtgccgcccgagtttgagtttcctgctgaatacaaacatggtttgaactgcatgatagcaataggttgggctggattgtgaaatggcaatgcaaaaattaactttcttaccagttgtttcctgttgcttgctcacgttagagcaccagatagtagttgtttagaggaaatgtatttcgctgctgtccctttcccaacattttcagtaagcatactctttgtaactttggaaactttagattttcctatagtagggtccacattttctttgtttgcagtgacatcgtgtcgggtcccaaaattaattacttggatccgactatgattaatgtatcaatccatggatcagtaaatattgatacatacaatataactggttcttcattgcatatgttaaagttttacaatactaagagttttacaattaggtactcacctaattgatcaactagaattaatacatagcggaagtttctatacattctaactagggaggtataacctttagggattttctaaattatcggggtcatcatagtaatagtcataggggtcctcctcttgacccatatctgaaaaaggggttatgagagcaaggatgagtattcacaatactcagcaagttatcatggaaatatgttatgcactggcatattgtagggttctttgcaaaaaaaaagtaataatcaatctggaagagttatagcaagaatttataaatatatagactttaaatttctaaccagtgtaccatatgagtcccaatactcaactccatgagtacggctattcgaatagtttcaaagatattctactgcagcagatgtacgctttacccgtagtccacgacttgctgataatcatcggctttagtcatggcccagtatcaagttattaacaactgtggcacctgttccatgaacttatatcctcatatgctctgaacgtattgttaacagcagcaagaggagttctggcgttctcgaggtatttaaggggaactgaccgtatgacaccacgtcatctcgatcagggtttagaaatataccatatagtttatacacgagtatcacaaaccatttacctgtacctggtaatggttaaaagttgctcttcacggctataaatgcctcctgcgcgagggcttaaaaataagaaccactatacggaggtgccatattgctaattaacataatatctaggtttgtccccattctagaaacagcggtcgtacccgttcgttcgacataagtacctggtaataactatatcgatcgagacggtactagccacccggaaatcatccaattctaacgtactgtcccaatctaagtataagatattttaaccagattataagcgaagtaagcaaggctaaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctgttatctagtgtgttagaagaatcctcaagacctagggttagacatataaaattcaaattcaaaaggaattcaaataaaattcaaaaataagaaagatagggaaaataaaataaaatagaaaaataacaaaagg

SEQ ID NO: 9280 - DNA, 9943 bp, Oryza sativa
cgcgccaagacgatcgggcacgtgcaagcggccccaaagccgacgcgcggcgacacggcacgcggctaagtcggatgcccaggcatgcatgaatgggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaagtttcactagggtttggaatatagcaaatccttactaatattagggtaaattagtagggttctaaaggagtaacacttgaaccaattaagaatcaaataaatttttaaagcacactaaattaatcaaaagccagcatgatgcagtcaaattttagtttaaaatttgaggatgttacaaacctacctcccttaaagatatcttgtcccgagatttgcttaggagtcttcgaaaagatacgggaattccaattgtaaataatcttcccgttcccaagttgcctcatcctctgtatgatgattccattgaactttaaacatttttattgccttagtacgagttgttctctgtgtttcattcaaaattctaataggatattgtggataggttaaatctttattcaattcaatagtacttattcctctggaatacgtaaacatttctttaattgtgaaatatggaatgtaggatgtacatcagatagataatttggtaaagccaattgataggctacttctccatgtttagcaattatttgatatggtccaatataacgaggggctagttttccttttactttaaatctttttatccctcgtaaaggtgaaacctttagataaacataatcaccaatgtcaaaagttaactctctccgtctagagtctgcataactcttttgtcgagattgagctactttgagtctgtctctaataagtcgaactttttcttcagcttcctttaaaaggtccgttccaaatatacttctttctccgatttctgtccatatcaatggtgtttgacatttccttccatataaggattcatgtggtgacatttttaaactagcttgataactattgttatatgaaaattctgcgtaaggtaaacatttgtcccaactagcagcaaaatctagagcacaggctcttaacatatcttttaatatctgatttagtctttctgtttgtcctccggtttgcagatgaaatgctatactaaaatccaaataacttcccaattcataatgtagtttctgccaaaagtgtgaagtaaattgggtaccacgatcggaaataattctttttggtactccatgtaaacatactatccttgtcatataaagttctacgagttgtgctccagtataggttgttttcacaggaatgaatcgtgcagtctttgtaaatctatcaatgattacccatatagaatcatatctagtagaagttttgggtagtccagtgataaaatccattcctatttcatcccatttccattcaggtatttgtaaagggtgtaataatcctgtaggcttttggtgttctgctttaacttgttgacaaacataacataatgcaacatattctgcaatatgtcgtttcatatttggccaccagtataagtctttgtactacctgggtgtaaagagtaggctgagtcaggtgcttcttttagtattaccttccttaagattcctgattgtggtacgataattctatttccgtaccataatattccttccaggtcttcggtaatatctgtagcctttcctcgcaccatccgttccttaaaagtttgtattttagaatcctccttctgatgttcttttatttgatccatcaaggtaggttttaactccaaagtgttcaattctccatacttaataatacccagatttagtctaagcatttatgcttgtaattgttctgacattatttcttgttgtaaattgcaataaactttttgacttaaagcatcggcaaccacgttagcttttcctggatggtatagaatttccaaattataatccttaattaattctaaccatcttctttgccgaagattaagatctatctgagtaaaaatatatttcaaactcttatgatcgatgtagattttacaatgatttccaatcaagtagtgtcgccaaatcttcaatgcgtgtactactgctgctaactccaaatcatgagttgggtaattttcttcatgaggtcttagttgtcttgatgcataagctactactttaccttcttgcataaggacacatcctaatccttgtcgagaggcatcacaatagatctcaaaatctttttggatgtctggcaagattaatactggcgtagtagtaagcttatgtttcaatctttgaaaactatttctgacattctggtgtccattcaaatttcctgtccttcttaagtaatctggtcatgggttttgcaatagtagagaaatctttaatacaccttcgataatatccggcaagtcctaagaaactccttatctcaggtactgaggttggtgttttccattccattacagctttaaacttttccggatccacggcaactccttccttagttattatatgtcctagaaatgcaacttgatctagccaaaattcacatttactgaatttggcatataactgatgttgccttaacttctccaatactaatcgtaggtgttgtttatgctcttccttgctccttttaattgatcaaatagaccgtcgattcttggtaagggatatttatttttaatagttacttcatttagagctcggtaatctacacacattcttaaacttccatctttcttctttacgaatagtacaggtgatgaaccctgagttcctctcgacactcaaggctgttgttggttcgatctttcggtgagttgtgataactacgatttgggagaaacgttgacgatccgactacaaccgtacgagacgttgtgttgcgccttagcgatcaatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagctgacacgcgcgctgcaagcaagtagcaatggctaaactttaatatatcaaaacccaataaaccctaaaggggtacctagctatatataggggtgggaggacgacctagggatgcctaggggcgtgctctacctggttggggcacaccccacatgggccccacctgggccggggtcccaaatgaagttacaagcccataggcccattataggtgacgcagcaccttgtgcctgtgatttcagccacacgagatggaattcggatatgaggctagatccgttggaaagagggctccgagagtattctatcaagtactcacgggctgaaaatggaggtcgtatgcagattcggcgaccgtttgaagtcagtactatagcaagtggccgaatcggattccagcacttggacgacgtgatctcgatatcttcttgttcatccatgatgtgaacaatggttgcattcgtggtagttatggtcacatcatcctccccttcttcacggaaaaccatcctcggtttttccatatggtgctatttgcgtagtccatttacaacaacctgtttcttccaatcaaaacaaggcaaagttgagacaatttggttagcaataacatttctctctagcttgtatgttttatccacatgtacaggaagttctaaatccgagcagatgtaaactctatgcacaaaatatattccaagatcattatattcgccaaagatgtgaaatataatattggttggatatggcaaatcagacttagcaaataatttctccttcaaattatcgagctcacaaaaatcatcaaactgaacatagcccaaagtatttaaagaagatctcaattcacgcttctctacttcattagcaatgtgaacaacatgcttaaaatcagcgcagtatgaattaacagtaggaatagcatgttcattcactagttgtggcatggatataagtgaagcattatcacataactcttctttatcacaaggaactgcaaacaaatcaacttgtgacaaaggaatctcagcagttggttccactaatggttgctctgctatagtatgaaaagtggacaaattcaattcattaacaacacactcaccttgattaatttcagcaccattaagttttacctttgatgccctcttcagatgatggaggtgcctcgactttgagtgtgaacaatggaactggcggctctttcatgtctctctcctccttttcatgattatgcacttcctgcaaatggttagtattagaagacaaaaacatagcatgttgcttcttcatgtcctcctctattttactttcagcattgcaagcaagttgtaacaaatgagaaagaaatgtatatctttgacaatcaagcatgtcctgaatttctttgttaagcccacgtaaaaacctcaattctttagtttcttcgcattcatctaaaccacaacgtaataaacaaacttgcatatcatgagagtatgaagtaacagttctggtatcttgttttaaacattgcagtttgttgaacaaaatgtcagcataatacatgggaacataaacatctctgaaatatcgtttcaggtctttccatgattgtggtattttgttatgcctacaaagatgtttccaatcattagaagcatgtttaattaaaacactagaggaacacataaccttttgtttatcagacaagacatgcttttgaaattcactatcaaccgctagctcccaattaatgtaagcatgaggatcatagtttccctcgaaataaggcagtgcagatttgatcttacctagaacatcatcacttacctcataatggtcatattgatcactcctcatgtctcgacgaagatgtcgatgttgagcacagctatccccaattatcttgcgtatccctgccattgttagtagaaaacaaaaaacatacacaaaaatatgcgcgttcctattaactactaggtagtggcagctcaaaaatcacacacactcaagcttttaaccaagctcttccaagatcttaccattgaaagtggaatggtgacatacactgactcaaccaagcaccccaatggaagttggatgtatcgatgccttggcaaatacttgcggtacggctgtaatcaaatctgtggagctctgggtaggcttatatatgtagcaaaggaatagcaaatgctcaactcagataatgcaaagttgaataattgttcaaagtcaagtaccgtgctggtcctaggctagaacgtactagagacgcgagcctagacacaaatgatagcacaagatagcactaggaacaactcatgcacaactctgatatatgaagttcaactcaaacataacagtattttctcttttctttctttcttctttcttcttttcttttttttctttccttttcttttctgttttttttggtgcggattttttttcttttcttttttatgcacctttctgcctttttttctcacttttatcttgatttttttaacaaaaactgactcaaggaccttaatgtaaggttacagggactcaaacgtaaatataaaatctatagggactcaaatgtaaaagtctaaacccaaaattaaaattatacaaaaatggaatgctgaatttatgccggttccatttttccaaacagatctcgaaaccgacaccaaacaaaaattcaccaaggtgtttgacacaactcagaaccgtgaaagggagggagggagtcggactcggccaaaggggcgagtgggagtcggccaggaggtggagtggatggcagtcgaatttggtgtatgggataaaaaggaaactgatttttaaccaatccaatctactatatctttccaaaacaaacttgactacttccaaaatcagatatggtaattcaccttcctcctctcatgcacgacacaggcacggccaaaatagaagaacgcccagtcagcaaacccaagatgcaactcaacaactgcaaaaccaaccggtaaaaacttttgaaaactacaaaaatagaatcgtggcagcgagccgattcagttttcgtaggtcccgacgacaacagatacacggaggtgacgacgactgtggtacaaaacgtgaccagaactcgaaactctacacgaactagacgctaacaccagcaactcgactcgacgatgtaacacaaaactcaacaaagcaaaaactgataaaaacaatgcaatggcacaatatggctaggtacaggacaatttttttatggcaattttctggttatgggtagataaaactcaccgagcaacgaaagctctgataccacctgatgaaccctgagttcctctcgacactcaaggctgttgttggcccgatctttcggtgagttgtgacaactacgatttgggagaaacattgacgatccgactacaaccgtacgagacgttgtgttgcgccttagcgatcgatacacctctccgtggattgttgatcttgccggtgcagatcaaccctattcctgcaagcaaatcgaagaaacaagcaagaacaagataaaagcaatctgatgttgcaaataggaatttaatacaaatgataagttggggttccgaagaacaagcagacggacggtctagccgacacgcgcgctgcaagcaagtagcaatggctaaactttaatatatcaaaacccaataaaccctgaaggggtacctagctgtatataggggtgggaggatgacctaggggtgcctacgggcatgctccacctggttggggcgcatcccacatgggccccacctgggccggggtcccaaatgaagttacaagcccataggcccattataggtgacgcagcaccttgtgcctatgatttcggccacacgagatggaattcggagatgaggctgtatccgttggaaagagggctccgagagctttccatcaagtactcacgggccgaaaacggaggtcgtatgcagattcagcgaccgtttgaagtcagtagtgtagtaggtggccgaatcggattccagcacttggatgatgtgatctcgatatcttcttgttcatccatgatgtgagcaatggttacctccgtggtagtcatggtcacatcaacatgagttccccaaagtgaagaactttgtcgaataaagcctttttcttgtagctcagctatctgtttcttcaattcttccaattcattaattggcatcctataaggtctttttgatataggtgccgttccaggaagtaactctataataaattctatttcccgatttggaggtaaggtacttagatcttaaggaaatacatccaaatattcttgcaccactggaacttcttcttttggtataagcatacaaatgtctgtcatatgatattccatagatagattgggtttaactattatctttgtattaattccttgttcatcagtaaggataacctctcttgttgcatgattgattagtccattattcttggctaaccaatccatgcccaaaatgatatctatagtttgggtaggtagtacgatcaaatcaattaaaaatatttgatctcctaatttaatcggaacatttctacaaatagatgatactaatacagttcctctaggtgaatatattatcatagccttgtttaaattatctttaggtaaagactgattccaactggcttttgcagataaaaaggaatgagaggcaccagaatcaaatagaatagtaactggtttagagtttatggtgaacatacccatcaatatattaggatcttgttgagcttgttctgctttaatatgatgtacttgaccacgtccaagattaggtccactcttaataattggaggatttttctttataaaacctgtagtagatggtttctgataagaagtttggccacccatattttgacgattagggcatagtcttgcaaaatgtccaaacttcccacaaacatagcatggagagtcttccatccttaatccaggtcttgatagtattggtggcatgcccggccttgcattggatagagatggcttaaatggataaggcctccgaacttgtagtgaacttctagttggtgattgtcgttgtaaattcattcttctcttacggaatccttccaccattctacgatcattttctagcctaaccactttattgactaggctttgaaaactttcatgatcttgactaatcattggtcctcgaagttcatcacgtaatccttctataaacctttcaatcctctctttctcatcttgaatgtctgaagcaacatatcacatatcgagaaagctgtgtaaatttattcaaatatttttgtactgtcataaaaccttgtcttaatcctcgaaattcattctttttcatcctgatcacagctgtaggtataaaagcatttctgaaagctatggtaaattccatccatgtaatgatatgggtaggatcttctatagaagcttgatatgcttcccaccattcattggctggtccttctagttgatgggttgcaaaggttaccttctcttgttcgtttgttctgaccaaggttagtttcttttcaatagcccttagccagtcttcggcatccataggttctttggattttgagaaaactggtggtttaatcctcagaaattctgcatgtgcactataacctttatttccttgattttttgctatgtcctgtaataattgagtttgtcttgccataacttctaccaaggtagtaggatttggtgaagggatttctcccgtatctccttgacccgtgctgccattacccgtattcatctagaaaatgggtaattgatatcttctcaaaggggagtcaacatccataattaaacatagattttatttatgaacaacattgtacatggtgtatgctacaaaagaacaaaccaagaaaaaccacaaccgcaaaagaaggggtaatcacacatagaagttagagaggagtaggatcactaacaattctacacttaagatctctaactatctataacttctattcatcaagccatccaccactgccttccgcgggattagcaaataacgatgcaggtgcgaagtgtgaaaattcatgaggagatgcagaagttgatgcagtaatattgggggcagagcaggagtaagggtcttcattattttcttgatcatcagcatgtatagaaagatgttcctgtgtctcaagctctcattcttctggatcttcctcttcgtctggagattcagtccaaattggggcagtatttaagtcattgatatcaaatacccgatttggcctgagtacttcaggttcttggctaggttcactgatatcgatagctgaatgcatttcttctgcttcatcatcagaataaataggatacaacggtggtggtgatggtggtaaaccttgtaaaactccttcaccattatcctgaggatgtggttcatcttcacgtactggtgagatatgtccttccataccatcatcatcatcatcgtcatcactacccatatttgggatttggtgaagacagaaggctgctcttgcaacacaaatattgaggatagaattatgtttttctctttcctcatataattcgtgaagtatacgatatttgtgtttgagaacagcttctctgcgttcagcttcctccaaacgtttacgttgtacatccatgtgttctagggcttcttcatacatgtcatctgcagcttccatccagatagacata

SEQ ID NO: 9281 - DNA, 2650 bp, Oryza sativa
ctgccattgtcctaaaatacacagatgacattataatgcatgctcgtggattaaatctaccccccttaaaaaaataaggttgaggtaaattcaaacttaacttagttagtagtccttaaggttcatcctatagtcaaaacatatgctctgataccagtcctctcgggtcccaaaattaattacttggatccgactatgattaatgtatcaatccccggatcagtaaatattgatacatacaatataactgcttcttcattacatacgttaaagtttcacaatactaagggttttacaataataggtactcaccaaattgatcaactagaattaatacatagcggaagtttctatacattctgactagggaggtataacctttagggattttctaaattatcggggtcatcctagtaatagccataggggttctcctcttgactcataactgaaaaaggggttataagagcaaggatgagtattcacaatactcagcaagttatcatggaaatatgttatgcactggcatatagtagggttctttgcaaaaagcagtaataaacaatctggaagagttatagcaagaatttataaatatatagactttaaatttctaaccagtgtaccatatgagtcccggtactcaactccatgagtacggctattcgaatagtttcaaagatattctactgcagcagatgtacgctttacccgcagtccacgacttgctgataatcatcggctttagtcatggcccagtattaagttattaacaattgtggcacctgttccatgaacttatatcctcatatgctctaaacgtattgttaacagcagcaagaggagttctggcgttcgcgaggtatttaaggggaactgatcatatgacaccacgtcatctcgatcaaggtttagaaatataccacatagtttacactcgggtatcacaaaccatttacctgtacatggtaatggttaaaagtagcccttcgcggctataaatgcctcctgcgcgagggcttaaaaataagaaccactatacggaggtgccatattgctaattaacataataactaggtctgtccccattctagaaacagcggtcgtacccgtttgttcgacataagtacctggtaataactatatcaatcgagacggtactagccacccggaaatcatccaattctaacgtactgtcccaatctaagtataagatattttaaccagattataagtgaagtaatcaaggctcaattatctgggtttctatggttgaattgtgcatataaaatagaatattgaatagaaggctataaataaataatttgtaaaatataggcttaaatgatcaaaaggtatatggtaacttgccttgctcgatgtcctgaaattgattgctattatctagtgtgttagaagaatcctcaagacctagggttagacatataaaattcaaattcaaaaggaattcaaataaaatccaaaaataagaaagatagggaaaataaaataaaatagaaaaataacaaaaggggtctcaaaagatagagaatgattttagaagaatattggtccaagttttactggaattagatctatattttaaaagatatgtgcttctaaagtttgaaaatcaattaaatgtgaaatggcacggtgtgcgggtcccacctatcaatctctctctctctctcttctcttcttcaacctccagccgttccccaaatgtggctggcggcgctagggtttgggattacggcggcgctagagggggaaaggggttgcggccgaggaggggagggagctagggttctccggcgacggcaagcggcggcggaggggttaatttggtatgtggttgagctagcggctagggcggcgatggcatagttaagccgtgaaggtgatcggggtgatgtgagtcagacatggctcggggaggggttctagagcatctatgaggtacctagaagggtttgggcagcttgccgaccttcggcaaggtgcggagtatatccgccgacaagcgcctccattggcggcggtcgagctcatgtcggcagcccagaggatggcatgatagtgcaaaccgattgcaaaaatagactttaggtagtatatagatggttaaaacggaagaactcaccgagatcggttgaaacgacggattgcggccggaaaaacattgcggcgacgaagaacagagcagagcaggggcgacggtgctcggctcggtacggcgaggtaaaacttgatgcagggcttcggttagggctcactatactagaacctggtcgatataaggtgttctaagggttatttagggtggatggatggacgggcgtggagtcgatcgcgcacaaggtgttcgaccgacgggcgagagtggttgatgagatagattggtgaagcagagcttcggagttgtggggctatggttgttgatgatcgatgatgaacaaggaagggattagggtcctatttatagggccaggagaggtggatgagctcggacgccatcatcgccatggatgagctcaaggattggatatggcaaaggtggcagaggctgtgatagggtggccaaggtcaatttgagtggcgggaggccacgtttgaatacttaccggcgaaggattggcttgacccc

SEQ ID NO: 9282 - DNA, 25436 bp, Oryza sativa
aggtgaatggtgagaggggaaacgaccgtctatcttcaattcaaccgtgcagcaagaattggcgcgattcaccccgggtagaatcaagatcggactcggtggcggctttggatgggagcgcacggcgtcaagcggcgatttcttgcggcggaggtcgtcccggctttgtcgtcgtcaagattggtgcggcggtggcggtctgagggcgtcggacgagcgactacgcgccaagacgatcgggcacgcgcaagcggccccaaagccgacgcgcggcgacacggcgcgtggctatgttggatgcccgggcggcgcgcgtgaaggggaggaagaagcaaagaaagccacggatttgagtgggatgtggtccccaaggatcaaatctagactttgcacaagattgggtagaggttgggctgtgttagttgggctagacattctgtcgagcacctagtgtgaaatgaacagtgaatttcaagaattttgaatatttttcctagagaagatttgaatttaaactatgaattttgaaaggtttcactagggtttggaatatagcaaatccttactaatattagggtaaattagtaaggttctaaagaagtaacacttgaaccaattaagaatcaaataaatttttagagcacactaaattaatcaaaagccagcatgatgcagtcaaattttgtttaaaatttgaggattctacacatcgcttgttgggatattctgtttcgtaaagtttgttacgcaatatgtaattatatattatgactggaatgattggtctagttcattacctgtttcgtaagtgcacgattttctttctctgttgtgacatcactttttaggtcaatatgtgttatgaattatgctcaatattgttagatgtaatcatgtaattcaatgcacagtgatgggtagaaatcttgttcaaggtcgttacctggattgtaggatgctctttttctttgttcccagcatttcctgtaaacaaactctttgcaactttggaaactgtatctttgcatgtagtagggttcacattttcttgggttgcagtgacatggcttgttgggatattctgttttttaaagtttgttaaacaatgacatatgtaattcaatattatgattggtatgattggtctagttcgttacctgcttcgtagttggccgattttctttctcttatgtgataacactttttgggtcaatctgtgttatgaagtatgttgaacattgttagatgtaatcatgtaattcaatgttagatgtagttaaatgcacaaaaccatgatgactgaattatttgttcaattctttacctcattcgttgtttctggtgcgtgcactggtctctcttgagtgtgcagggctgttgcatcagtataattcacattgctccactctgcttctttgttggaagtgtttgtgtaacaccccaggtaaccacgtaccaagagtgccacaccaaaaaacactcaaaccactaacttccaaaattattagaaatttcggcagagtcttccctgtaaatacggacatccacgacatgcaattataagttaaactaataacaatatcattcccataatacgatccatccttataatccatggggaagaaactattagaaatctaaaagattattataagaccaaaccaggatataattttaagtgtcattatggatctaagcaatatagtttgatagtgagcaagtagatgtgcatataaggatgttacttcccgcccttgcatgccggtctcaatgcgtacctaaaaccaaataaaacacaagagtgagtataaaaatactcagcaagtacaatatggaactagaaaacacatatacacatcgctgacaataaagcatgaacagaagcctttctttctttgataggaaacacatttccaaacaccaagtcaaaaaagatagtagttcccatcccgggcaggcatgaattgaaatagtagttttcatcccggacaatagtaaatacatcctagcatttgccggcaaagccaagtaagcgtgatcagcgcttacccacaggaacttgaataaataaccaaattgcactcccatgactacgcatggtacttgaataattgaaaccggaatcaaagaaccaaatggaaacacgtccatggcaagcagggaacttgaattatttaagcagaactagaatccagaatattaaaacaagaataacatcgtacacataagatcaacttgaaatctaaatagcgtgaacaacaatatgaacataagcaattacttatcacgttgaaatatatcagaaataaatagatagagtaacaatccatgaatcacacaattagttcgtcatgcatttgcctcgaacgaacggttggtatcatgcacgatatgatggaccaccacctaatcataaacaaaaccttagcaaacatattcaaacatgcatataaaacaatgaaaaaggtgaacctactgccccatcccatcaaatctcaataacaaggaacgccgcttggactatacacaagactgctgcttcaaacctttatatcttgaaatatgaaaaggctatgactgaaaatatatacattttgaaaatctacagaacaatacctacaactttcatgtagaaagcatatttttattctgccatttaaatggtctaatttgcgcttgaaagcaggcttcagaatctgtccagaatttcagactgtccacactaaaacaactataactagagttctactcgcccaatcagggtgtactttaccaatatagaaagataagaaaatcctctacaactttgtctataggcggcctggctgattccactgtttaacctctccaaaaacagttcaatctactactatccagattatgacacaaaaacaacagtcatactaaaaaagttatatctcctaaaccacttgagataaaatcgctccctttggtcagaagatatatccaaacattatctacaacaccatagttataaacttttgcataaaataacatttagagccccgaaacatcgaaacactgaagcactgcaaatctacccacatgcagaactgcaacaaaccaaaccgcaactacccaaactccttctctagccttccctaaccatgaattaatgcactaaagccatgctagaacaactgatacaacaaggggataagcctcacctagggtttctttagtgaacttgtgaggagacaatcggggagactccggtctaacccctccttctactcctctcctccttctcgttccgtttttctacttctcttcttgatccaagctatgaaggtggagatctagggagaggaatttgctgtagatgggagagatgcaaacacaggaggaggggaggaatgaggcgccggccagggagaggggtggcggcactatgaggggaggtgggattcggttcccctctctctagcttttatgggagaactaatgggctgggtttatgggccttctcatgttggcccacttctaaagatatttttcttttatttatttctgttaacatctttattttaacaagtcaacccaaactaaaaaacctaaatatcttttaatatacggggtattacagtttgaatcaatggtagccttggtattaaaaaaatgtctggtcagatattagcagtaatatttgtatcatcaatcactaaggatacatcttctccagactctcaagaagcatgacataactattcaattcattaccaattctctatgattttaaaatgtattatgaacagagcatgtacacatattaaaaaatgcagacaatatgaatgtcttacctcctgtgtcaatggttgtttactctgctccgacatcactttttgaatctccttcaccaattcatccttgagataggctttaagttattcctgattttcgtgttccttgcaagttcatcctttaatatctgaacctcacgagcttgttcttcaactatctcatgaagttggtgttttgtttgtttctcaaaatatccgtgtccacgtttctatgttgattttgttcctgttgtttccttgtatgtgttctggaaaacatcgtcttcttgacccccaaatgtgacacttcttgatccttcatcacccgcctcatctgaatctgtcatagccaacttccttgttgtattattctgatgcaaagaaaaaaaatgtaagacatcgatttaggtaatgttgcgactcaaataatatcttgttatgtgcttgaaattacaactcatgtaaatactttcagacatcttatttgaccattttccgtgcctcgtgtgagtagacttccaaagttccagaacacctggctcagcaccagtttcttcatctctctacgaatgaaatattttgcatcattagtattcatttgattattattttgttagttcatctgaatgtaaaacatattcacctgttcccaactacactgagagaatggtttggaacccataagatgcatggttttcatttgttgcctattcgtagagttctgggtgctgaccttctgcacagataagacacgcaacgttcagcaattagcaagtacaatatgcacaaacgcttgtgttattaattgtacaaaaaagtgcctcaccttaaattttttggatccaaagtacatgatcagtcttgaggcttatttttcattctgtcttcataactgtcatatgccctgtacgtagcactaaaagtggatcaccatcctttgtatcgttctttggcaatcttccataccatctgcctagaatcatcattctgcgggatgtcccatgaattatgttggaaacattacattcaattacattgagaacataggtgcaaattgaaaaattcatttgcataacagatagaaaagaataaagatgtggcatatacataccattacacaatctgcaattgaattcttgacatcttgcttcacatctttccactttctaacaccaattagtggagtccttaaccttgtgtacattaccacttcatccacaaatgtacgcctattgtctccacatggaccacccagttttgctgaaaattcaactttaagtttacgagaagatgacttcaacctcttggtaccatggccaacttgcttgccatctacttacaatcacgtgagaaaagttcatacaaaggattaagtgttgattcaattgcagcaatgaaagtaaaaatttaaagaaatatgaactgaatataaccttgtgtatgctttgttattttcctagcatgagatggccattctatttctggcatgtcactgctgccattgatctcgacaccatctgatgtattcttattattggtaatataagctttgtaagccactgccaaaaaatgtacacatgtgcgctttgtagattataaaaagtaattagaaataataagtactccaaagggaaaaatacatactaatttgtttcagaagcccttgatcccttaaccattcagtgtaagttttaatggtttcgtccctgtaatcatcgtatagatctgcgagataccaacaaaattatgtaagtaaataatacaggtacagatatgcacaacttgctactgcaatacaactagcatatataccatgaacagtttcatcatcctcttggattgatgcaagccattctttgtatgcatcaacctcatcatcatcatcattatcatcgtcacactcttgctcccttggtcactttagaggtgtaatgttgacatgtcgttcttttacttgttgtgtagccagtactaacctgactttcttttctgaagctacgtccctaatcatgcattctgcatctcttctgtaatcaattgcctcaaggcttgctatatcatttccacatctcttcttgtagtacaagtagtcgcgcaagccaaaccctagctactcttatcaaagattcaaatcatatgttacccttgtcaacattggctttgacccagcgctctttggaccccttgcagttgatccatacctcccatatctcacctgtcaacttgatgctatttgtgtggaaaacaaccattatgataatatagtaggaatatcaaacattgatttacatgaaaaaaatatattcagtacacttctagtattcttatatagtaacataaacaaacgagaaaaaacaactctgttttataacatcaaaaaatgaaaatgtcaattaggcgcaaaatgcagccctctgtattatcaaatttgctgacctcatttagtacacactagggcaatgtttggcaaatgagaaagggaaataatttcacacccatctttaaatcctaactatacattctcaatcttcaatttaatcctaacccatcattgattttcccaatcccaatccaatcccatatatcccattatctaatcacaccctaggttaatatgaacatacgaagatgagcacatgaaagatgcgcactagttggaaaaaatactcacctttggcttaacgggtcattcaaatcctcttcttcaaaaacgacgtcggcatcctcgactattgccgtacgaccaagtatacagagacggtccacaggtcaacggaagcataccccgtgtgccaaccgaggcgagtggccgacaaacggactccactagacaccatgcgggctgcacacgtggaaacaacgcggctaccgagcgaacaaacaaccacggtcaccacacgcacccacaaacgactaccgacaccggtacacgggtaccggggtcgacaaacacacaacgggcatggggcgacatcgaaaggacgagaacagggcagcgagaggatggatccttaccaccacgcgatgaggcatgggaacgacgatgatgaacggcgcggcggagacggatgggaacgacggagacgaacggacgacacttcggcggcgatccttggatgaaggcaggacgaggccgacgcagggcttgatgacacggagccgatgacgaagacaacgccgaggctgcagcagacttgacgaaacgcgggcgacgaacgaacgcggcttgacgaagggacgaacgccacgacgaccaagaacgatggcaggacgacaaccggaactggcgaggaggcgacgagggcagctggcagcagctgcacggatgcgaggatgacgcggaacacgccgctgcgatgacgacgatggaggcggcaccgcgggatgacgagccggcaaggatgaacggtgaagacgatgacggacaccggcggtggggttcggatggaggggaggtgatgccgaggacgacgctcgctgctgcgatgccactgttgcctgcggggatgcacttctggaggtctccgagggaaacggagagcaggccggggaaggggaggcgactgtgacgccgggggaggcgacggcacggccggccggcgtgctgacgcggtggcaggggcggctggagttggccggcggcgtaggagagagaggaggtcggcgacggtgtggctagggagctcgggaaggtggaaaaccgaaggaaagggggactagggctccgttttataggcaatggaggggagtgccgaccacaggaggggacgggaacgacgccggagaacgtggccagcggcatcaatggcggtcaaagaagagggattaaatcctagtgattgggggcgggattaaaaggggaaagttgggggaaataatgaggaagggatggggattctgtttttgcaatttatttggccggaacttgcgcagtggagcgggatcgaaggatggcggcgctagggttcaggagagggacagagaggagcggccggctggaggttgaagacgaccgggtgggtggacccaccggtcaggcgcgaggcgcgcacgtgcgccgcgcgtgcagaggggcgcgaggggaggagggaggcggcctggggtggctggtcggctgggccggcacagggcaggggtggcccaagcggaagaggagggaagaggtggaccgggaggaggaggggaggcctgggagaaagaggggatgaaaaagagagggggggaagagagacttcggccgcgggccgagggagagaggaaaggaactttgggacggacttggcccaaaggaaaaggaggattatgtttagtttcctttttaataaactttcttaattgttgttgttgcttaataattgttcttgttgcacacaagcaaagctacaaccttataaagaagcaataacaatacataaaaagaaagcacacggttctttaggttataagaaacattaggagacttgaatgggtcaattcagggttcgtatgatcaagatatgatcatccgaagtttaatgctgttattgcaggggcgtgagcagtagggcaaggacaaggcgagtacatacactccgtgcacgacgccatctgcgggactgcccaaagccgtctcttttcgggtgccttcccagctagcgagcaagcgaccagctgcatccggagcttctgcggcaccaaaaccatctccaccatgataagcagagtcaggtaaaaattcttcgcaggtacccgccaagagtgcctcatctgttgcctcgacgggacgcattcagtgccaccgttgccaagggtttgggcatgtgtagaaagattgccctagtcaacaggcatatgttgctacagaagatggctacatcaccacctccaacgtggaagaggaagaggaagaaggagaagttgaggatgaggacggcgaagtctttggtcgtgatgacacaacggcctataggaccatcattgtaaagcgggtgctcagcacgcaggtacagcagcctgagaggttgcaacgccataatttgttccagattttcttcatcatcaacaaccgtcgtgcacgtgtgatcattgatggaggtagctgcaacaacttggtgagttctgatttggtcaagaagcttggcttgaccgcacgtacacatccacatccttaccatattcagtggttaaacgtttccggaagagcaaaggtaacacaggtttgcagggtttcgttttctattggctcatatgcatattctgttgattgtgatgtggttccaatgcaagcttgttcacttttgttgagtcgtccttgggaacatgataattatgctacacacaatggtaggagtaataaatacacttttgtgcataatgaaaagaaaattacttcgctacctttgacccctgctgaaattgtagaagctgataaagagcgagttgctagtttgaaacttgatgaatctgaaaatcagcaagttgttaaatctgtttttccacctaaaacggataagctttcacctagctctaaggttgagggaattaagttgaagggtggtgttatgcttgcaacaaaatgtgacattgctgaaatttcagatgatgatatttgctattccttgatatgcaaacaagccttggtatctctagatgatattggtagttcgatacctcctgttgttactaaccttttgcaggagtatgaggatgtttttccagctgagatacccccgggattgccacctatgagagggatagagcgtcaaattgatttgattccaggagcatcattgccaaaccgtgctgcttatcgaaccaacccaaaggagactaaggaaattcagcggcaagttcaagatcttttggaccgcgggtatgtacgtcaaagccttagtccttgtgcaattcctgtaattttggttcctaggaaagatggttcttggcgaatgtgtgttgattgtagagccattaataatattattattcgatatcgtcatcctatttgaatgtgtgttgaattattccacgtatgataaggaattgtatgctcttgtacgttctttagagacgtggcgtcattatttgtggcctaaagaatttgttattcactccgatcatgaatcgcttaaatatcttcgctcacaaaataatttcaatcgtagacatgctaaatgggttgaatttattgaatcttttccttatgttatcaaacataagaaagggaaagataatgtgattgcagatgctttgtctaggcgctatactttcttgtcccaacttgattgtcagatttttggacttgaatcaattaaagaacaatatgtgcttgatcctgattttaatgaagtgatgttgaattgcaaagagggacgtacttggaacaaatttgtgatcaatggtggatttgtttatagagctaaccatctatgcattccagttggttccattcgtctttcgttgatacaggaagcgcatggaggagggttgatgggacattttggagctaagaagacgaaagatgttttggctttgcatttcttttggccaaggatgagaaaagatgttgagaggttcgtggcatgttgcaccacttgtcagaaagctaagtctcatttgaatccacatggtttgtatatgcctcttcctgtaccttctattccttaggcagatatttctatggactttgttttgggaatgcctagaactaagagggggagggatagcacttttgttgtggtagaccgtttttctaagatggcacatttcataccatgccataaaagtgatgatgttgttcatattgctgatctgtttttccatgagattgttcgcttacatggtatggcttctactattgttttagatcgtgatgcaaaattcttaagtcattttttccgcacaccatggaacaagttgggtacaaagctattgttttctacaacatgtcacccacaaacagatggacaaacagaggtagtcaaccgtactttgggtaccatgttgagggctattttgaagaaaaaattgaagatgtcggaagaatgtttgcctcatgtggagtttgcgtacaatcgggcaacacgttctactaccaaggtaagtccttttcagatagtgtatggtttcaaccctcgtgctcctattgatatcttgcctttacctactagtgagagggttcataatgatgcaaaggcacgtgctgaatttattttgaaaatgcatgagacaaccaagcacacaattgaaaagatgactgaaaagcatagaattgctggtagtaaagataggcaagaagttaagcttgaaccgagtgatttagtttggttgcatttgagaaaggatagatttccagaattgagaaagtctaagttgatgcctcatgctgatggtcctttcaaaattattgagaagattaatgataatgcatataaacttgagttgcctcccgagtttggggttagtcccacgtttaacatttcagatttgaagccatacttgggagaagaggatgagcttgagtccaagacgacttcaattcaagagggggaggatgatgcggacatcactacctcagatacacacaacaatcctccaacggtcattcaagtaccgataacaagagctcatgcgcgataattgaatttagaggtgagctcattcctatgttcttctttgtatgaattcgagagtagattgctacctaatgattatattgtgattagaaacaatggaggagacaaggagacacttggagaaggacttagagccatggaggatcatcgaggacgtccaagttaaagtggaggcccaaaccaagccgacctcgagtgtaattcagagtccaggaccagtctgcactaaaacgggcgcccaggtcgcatacatgctcggattggggcattctttatatggatggaaagctaagaagataacctttccaatggttttcgtcccacatccaaattatatccaagtcaatgggaatcgaccgaacaatttgacgtccagaatatgtcacggtgctgcgtcaccgtatttgggcctttgggccgtgtatcgtgttagaacccattagggttgcgtcgagagggggttgcacgaccctaaactctatatatcagtatccgccgccatctttaggtttttgggttttgcttagattattctgtcgagaacagtttcgccgctagatcggtttgtaagaccccaactcgtgagtttaatcattcatctgcaattttggttgttttctataccgttctcttttgtgttcttcgattggcaaatagggattagccttctcggtgaggtcatccgcgtttcgacacgggtgataaacagaggagacgtggtgctgcgattgcggggctcaagagcgtccgcgttcgagaagccggatcgatttgtgtcgcgactccgcccaaatcgttgtttatcagaacctttcagaagatcgggaaccctagtatttatgtcaggaagggaggaaccttcttttgccgagcctgaacctgagccttcaacatctttgggtctgactagagagtcctccccagagccatcgccggattccaaagaaattcaagctccgggttgtgctcctaaatttagggatgatcctcatagcgattatgagaaaaccttgacgggcatcctccctgataatatgttgatagaggaagtaatgacggttctgcttcatgagtcccctgaatctactctagaaccggatgatcttcatttcattcaaaaagattctggtgagacctttgaattgcactccaaagaaccaccatcacagcttccccatcgagcctgaaccttattcctctggccatcaaaatgttgttcttgacatttgtcaagaaacaaccttgttcttgcacgatgcatctcttgggaaggagaacctgcaagccatggacaagcttgagacaccaactctagaggatgaaagtccacaaatgagcatgaaagattctctttcaaagttcctcagtgttcatgctcacataaagaatcctcatagttccgtccgattagtttcacttccttgtgcaagaaccataaccgccttagggtcctcatctctatcatgtttagaaggttggttgtggatgcttttatttatcataaatattgcaaatcttgtatgtgtctgtggcactaatcttgcagcgagatgtctccatggtcgagcttgtgaccataaacaaagcaatgccgggagatatcccggattatcttggtaacttttctttccaataaaagtaagaatcagtttttaggatattatgcaccttcgggtattcttagtcagtaaccatttcaggctgagattaagaatgagggacgtacgatgcctaagaacataggaactacatcaactgctcattttggtgatccttggtgttggtacacaccttataaagatcccagtctcacacacttgatttttgacgtctcataacgcaaaagtccaagtgtgggggaggaatgtcgacgagcttgcatgacaagttccatcaaccaaggccaccttgtttgcagttggcgttagtcttaccttgcagataaaaaaagaaaaaaaagaagaaaaaaagaaaaaaagagagacagaagataaaaaaaagaaatgaaagatgggacaagaggaagagagcaagagggctgacgggctacatctagttcaaagaccgcattatgtgcgagtttttaaaataggccatacacctcgctagtagcgatcatgctacctcgctacaccaagcccctctcttgagctcatgtgccaccttggcttagccttcatccactcctagttgtgcacaacctctcgctcctgcaacacctacacacatacaagcaagaggagatgccctcttctttcctaggtgtttgctgctacactctagttggcacttgcatctttgcctaagaagagatgcatcctacgtctctacaaaattttgccaacggaacacgccttcaaggcacaaggttcttgcacccgagatgtgggcataaccgaaccacttgcttgagttggtgtggtcaaagtaccttccttcgccacaacccacatcaagacggaggagagattgacaatcacatgtgaccatgccaccgctctagagatttcaacatatacatcatgctggcggtaagtgcactcaggtataggacatgaagcaaaagattcaccatttcttttactcatacttatctctagttgagtctagcttgatcatatatggttatgcgtcctcagtccatttttcgtatgctatggtttgggtggtcgtcaacattcataggctttttaaattaagcatgatgcttatgataaatagtctgctttaatcaaagttgatgtggtgtcaagtttgtttaaatgaaccgtagagccagtactttcatggacttcggatgtatatccttcgtagactaacccctgcaggaaccttttcaatttgacgggtgagttctcaagcatgagtcacactggaggtaagtcaagggccaggaacaaatcaattgccataacaggcaaaggagagacatatcacctctcaagttgcacggtacgtatattgccaaatactcctttgctatgcttgtaactttatctcagccatgtatgagttctgcttaaatagaagtttggtgaaccaaaaaaaatgtttttaagaataaaagaaatgtctctcggagaaaaaaaaaagacaaaataaaattatggcaaaattatgggatccatgctcattaagttttcaatccaattcctttatagcatggatgtgaacaacaaattttgaggctatgataaaatcttttcaattttttgtagtccctcgagtatttgttgtccactaaccttttgcatgaaaataaaaagacaactaaggagcagtgtagaataacctcaacattcataccacgctccttggactatgagaagacagatgcacagggaaccaagcagagcaaatgcaatactttgttatagttgattcggttcaaagtttggtaagttcgatctggtaataatctcaaacaccctgtgtatcattgcgtcatatagtcgtcctgctaggatacccaccatgctcattgttgccataaaaaaataaaaaataaataaataaataaaagtgaaataaaataaagtaaatttaggcacttcatccgcctagagttacttaaataaaatttggctcaccggtattttaccccagtagaagtccattttactttccatgtttttgttgaataaagacaaggtacaaaacaagtgtgggggaatcatttccgaacatccgacgcgcaacagcatcaactcaacatgacaacatgatgaacaccaacccacggctgcgcacaaaattcagcagccagaacagagtcctggctgggtcggttgaaccaagtgttcgcccaacccttgcttggtccgattctgtcatccttcgccgtgtggtcaggtttgcgcgtctcctcccttatcctccactatttgtgagttaaacttggcagaaaaattgaatacaaatttagtttgactccaaatgaaaattgaaaacattaactctcaacaaatagaattttcctatgattgatcatgtatactttttattctttgctaacacttgtcacttgtgaacaaacatctatcatagggaaccttgctcatctaagtaattgatgtatgtgatatggttatgacgaaagaaattcctgtccaactgtcatgatacttgggattttgttttgtgaaattaaaactttttcgagcaatactcctcagtgactatataattacctaccaaggccatgtataattatcattgcagaaacctttatatatatgtatatatacatatatgtatatatatatatatatatacatacatacatactagcaatagtgcccgtgcgttgcaacgggaaaaacactgtttgatagtgacaccttgaaaaccttaaatcggtaaaaatcaagtctaatttgatatattaacaaataggtagaaccgagtctaatttgatgaattagcgtagaatttatgatttagttttagatttatttttcgagcctacttaggagcttatccgacggattttgattttaaaaatctaagtcacattgtttgatcaaatttgctttcgacccaggtcttcctagtcggcccaaacttgggctggcccatcttcggcgagctaattcaatttgacatcccgcaagccgagcagctgagcgcggcccacatatgcggggacggtccgatgcacttcgacggcccatttggcacagtgtaatcagcggcggcggcggcggttttttaagtagtatttttttcgattcggatctatagtttttttcaccacttaggggaaaaagacttttgttgttgttgtttttctttattttattttttgtgtggcttttctttttctttttatgcactttctgccttcattctcccttttattatttttttaacaaaaacgacctcaagtaccttattgcaagattatagggactcaaatgtaaatataaaaattacatggactcaaatgcaaaagtacaaaccaaaaaattaaaatcatataaaatggaatgctctcgaccgtaggttccgtttttgcaaatatatcttcaattcgacacatcaatttttcaccaatgtagagtcagactttttttttcttttttgaaagggaagtcggacttttttttcttttctaaaagggaatcggatataggtgtcggacttttttattttattttttcgctattatttttttttgacggacgaaggaagcatctctcattttgacttttattgttgttgtttttctttattttattttttgtgcggcttttcttttttctttttatgcacctttctgcatttgttctctctcttttattatttttttaacaaaaacgacctcaagtaccttattacaagattttagggacacaaatgtaaatataaaaattgcagggactcaaatgcaaaagtacaaactcaaaatttaaaattatataaaaatggaatgctctctgtaggtttcgtttttgcaaacagatcttcaattcggcaatcaatttttttcaccaatatagagtcggactttttttcttttctaaaagggaagtcggacttttttttcttttctgaatcggatataggtgtcggactcttttattttatttttttcgttattatttttgttttgacggacgaaggaagcatctcttattttttaagtagtatatatatatatatatatatatatatatatatatagatactactatagagcaccctaaggtgctacgtattaaacagcacctgatacagcttctaaccccacccctccaccctcccaccctgctccccaccaggtccatagtacgtagttaaaatttaactcaccaacgaccaatctcgatcccacccctgcgccccctcccttcactcccatagtccgagtaaattttttacttgatgttatccaacttcttagtagttctatatatagttaaaatttaactcatcgatgaccaatctcgatcccacccctgcacctctaccgccactcccatagccgagtaaattttgaactcgcgcaccaccaagagctcccctcaccccaccatgtcaacactcctgcccaaacaataataattttttactcatgccaataattctatttataccatccataaccatcttaccgtatctataaccatccgctggaagtaaaaacattactaaccctaataattattatagggaaaaatatgtagcaaaccctatatgtaatgcaaacgtagaaactaccattggatcgaaaaatggacgcccgatattcgtccacataacatgagttaaaattttacccgcaaattcactcatgagttaaaatttcactaggagtaaaattttaactcatgcagacgtggacaaatctcgggcatccatttttcgatccaatggtagtttccacgcttacactacatataaggtttgtgctatatatttttttctatttatagagcccatgacttgcggggagtcaaaaaattactacctgtagaacaagggcctaatttttactgaccctgaaaatctgcttccgttaagtaaatgttttactggtagtgtgaactgaataaccgagaaaatagggattgggtggccacgtggagatcagcagggggagcgctctggctgagggtgcggggaaaaacgaaaacacgatctgtgggagaaaaaacggaaaaaccggagaaactctgcgctgtgtgagtcgcgccacgatgttgcatagcgcgccatgatccgtgagtcgcttcgtatagcgctaccgtatatatataactactatatggcaccctacgtgtcatatagctaaatagcacgtctcaacgtaagccctcccctccatcctccacatcctccacccaccacatcaagatgttaagtaattttttaactcgcgaacgaaaacataaagcgctaccttattggatgagagacacacgaaggtgcgtagtaaaatatttactcacgcgccatgtgcagctaccctctttcatattgagatgtttagttatatttttacttgattaaaatatgagtatttataccgtaggaaatcctatccaaccattccttcctccgtcaattactccatttttttgggatctacggcacggcagcctcaaccgtgattccagcagaggaaaggatgacgactccttcaccgcgcgcttgccagcgagggcttgatggctgcggccaccggcgacgaagaagatgttgaggaaacacagggctaccggatcggaaggatggcgacgagagaagccaaagatggctatgggcgttgtcgctcccctggtctagccatgggcgacgggcgccggtgtgctttccgagccatctccgccatgggaggaggcgtttgacagtgttgtgggcggtgtcgctcccatggtctagccatgggcgacgggcgccagtgtggtgtcctggccatcgccgccataggaggaggcgtttgtaggcggcgacgttccccttatgttgcggctggaggttggctgtccctgtgctatgcttggattccaggcaaatctggcactgatggctgacattgcccgtgcatggccacacctgctgctcgtcaatttcttccacatctacaagctgggtcctcaccaacaccggtgtcacctctcatgttggtccctagctgtgctctcctttatctcctctctttcaatcaaaggggtgggtaacaacaaccctcttcttaccagtagaacaaatatatgtttcctcttcgatggtgcggtcttaatttgcaacagtatcgccttacatttgctcattgattttgttgtagattgccagcacccaaagacagccgaggacttcctcaagcttagccccagccccaaggttgattgacaaatgaccttgattattcgtgcatacgccaacggttcacaatccacatgatcaacatttgcattttagtaaagaatgtgattaccttcttttgtttagttgccgctgctagcatcctacgagctcattaatctgaactaggggatgtttggtttcgattgtgaattgttgttcaattcttaggattgttatctgaatggaatatctgatggtgattctgtatcagagtatgtactacttttctaaattacatatgactaccacccattatcaaaatccatgcataaaaaacagaatcattttttattggctcagacctgggctgtaggcaggcactagaacggataccctcatctcaatcgggcggtaagccccatctcaatcaggcacagcgtccgtcacaggctagaagtcactgatgtgaagagttatctcaatcgggcaaatggccgtcacgaatgaatatatctcaatcgggccctaagtaaagcccgtcaccgaccagtcaaactatagcccgtcacagatgacctatctctatcgggccacaactagcgcccgtcacagatgactactaacctttatcgggcctaaactagagcccgtcacagatgatactcatctcaatcgggcctaaactataacccgtcatagatgactgatgacctcaatcgggcctaaactagagcccgtcacagatgactgctgacctcaatcgggcataaactagagcccgtcacagatgactagtgacctcaatcgggcctaagctagagcccgtcacagatgacctcatctcaatcgggcatttagttatggcccgtcacagatgactataatccacaaaaaaaataaattttgttttttgtctagcctcaggcctttgctagccatgcccgctgcaaaaatgacagaaacaaacacagatatccaatatcctcagctccccagcatcacccattcatacatatgcattcacatacacagacatcaacatatttcacacaaccacacattcacagccatctcatatttcacatccattcacatatttcacatccatttaaatatttatcatatttcacctgcaaaaccgagttaattggatcaaatatttatttagcaagtcttaacataaacatatgaaatatatacataaatataagcatcacagttacatcatcacagttgcataataagtgttcatcattgcctaaacatagaatttcaacattgttcatcatttcagtttaagcctaaacattcctttggggttaattatttcgcggaggatgaagctggctatctcctcgcgaacctcctcaaagctggtagtcagagacttggttattgtgccctacattgtcataattctagattagttgatcgatcatatataagtactaaaatgtagttagtctatcacaattgagaccaccgacctcaaactcagccaaagtcttcaccttttctctatacagaagtcgtatgttgtggcacacatggaatccgcactggtcacctatttgttgcttcaccgggaagtcttttttgtggatgagggtgtcatgtcctgtcttcctgaggcctcctctttgcacgtattgggcccacgcttcatctatcgctagttgaattgaggtccaatcatatgcgttcttatcaattctggagttcaggtaatgacatgtactccatttaggtgttatgaccagaaggatccaatgggcactgcgacattaatatagtgaaagttaattaagtactcaaggaatgtgtcatgctgttatgtcttactattgattataggcacacataatgtactccttgtctcggcgggaccacaaggtgtcgtagatgtagttgaccattccttgacggtcattctggagatttgtgacagtgaccacttgtagatcaaggaaggcaacttccggtgcatgcttcttacaccattgccaacttaacctacacacaggatcaacgatcttgtaagcaagttaaaccgattgttattaccagaatgagttgggcgacaatacttacaaggagtagcacttaaggagacttgtgtccaccgctcggagcctgtagaggtcgaaaagatccttgaagtcgatcacgacataatttattggaccaaggaatggctttccatcgtgctgtccaagtatatcggtagctttacttggcttcctggcgttagatttctccatgtagtataagtgaaggtccttgcaagcggtgcccattgcggcaagcacgtcatctccaaccaatggcatgcctagttggaactcctgtggagcgacgtatttcttcttgacctctttgcccttagtctcttcctggcccttgcccagatctagctttcttggagctagaagcgaggtctgcacctttcctccccttcctctccccttttcttcgggtttatcgagagtaattctctgaggggaagagtgtgccttcctgctcttcttcatcggtgggggttcatgaatcgccttgctgtcggcctccgttcggtcctccccaaaatccgtgtcgtactgcaactgcacatcgtaagattgtgcatgacgatcttgagcatgaggggctgaaggagcagtggcgggtctctttggtggaggaccgcctggtgcagtggttggcctcgctataaccctgatctcaatgaggtccttaggccattggatgaaggtaccacgggcatttcctagtgagaggacctcgtcgttcggtggatacttcagagggaacagctcgtattcgggcttcaccgagtcgacttgaacttttgcacagtcggccctgagttgcgctccatgcactcttgtctctggggtcggcttgtacgcaagtccctcggttgctagaacagtgaaggtcagcatcaccctaactgtgagggtgcagctcgttggttcctgcgatagattaatcaatttttttagaatattatatatcatatggattcgttacatctttcatgtattgagtaagttcacggttaccgttatgtggtcgacggcgctgtcgaccgatgttggattttctgccaattcagttgatgcgcaactgctgcgtttttcggtgggacttcctaactctttgtgcgcagcagcagcgccggcctgggggatctgttgctcttctcggatctcttgcctaatcttggccctcatcgactcgagcttttcgtcgaattcagatgtcagcttagctcgtatcgactcccggatcttggcttcaagtcgtgcatctttctccgccttgttggaagtccgcttcttgtactgccacgcatagtctggaaatccatacttccagggaacagaagacccaacgccccgtgtccgtccacggtgttccttgttgcccaacgttttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgactagacacttactatagcttcgtatactcgttgatcttctgcatttggcatgaagattgtgccatcatcatgtttctggtacctagccctggcccagttcctagcccgagggtgtgggatatcgccaaacacgagcggtgtgtacgattcctctgcttcttcatcctcacgctgccattcctcttccttaccggcatatccggcggtaccaagccggtgcggatgctggttcctggtctggagcaagcgatatgccttgcttctagctctggactcgggggtcgacttcttcgcatggaattcctcccagacctgttccgtgatccaaggaaatttctctcttggatctggatttgccgggttgtaaacgaactcgccgactagcttagtcttgaagttcttccaagcagtgcccataaccttgaaagcagcccgcctgagacggtcctcatgctccgcaggataatcaaagctctccttgaacgttagcgaagcaatgtccttctctgcggccggcacgagcttgaagtcgtcttgcagaatactgaatttctgccttcctatgaccccgcagatagacctaaatcggctcaatattttccttggagatgtcggcaaccctacggcgtccaccgctgttatgcggaaccgttccttaggaattttgttccctgtcctaggagtacgtgcccttgaggacccactagttgtcgtcgacattggttcgccttgctgagacattgtctacttttttccaaaaaaacaaaaaaaacacaattgagtgctacaatctattacaatctattaaccacatttcacaataatttcattaatgcaccacatttcatcccaacataaataaaccacatttcatcccaacacgaataaaccacatttcatcccaacataaataaatctcatttcatcccaacataaataaaccacatttcatcccaacatgaataaaccacatttcatcccaacatgaataaaccacatttcatcccaacataaataaaccacatttcatcccaacatgaaccacattgcatataaataaagttaaatgaaccacatttcatcaatcactacaatcatctatcacaaaattcataaatgcaccacatttcatcccaacatcgacatgtctcactaacagttcaatcacatatcatccacatccacatttcaatgacatgtcattcacagttagcagagggcggcgcaatggaggactcacctgaggatggccggtggggctcggtggcggtggcgcccgggctcggtggagggcggcgccggtcggtggagacaccgatcgggcaggtcggcaccgggcgggcggcgtcgtgctcggtgggggtcggcgacgtgggtcggtgaggacgcgggtggcgactacgaggaaggccaacaccggtccggtcggtgtaaaggctcggtggcggcggcggcgggctcggggggggggggtcgacggtgaggaggctcggcggcggaggtccgaatggagggccgaggaggctcggtggtgacggcggcaggcttgacgagggaggacgactgcggcggcggcgggctcggtggtgacggcggcgggcttggcgagggaggatgacggcggcgctagggttctaaggaggcgggaaactgtagcgggacttagaaaaattttcgatccgctctgagaaaccctagttatattagagtgatgagtcatctcaagcgggctttgccgtagggcccgtcacagatgactcatcggtgacgggctccatactaatgcccgattgagatgacattcaggcccgtcacggatgactcatctgtgacgggccctaagataatgcccgatagagatagattaatctctatcgggcttgaactaaggcccatcaccgatgactatttttccattttccaggcaagtctttatatttgtgagtacaagatatatagctgttgtataataattcattttattagtcataacatattttcggatagtaaatgatttcaaatcgaaatatggtcaacaacaaaattgtagaggttatcaagatctacaacttttattttggtcatttgtctatataactttgtttccaacagcttgaaattgattttgacaatatgacaaatataatcaacatttgtaattactaaatgattttaaatggaaatatggtcaacaacaaagttgatcctctcatcaagatctacaacttttattttggtcatttatctatataactttgtttcaaacagcttgaaattgattttgacaatatgacaaatataatcaacatttgtaaatactaaatgatttcaaatggaaatatggtcaacaacaaagtctatcctctcatcaagatctacaacttttattttggttacttcttcatccgataaagtgatagttatattattcacaaaaatcacatttctctcatctggtttataaatatcaacacagatatgtcaattttgtaaacattggtactatcactttgtcggatgaagaagtgaccaaaataaaagttgtagatcttgattagctgtacaagttagctgtttatggctttcccatttacgtcatgtaatatttacaaatgttgtttagatttgtcatattg

SEQ ID NO: 9283 - DNA, 9509 bp, Oryza sativa
attaatctatctctatcgggcattatcttagggcccgtcacagatgagtcatccgtgacgggcctaaatgcaatctcaatcgggcattagtatggagcccgtcaccgatgagtaatctgtgacgggccctacggcaaagcccgattgagatagattaatctctatcggctgtaaactaaggcccgtcactgatgactcattttccatcttttatttgttgtgagtgcaaaatatatagcctatataatttttattttggtcattattctgtataatttttttcccaacagcttgaaattgatttcgacaatatgacaaatctaattaacagcatttgtaaatactaaatgatttcaaattgaaatatggtcaacaacaaagttgatcctctcatcacgatctacaacttttattttggtcatgtgtaataaaacaaaattagccatattaatgactacacatatcaagtctatgcaataaaacaaaatactttattcattacaatagataagtacaaatgcatcagccacaaggttatgccttcggtatgatctgaacgagcatatgccacaggctcttggggatcatcgtcaaggtcaatgtgaggtcttatatgaagattatggttgttttcttcttcatcgacgacgttgtcaactcctacaattcggcgctttccatccctcacgatgtgcatcttcttgtttgaagggtcttttatgtagaatatctgctcgacctgtttcgcaagtacaaatggttcataggcgtatcccaccttagatagatctactaaagtgaaaccttccttgtcggctttgacaccagtgcgtagattcacccaacggcagcggaacaaaggaaccttgaacttgacgtagtttagctcccagatctcctcaatgtggccgtagtatgtgtttgacccaacttgatcctggaatgcatctatacggatgccgctgttttgcactgtgcttttgtcatcttgtttgacggtgtaaaatgtgtatccatttatatcgtatccttgccatgtgtctatggtccaagacggtcccatccccaacaactgtactgtctcatttgggacaaccatggacattgtcacacgattcttgaaccattcgttgaaccgagaattatgttctctgttaatccatgcatcagatcgccccaagttctcatctcggattttcgctaagtgttcctcaaagtatgggccaacttctgccatatgttggagcatagcgtaatgagcctgcgcgtacgacgcttgatcgggcctaattcttttccttccgattgtgccaacacctgacaaccttccctcgtgacgagacgctggaactccgataggatcggcatcggacatgtaattgacacagaactcaatagcgtcctcggtcgtgtaaccttcaatgatgctcccctcgggtttagctctgttacgaacgtacgacttcacaactcctatgtacctttcaaacggccacatttcccttagaaaagccgggccacatagttttgtttgcttcaccagatgaacagggagatgaaccattatatcaaagaaagacagtgggaaaaacatctccaggtgacagagggtattcataatatcggtctgcagcccatctagatcttctggatctataaccttctgtccaattgcattgaagaaggcgcacagacgttgaatcgtgtaacgcactttcggtggtaaaatgcctctaatagcaactggcaagatttgtgtgattagcacgtggcaatcgtgagacttcattccaacaagttttagatcgtccaatttaacatacttatcctcgctgaatagcccgatggaactttaatatccttcaagcatgataacattgcgatcttctcatccttcgatagtgtgtggcaggctggagggaggtacactttacctgtctctgcatctcgtatggactggagttcgctgcgaatattcatgtcctgtagatcaaggcgtgcgttcaacccgtcctttgtcttcccgggaatattcaacatcaggccaaccaaactctcacacacattcttttctacatgcatgagatcaatgcaatgatgcacatcaagatctttccagtaaggtagccgccaaaatatggattttttcttccacatacccttctcctttgtctagctacgttttcttttcttcccaaactcattgcttatgtccttgaccatattgtggacctcatctccggacaaatctttgggagcaggctgaagttctctcttaccattaaaaattttcttctttcttctaaatgtgtgacatagcgggagccacctcaggtgacccatgtataccatctttcgtgatttcttcagccaccggcttcgtgtatgttccttgcaatcggagcatgccttctttccttttatagtttgtccggaaagattaccgagtgcagggtagtcattaatggtgcaaaacaatagaactcttagcttgaagttctcctgaccatgtgcatcccaagtttccacaccttctttccaaagaatctccagatcgtcgataacaggctccaggaatacatcgatatcattgccgggttgccttggaccttggattaacaagcacaacataatatatttctgtttaaagcataaccatggcgggaggttatagttcgcaataagaactggccaagtgctgtgagtactactcatgtcaccgaaaggattcatgccatccgtacaaagacatatcctcatgtttctagggtcggcagcaaagtctttgtgttttcgatctatattcctccattcaatcaaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacagacctctaaccccagtggacacagaacctgctttgcatcgtatatcgtcttgggcaatgtgttctcaacaggaagcatagccttcaaaattcctaaaagatctgtgaaactcttgtctgtctatccactacttgccttcagcttcattaggtccaaggtaactgacaacttagtgtgttttgctttgcatccaacgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctaattcttgctctccatgcttcacccaacatgtatggccctctatgaatcctcgttgtatcagatgaccgtgtacgtcctctccgctatcaaacatattctcgttcttgcaatctgcacatggacaacacatgtaattactgtttcttcttatccgatcctcctccacggcgttcataaattttattacgctctttcggtactccgtagaatgacgtttcaaatttttggcatacatccaacttcgatcaattggtacaaaataaaaaaaataaattagaggcacatattataagatcagtattgcaaaagtaagacgtgataaaattgctcaattaatgatttatattactcacttgattgatccattttgatcacttttgagaatttaatttctgttttccttggaaaaaggacaaaaaatcgcccccaacagcctcccaccaaaatagtgaacagtgggatacagttacactaggtggtggggggtatttatactgtgcaacaaatatctgtaatggccctaaaacaatcaaccgtgacgggcatacaagtaatctctatcgggccttaataaaaggccgtcaaaaaagagtgtcatctgtgacggacaataaacttatctcaatctggcctctagttggagcccgtcagaaatgaccctcatctgtgacgggtttcttttaggcccgattgagatatggaaccctcatctcaatcgggcctcaactatagcccgtcacagataagtgtcatccgtgacgggctttagttttatgccgatataccatggctgtgcgaccatatctcaatcgggcgaaacttcggcccgattgagattacttccttatgacggcccgcaaattccagtcttgttatgggccgtcacagatggaaggatctgtactagtgaggtcagatctatggcgcatggctggtgatgtgcgatggtgatgggtcaaccgatgtgtggactaggagcctgggacgcacggcgtcaaggccgaccacgtcgtcacgtggtgaagcaagccaggatagatgcttactatcgccggctatccaatgctgggccagctgttcttcctcactcctagaagaacatatttcttgtttttgtgggctagcttgatgtgtaatattttttcacccgcatagtgacttctacaatgtttgtattatttactcataatcaaattttcatggttcaaggtaacaaaacgaacggtaacatattgctatttcacatattattctaagataaatgaagcaacaaatgagaattcatgggagtaaaagagaacatgtagtaaaatacatgagtaaaattattactatgaggacatgagtaaaaatattactatgagaacatacgagtaaaaatattactacgaggaaaatatatccgagtaaaaatattactatgacaactcgcaaaatatatgcaagtagaagaattaatgtgagaactatatgggagtaaaaattttactaactttggagagatttttaccaaataagttatgtcacgcccagaaattcacttataatttccgaactaatttgtgcataaaatcctcgtccaggaatcagccgaggtacacaaactgacaatttaatattcaaatccatcataataataataacgttacatacttacaaaagaaaagaaaacagcagcggaattaacggtttagcaatggcttcagctccactcccacaggcagctcaactggggtataagccaaacgtcttctacttctggatccttttttttcaactgaggtttgatgattattgcaaggtgagcatatgacatactcaacaagccacacagcaaatatgcaagtgcacaaggataccaaaggatggcataatataggctcatttgcaaaagcagcatttagcaaagatttaagagtaaaccagtagagtaattaatcagaaatattaatcaacactgaacagcacacccatgctgctcaggcccaaccatccagaacaaccatacccggctgtacagatctaactccaaaccaggagctaaacaaattattaccagttattgcatcaataattatttgtgagaggtatgagactaatcacgaaaaacattgctcaacccgcccatgaccgcgggcacggctattcgaatagttttactctagccagagatgtaccattatacccacaagacacgattccacacatattgccataccccgaagtaccaccacggcactgcaaagggactccacagcgacccccatggacttctcgccgcttctcagtctggcaccccgtaataaactatgctatacaaaaggtaaagccgttgcccacgctggcttgtggttggcacggttaatgtctcacaatagtagctcgcgaaccggtccttaattgccatgagcacgaccttcaaaaccatgtgctcacaacccaccatcgacaagttttaattatcatttaattatcataacacgattaaccatcgtgagctaccattaaatataaccataaataataatgtagtgtgattcatcccattagtaagctaatgtttctaagcatggctaagcaatcatatatatatatatatatatatatatatatatatatatatatatatatatatatatatagcatttagctgaaccaaaccaatatataaggttctagctaatcaaattataacccatagaaaaataaagtcatcttcggccattaattaattgggaaaggctcaccacccgatgacattcgaaaataatgcataaattgaaataaaacattagctttaaacgggttcaacatgctcaaagggttgtttgggatctgtgtgacttgccttgcaataattagtcttcaattagtctttttaacacttccgacgcactcacgaaccttcgcaacgacggaaacgacaagctaacacgcaaaacgaagaaaaagactaataaaaaccaaataaacagtacatataatgtaaacaaacatgtagatcatgattttagatgaatttagagacttgaacggcctcattctgatttcatataaattaattgtgaattttaaaagatttaactctaattaaacctattaaagaaaagactattccaaattaattaaacaatttacaaataatttatatctgagatataagactaaagcatcctccggaaattattgtaatgaatttagtagacgacatatagtaaaaagaactaatatgtcattgaaaagagataacaggatttatattgattttgatggccaagatggcgctgatgtcagcgatgacatggctgccacgcgggatcgacgccggcgagcacgggaacggcggttaccagcgaaccacggtacaatgatgcaaaccgagggcaccgggtgagagaggagatcaaggcgacctttaccaccacttacgcgacgacagacggcgagggagatggccgacggcggcgaagtactgtccacggcggcgacggtgtttcggcgacgagcagcagcaacggaggggtggacgagcttctcctcgcagctgcgaatccaatggaagcgacggcgaccaaaggcgaccatagacgacaacgaacggcgcggctggagatcggaacatgacggcaacccactggttcatggtgagattgacttccggcgaggtttcggcgcaaggggaacggcggccggggtagctctcacccttgcgaagccgagggaggtgacggggctgaccggcgacggccgaggcgacggcgcacggcggctggagaggcgaccggaggtggagagagagggagctcgcggggaggcggctagggctagggaaaaactcgggaaaaagagggaacggaagaggaggtcttgggactgctatttatagccggaaaagggagagatcggctcgggaacggaggaatttggtgtaggaagctaggatttatccgagttcacccgaataaaaacggccaaaattcgtgagatagataacgaatttgatgggggtttcttgtggataagatagaggagatagagaggaatccgtttttgcaatcaattttggaagggaagcaacggagcgaccggattcggcggagattggcgccggtatcgggatgaacacggcctctgtccagccggctggaggtaggagaagcactgtagcgagagggagtataattagactttaggctgggctgaggacagagagaagggatgaaggaatgggccgaaaagggcccaagctgaggaggaggatttttattacttttccaaataaatcaatcaccaaaatgatctttgaattgttaaaaatacttccattgctcaaataatttcagggaaaatcctgaaaatacttggacactcaaagtacttaaaaaaattaaaataagatcatttaatgattaatttaatatttaaataattgctgaactgctctttgtatgattaaaattaagagttgagctccgaaaaatccgagaaaattccagagattataattaaccatggagaatttaataaaaattaaattcatccatgctttatatttaggaaattttatttcccacatttaacttcacttgtaaattaatgaacatttaatataaattctaataataatttattaaataatttataaatcctaaaacgaaaatcaggatgtgacaagttattactaccatctacatttctctgttctcgagctgaataaaaatggcaaacggaagaaaatatactgctaaattataaaaggactggattcagtaaaaattttactacagtaaacttttacgtttactctctagtaaaaaaaattactattgatggaaagttgaaggaaaggaaagcaccatgtacaaactttttactccagtcaaactgtgcatggatggatgggtgggtacgaattgaaaggagcataaaatccggaaacagcaggaggaaataaacctcaagtaaataaattactcctactatggatgaaacagagagagaagatagtgatcctatagtgatttttttacttttgagcgatggatgaatggcgagcaggaagcaagttattttactgaagcagtgatttttctagtggacaattgatacatgcgtaaggactataggaggaaggaaatattttttttttactgaaaccggggaggaccggtcaatgccgcaacttaagaaactaaaacgagaaaactggggaaacgatggatgcatgtggatgcggaaaaaggcaagtaagttttttactactggatgagtgcacgagggatgtgcggcaggaggagaaaaaaacggaaaatacggagggaagagtctatttcctagcgcgtcagagacgccatgtaatatatatatatatatatatatatatatatatatatatatatatatatatatatatatatatatatatatatatatatatatatatatatatatagaactactatagagcaccctaaggtgctacgtattaaacagcacctgatacagcttctaaccccacccctccaccctcccaccctgctccccaccaggtccatagtacgtagttaaaatttaactcaccaacgaccaatctcgatcccacccctgcgccccctcccttcactcccatagtccgagtaaattttttacttgatgttatccaacttcttagtagttctatatatagttaaaatttaactcatcgatgaccaatctcgatcgcacccctgcacctctaccgccactcccatagtccgagtaaattttgaactcgcgcaccaccaagagctcccctcaccccaccatgtcaacactcctgcccaaacaataataattttttactcatgccaataattctatttataccatccataaccatcttaccgtatctataaccatccgctggaagtaaaaacattactaaccctaataattattatagggaaaaatatgtagcaaaccctatatgtaatgcaaacgtagaaactaccattggatcga

SEQ ID NO: 9284 - DNA, 6067 bp, Oryza sativa
acattacatcgagctttgtcaaattattgtgacccatgtgagatgcttttcgtactttcatgatcaagattacacgcacactcgacatacacacattatgctaaatttctacactggaagctagcatctctcatccatcatttattttatccattatccacaaaataaatactccacctcatttatgcctcttgcttcgaaattctttcaaagaaaaaaaaagagaggaagagaggtatgactatgcaaaagaaaaaaaaaagataaagtcttgctcatacaagtatggagcgttgataaaaaaatgaataaaaaaaatcttgctcatacaaagtatggggcatgataaaaaaaaaagggaagaaaaaaaggtagccatgcactctctcatatttccaatgaaagaacattggaggaggaggtatatcaaaggagttgttgtcttcaattttccattttccacccataaaacaaccatacacatacatacccatacatatatcacacacatgcacattcttgatcagagagtatgacttgctatctcctttggtccggtattttggctttgtaatatatgtgatgcaggtatgcctggattgatccctaccgagctccacctctatagcctgttagaatagggacaattcggcaaacatgccttggtgaggatcgacaaataaaatcacatgagtgatctgagagaaggtcatttgaggagtacaactactttgcgaaaatataaaaaaaccctaagagattgacaggaggaataagatggacttgagttacgaccgttccattcatcaattgcccaagatggtaagtttgacactgcaaaagttcacaggtacatgtgtggcttaacatattttgtatacttgtattatatcttgggaaattttattcctcattaatccttaacctttactcgggacgagtaaagagctaagtgtggggggtttgttgacggctgttaagtgccaaaataacaccgtcaatacctgtataaaatcataaatgtgaaacatctaacatagtggtaggatgtatttctaacaatttccacgagtgttggtgtatattcgtatgcaggtgatagagagtgacatgggagagagtgagcataaagaatggaaatatattttgcactaacggactcacatggttttgagctacaatatataaaatgtgcaatcatttggagtcaaatcatggagtatcataaaaatagggcccacatgtcagcatcctgaaaaggatgtgggccaggggaactagcagctagcccaatccagcccaacttcggtatgacggttgtcctcctcatcctatgacagttacgagcgttaatactggtagaaaccgtcatcaaaaggacacatggcaagaggagaaggaagatgctctttggattctatggagaatattgcgggcatctccactctctcaagttacctccacactataaatacccctctcttctccctcattcacacaaaccaaagcatgagctgaattacaagaggctctagtgtattttattgtatattagaatagggagagtgtaagatagaaggaattggaggaatcccggagttgtcggtaatctcctcctatttttgtatcttgttaattactctgctttaatagaaatatcatcctgagtatttaagattttcttagtgagaattacttcttggttagttcctaattagcatacaggatcattgttcactatagtccatttatttataatgattgctttagtgtttgatcggcactagagtagttattaattgcgtagacgcggtgtctgggtaattaatctccagtggttgctgcgtatcgcacagtacatttgaggtgggtgtagaggtggtgacagccctcaagagcactcaaatcctccctgtccgggtacgtagtagagcgatatctaggaatagcgggttgccagtgcctgaagtattgcgttaggattaaagttaagctttccctagacaatatttctcattaggaaattctctctgtcctctgcccacattagctttgtttccttggatgaaccggaggaagagataatcacacacgttcctttggatttgatacccttggaatactccgtaggggaagtgctacatcggtatatccgtgcgcttgcggattctatctggatcgtaagaaatatcaacattgttgcaatatcaaagaatgattgcaacgattcatgtttgcgttgcaatacctatagactaattcgcaacgatttaggtttgcgttgcaatacctatagactcatttgcaacaaagtagtttcgcgttgctatatacatgaatcttataacaacgctctaaatttgttgcgacatggataactattgcaacgataacaaaaagcgtggcaatattgtcaccctaattacaacgcagatttattcgttgcgatacttcctacttattgcaacaaaaaaaattacaatcgcaacactacgcaattagtggcaatatgcccccctatcgtaactaaattagacttcggtagcaataacccctatgtattgcaacgaaaatcacgtcgttgcctaaaatttcgtggcattagcccgaaaaccttgtagtgactaggcaaactctaacgggagataagctagtaacacaaaaattaattctacccgcctgttagccttgcaccaaagcaacttgtatatgctaaaaattgaagcaattgcagaaagtgaacttgaggccagcacttaaaagcttgaaatgaatttgagagcaagagaggttgcgaaggggagtggaaaatgtgttcaaatggggtgaacttccctccgccggccattctcctcttatagaggtcccataggctataactgccatatggggtgtggggacctgttaacgaccaaatttggtaagatgtgaaccaggttcaacattaggatcgaggcgaattcgatgaagagatcgattcgaagaacagagtatgcatcggctgtgaaggtatcggctggagtgtacattggctgggatggatcggacagaggatagtcgatacagccgatggaggcaatgcaaccgattacgatgaagacagcttcgaggctgtttttagaatcgttcaaagtgcttcacaaggattgccacgatagagataaagctctcggtttgggcaattgtttcaattaattaggatattttatgtaatttccttagagatatgtttgggcaaaagtctatcgcaaagacttattgtatcttagagtttgttagagataagtgtcgtgtccggcaaggacatattttgtatctcgggtataaatagagcccgaacccatgtaagcaaacaacacacgttcaatacaatctcagcgcatcgccacccttttactttcgtttactttcgacgagttcttgctttcgggttgagctgcatcggtttcgatcttcaactagaggtaaagcttgttatggcggcttgcgttctcgggattagtgcttttatctttatgatactctaatattgtttatgtaattcgtcaagttatcatatatcctatataatctcttgcaatattgttatttaaccttcaattggctgacatctatcattggaaagcagccgattaggttaaatactaatgttgacttagactatataagatatccaccaccctatgaaacattcaatggcttgattgtctagatattgtccttcttttcatatttatagctgcatcagttgagtttgatcttataagtcgtcattagaatctcaatctctagcctgcttttggttgccgattagggcagtatcggagtttccgccgatcttacctgatttaactcttttatatctcatatgcttgattgagatattaaatccgccctttatgttaagatcttgttgcgtttaggtatattaagctttccgtttgatatattttgcttgctttaatatcttaatatagagtggtatcggagtactagccgatacatgctagatctatctgatcggctatgctatgaatgcttataatctccttgttaatatatatttcgatctaagtgatttatactatctcggcatggcgatgatctatcccaatcacttgatttaaacatatatcgacgaaagcattatataccattgatatctacagccgattgaatagattaagttctttcttgcctatttataactgccgatcgactcaaatatgacatcggctcaaagataaatgatacgtcatcgacgactggctgatcggctatcgtttatagatttaaccgctattttcctgtctttatttcttgttaattgcaggatcaaatcaactggcacgctcacaaacttaaaggcaagattttttggacctgcactggagttaagcagatctcccaggcctcgtgtttttcgcatcaacaagacccccagtttaatacaccggaaaccccatgtgtcttgcaataccactccctgaatcaataggtggtacacatgtagcacaattgaatatcacaagctgacattgtttacaggtatttctacattaataatactagggtagcccaaacaggtcccaaaatagaccaagcatggtcatatacattacaagataccaaaagaaatagatagggtagcggaagcgaagcagcggcgatccatcgtactccacaggcaacgactggtgaacctagggtctcaaatccattgtcttcgacatgcactcgacagcattgcataaatataatcgactccaattcctttctaaaagatttaaattaagcaagggtgagtacatacgtactcagcaaaccaccactacaaaatgcatctggtgctcacaggggaccaccactacaaaatgcatctggtgctcacaggggttcaaggatggcttggtttagttgcataaagctagttttcacaattcatttcataatcctatgacttagcagttttaactgaaaaacaatgttaatgttgaagttgtcattaatcgagggttcatccaccttcccacgcctcgcattccattttacaccaactctaccatattcccgcacatcgggcaaggttactcatgtcttctcttctctaaactaagcaatgttaaaatctactagtagcatacccgtgctaacgctacggtgacaactaatattgcaaatgaaacaaccaaatgacagcgacacaatatatgcttcatgaatggtacatagaacagatagttaggctaaaaaagcgatagagttattagaaaaaaaattaatcaacatatctatccacaataccatctaggaacaagccatcccttgcaatgctataaagtacaggtattactcctctcaaatacacaatataataaatatctaaaattagcttgacttaagccatccatttcgcttgatgtggtcctgattatctggacaaggttacaaaacaaccaaaacgtatattgtcactctagttatttgtatttacacaaaaaagaatattggtcatttcataacttgaagataaactactgtgataagcaaggtggactcgcttggatgactaacaaatgaacctctgaactaaaattgacgctcatttaatacatctgtaatcaaagtcagttgatcgatgttttcatctatgtgtagaaataaacaacggcaaacaaccgatatagctaaattttgcccaaaaaattacatgtcttgtcatatcactaacaagtatatgcatatgactaaagtttctgcatatcattagaaatatatagctgcattcaacattttgaaaaatatatattgtaatttatgaaccaatgaatcactaggggtaaaattaaaatgttatatattttatacattttacatttttaaaatgtggttaatgatcaaactatcatgactctccaatatctcaaatcaaagctgtagctatatatatacaaaacacattgtggtttgaggcacttttctgttgcactggaaaataaaatagataccaatcaaatcgagaatactgaaaaaaataagaattaactatttatagtctatagtaaaa

SEQ ID NO: 9285 - DNA, 22310 bp, Oryza sativa
  unsure (1)..(22310): unsure at all n locations
gaagtaatctcaatcgagccgaagtttcgcccgattgagatatggtcgcacggccatggtatatcggcataaaactaaagcccgtcacggatgacacttatctgtgacgggacatagttgaggcccgattgagatgagggttccatatctcaatcggaccctaaaagaagcccgtcacagatgtcatctgtgacgggcaccaactagaggcccgattgagataagtttaatgctcgtcacagatgacactcttatttgacgggcttttattaaggcccggtagagattacttgtatgcccatcacggttgattgttttagggctgttacagatatttgttgcacaatataaataccccccaccacctagtgtaattgtatcccactgttcactattttggtgggaggctgtagagggcgattttttgtcttttttacgaggaaaacagaaattaaattcccaaaagtgatcaaaatggatcaatcaagtgagcaatattaatcattaattgagcaatttcatcacgtcttacttttgcaatactgatcttataatatgtgtctctaatttgttttttattttgtagcaattgatcgaagttggatgtttgcgaaaaatttgaaacgtcattctacggagtacagaaagggcgtaataaattttatgaacgccgcggaggaggatcggaaaagaagaaacaatgattacatgtgttgtccatgtgcagattgcaagaataagaatatgtttgataacggagaggacgtacacggttatctgatacaacgaggattcatgaagggctatacatattgggagaagcatggagagcaagaatcaggaagtggagaagcagcagacagaagtggtgcgcataattaggaagatgaagatgagcatgacatatttataccttctctattgggcggtgaaatggttgatgtggatcacgatctgctgcaaatgttacatgacgttgaggacccagccaagaatgagagagatggaatgaagttcagcaggttggtcagtgattccgagacgcctctgtacgctggatgcaaagcaaaacacactaagttgttggatagacaagagtttcacagatcttttaggaattttgaaggctatgcttcctgctgagaacacatttcccaagacgacatacgaagcaaagcaggttctgtgtccactggggttagaggtccgtagaattcacgcttatccaaacgactgcatattgtaccacaagcaatatgcggacttggatgcttgtcctgtctgcaaggcttctcgatacaagcgaaagaaaagtgctgacgaaggaaataagtcaaagaggggtggtccggcaaaggttgtgtggtatctacctatcattgatcatttcaagagaatctttgccaacccgaacgaagcgaagttagtacgttggcacgccacagagagaaggaatgacggtatgcttagacacccaggggattcgattgaatggaggaatatcgatcgaaaacacaaagactttgctgttgaccctagaaatatgaggatatgtctgtgtacggatggcatgaatcctttcggtgacatgagtagtactcacagcacttggccagttcttattgcgaactataacctcccgccatggttatgctttaaatggaaatatattatgttgtgcttgttaatccaaggtccgaggcaacccgacaatgatatcgatgtattggacgaggataagtaagtatgttaaattggacgatctaaaacttcttggaatgaagtctcacgattgccacgtgctaatcacacaaatcatgctagttgctatcagatgcattctaccaccgaaagtgcgtcacacgatccaacgtctgtgcgccttcttcaatgcgattggacagaaggttatagatccagaagatctagatgggttgcagaccgatattgtgaataccctctgtctttctttgataaaatggttcatctccctgttcatctggtgaagcaaacaaaactatgtgtcccggcttttctaagggaaatgtggccgtttgaaaggtacatgggagatctaaagtcgtacgttcgtaacagagctaaacccgaggggagcatcattgaaggttacacgaccgaggaggctattgtgttatgtgtcaattgcatgtccgatgccaatcctatcggagttcctgcgtctcgtcacgagggaaggttgtcaggtgttggcacaatcggaaggaaaagaattaggcccgatcaagcgtcctacgcgcaggctcattacgctgtgctccaacatatggcagaagtagacggatagtcaaacgttagacacagaaacctaggaattgagtctttttggaacagagggagtagatgcaagggcacaaaactcggtaagggtgaaaaaaggcattatattagttagcactaacctccaggctttccaatattgacaagattaacaaagaagcatgaatatggtctggtctttaatttgtcatattcctttttcatataagattttttttatgactcgaggaagtaaataataatacaattatttcttgaacatgcataatttatcatgaaactaatttcgcactgtagtttatcttatcaaaagaagtaacacatagcatgagagacgcactgctaattgtgcctcctgcaaggaagaaagttagtagagctaatcgtttgatagtagtgttagttccaaaggctactgcaagaaagagagaagcagattactcttatcttttagagaattttcttactatgtatgtaattctatactaagtaattctgcaatatttttcatgcacaaatcctccttcacttcagtttctcatatactcaatcctcaaacaaggagggcagagatacctgcctcaatcacaagagctgaaagctttcaaaaatttgatgaagctacattgaaacttcagtctgaagacctgaaacaccaaaaacaattgatagtttgactccgaattgatttgtgaaactattctaaactcaattgcgtaaattactaaattggattgaatacaggattggttatagggcattgagtaaaacttctgaaacatttgcaaaatcaaaattgtaatcttaaaacctaaacagatgcataaaccaatcagtaaagaacgcaaggcaagcttaattaacctttgcccgtgctgtcgcagtagttgttgcacgcacattagtattgatccagtccaaaccagttctccatgtactcatctaggcttgcatgctctgtggcaaccggagagaaattccacttgttagaactcttaacccacaaaatagagagctaaagactaaaaccacagtttcatctataagaacactcaatcctcgatggagagctaataactgaaaatgcagttaggattgatgtgtttcaccttcactttcctgcacatgcaggatgacacctcagaaaaagaacaaaatgctgatccatcgtgcttgcccattgcagggagtcggcgtcgtcgcacgcgaaggaggggtgtcggaatctacggcgcccggcggctgctgtgatgcagttggagcggcgactactgttgggttaggcggcggccagcgttgcgtgtgagaggatgccgggcgtcggtggcgccgcgcgcgaatgcggggtgtccgaaccgacggcgggcagatatccggcatcggcggcggagatcacggcatagattctgtgtgagattggtggctcgacatcggcagcgaccgcaggcctggactggtttgccgcaaagatcgtttttgagccgttttctcgcccgcgccgcctgtgtcagctgccacaacgccagcccagaccgtcgaagaaccaccgccaccgccgtcgtagtcttcaccagctgtcgcacctgattgtatcaaacacatttagccacaccacacacatgacgttcgtttcggcaggcgggcggagccggtcagcggctgccgcggaggagatcgtcgctggctcggcgatcttcggcttcagaaattcctgcacgaataataagaaaatctttcacaatggaagtcatcataaatcttgggcaggaaaacaagactgaatccccaaggcaacgcaatacacgtgaatccccaaggcaacgcaatacaggagaacaagacagaatccccaaggcagaaacaacacatggatttttttcattcagaggtaaactaacaatcattcagagttggcgatcggtgcggtggtagctcgtcgttgcgttgtagctcccaaatcctgcggtggcggtgtcgagaagcagcggggtgaggagacgaagcgacgcggggcaatgggctgatgggtaggaggagcacgcgaacggcggcagccacggcgactgtggcgatctggaggattagtcgtcggcggcggctggtggtaggaggaggcaggtgggcagcacgcgtggctagtgggcgaagtagtaggcgtcggcaacggtggcgtccacggcggttgcgggtgggtgacggcggcgtcgacggctggggtggatgggcagaggaggcaagcgggcagcgcgcgtggtgagtgggcggaggagtaagagtcggcggcggggaggaggaggagtaagactctgcccggcgggggatctggagcggaggcggcggtggttgtgggtgggtggcggcgtcggcgaggaagaatcgttcgtgggggtggattggcggaggagtcggcggcagttgcgggtgggcggcggtggcgagtggcgattggagtggagaaaccgtctggcagtctactgcgatggcccgtttgatatgacgatccgatggttgatattacacgtatctgtccgatgtctctgctaggaatcaagaccaccattacaaattttctaagtagtagagatgagtttagttaagagtagtataagtcttggcgctcattaaatgtgagtacggctattcgaatagattggtttactcacattgtaatagatgtacgcttttaatttaatggagatctttagtacacaacctaaacacacgcaaataaataacaaattctattatacaaactgggctaggccttccctagaggaaaaccagactttatctgagaatgctatttcttttaaataaacttctaggaattatacttcgcaaatagagtttttagtaaatactttactggtagctattatttgcaatatagttgccaaaagacttaaccctttacagggactcatagaaaataatcaaaacaatatttcttttgtaaaatagtatttgttttaatgactatcccaccgagggtgtccatccataatagtaatatataattttatttacagagcaaatataccagaggggctctattatatagagaagggtttttaggaagataactagtattagggcctgttcactttgataaaaaaaaaccttattaaaatttggcattgccaaaattttggcaactatgccaaaattttggcaacttatcaaaatttttgcagaatttcttatatagttaccaaaatttaacagcaaactaaatatagccacttttttagcaactttaccaaaatttggtaaggttgaaaatggcatcaaagtgaacaggcccttaatatatttcataatcatggttctttaattaaataatatttgaaatcaaaatacacgcatattcttagaagttcctcatttagcccatacataaccggaaaacgaaaaataaaatcaaataaattctagcatgcaagggagggcctcatcggttgccctatagcttataaaccaaagccaaaatttgaattttaaaacttgattttgaatttgattttaatattttttcaacattgtttttttttcaactttggcttttcaatcactaagaacatacatacaaaagttttactcgcatattatttttttaatcgctaataaaccgttatggcttataataagaagtgggcaaccgatggggaccggagttcaaaagatttttggttattccgaatttttaattccatattttagagtcaaaatttttagggtgttacatggggcccacaagttgtttgaaagtggcacagctgaccgttgctttgccggttcagccgaaccccttgtgggctgtaacatacccaaaatttaaaatttaaaattttgcacctaaagaattagaatgactttttcctatctaggaatcctagaatttttgcatcagacatctaaatgagcccatcatagctagaactcaaataacaatttaggacaatttaaaacttttccattctaatttaatttgacacgtaatatatttcatgtttgcattagcacaaagtgtggtgtgtgatttgagtccttttaagtgtttttggaatttaattgcattgcataataggtatcatggcattaattaaaaactggaggcaactaattttgtagaatgacttaataactttattccctaaaggtcattcaacttaaatattccagcctaatcagtggcaaactctaatatattaaattggacacacttccctggacattgtcatgagcataaagttttataaacacaataactccttaccctgaagagaactaataatttgtatagttaagtgatcaccacacacgtaatccaacttctagaattcataggaaatttatattagctttaaatattatgaactcggttttgttagattaataaaatatttttcttcatttgtatagacagcaagtaacacatcatgtacagataaacatctaaaactatatatataggaaactactaacatagaacgcattataatttgtagaatgcataagaaattcattttagctccaaaaatgatgaatccaattatgttgaacttagtatatcatgacctttcctgttaaaaaaatgaaattgtacagaacatggttagaaactacctttaaattcgaataaagcctaaatgacataattgtagcctaggacttgtaaaattcctatctcccaaaataaatgagataaaatagaaattcttttacctaaattcatataaggacagaaccttcccactgcgcacaaaacattcattttagagaattttgtatttttcgcataatttggtatttatttgcatgtcgtgttatttgtctagataatttgcattcacgttaaaggagtgacttaggaattgtccaagttgcacaagatcaaggcaagtttttcctcccccttcgtttgatcacattgaaacccatgttttgggagatgaaatgtgttgtttgcaaagttgcatttatattttattaaaccaatatttgaaaacttgggatatggtagttatccctaacttgctgcataaactcccttgaattattgtacacctctccatttgtatacttaggaatggttagagtacaacacttgtgttcatttggggctacaaatgcttaatatgctactatgtgcttagccatgcttagaattatgcaaataatatttatggtcactttataaatgaaattttgggtattattttgctgctgtacagatatgaaaattatgattatttctgaactaaaaatgaagttaaacttattttaggcttgggcgacaagtggtgtgcatatggtggtagttgcacaccaatagggggagtgttcgcccgggtcgattaaggaacgaacttcgtgtcaccctctaatgtttaccgtgcatcgatatgagttattatggggtaaccttggcctattaagttaagtatgtctctaaccttgtactcgggaggctgttctagtaaagatggcggtcacggtttgtggagctatctttaggaactacctatgtgtgtgtgtttgtttgtaggatgactagttccctatgtatgtgttctatgggggacagatgttccacctcacagcatgggcgtctaagtccgtccaatacaatgatagcatgcctcgtgggggaacggatgtgttcgccgccacagcattaggttaaggcgtgggccctccacctaacggctctaggacttaagcctagggtggattcacacttatcgtgctcatgcaaggttaggtacttcttaatgtaaaagctcgttgtgtcctctagaccacactcaatgtgtagagagtggtggtaccgacgggtaccggacaaactagagcgattcatatcatgtgggtaaagctatacaaactctgcagagtctaaacctaatcgattagcaatgctcatggtcatgagcgacatagtgagtggtatgggtatagttttatgatttatgttttcaaattgtgattgtgaaatataggttggaaaatggtaactagtgtagaattgtattgattatggtacatagatgaataatgtgagacttgatgccggtttaggtatcaagaatgattataatatgatatatgataaatattatgatatatctatgttcgtgttttgtcaattgaattgtcaactctctttacaaatgattgtgaactaaaatttgtctttatgctaaaatttgagctaaagaaagccttcctttgaattatggccttacatgtagtatgttaggcttgttttgtagttgtcagtacattaatttgattaatgtactgactcttgccaattgtttatgatcttgttttgcaggtagtaggtttaaattatgtttagtgattcgggtttcgactacttcttctaggacttgattcattaggggtctaccactagtcggctgcttatgggaacgggtatacaagcttccgcagatcaatatatattaggccggttggcctgctatgatgatattaagtgcaagttccatattggtcaggattttgtgtagaccttgccgttatttttggtcattaggattgcaagaatgtcttttgcatttgtgttcttggctaagctattgtgctatagaccatactacagaaatttttttcatcccatattgctattaaaggatcagaaacataggcattgaatctttaaatcaatataacgcctgccaattgcttgcataatcattaatttgattgctagctgtgagcataaacttttatagaacatgcttgatttaatttttatttttgacaccagacctgatttaattttcattttaaaatgaaactcctgtacaattagagtattaaatgtagactaaaacaaaaatcaattacacagttcgctaggaaattgcgagacgaatcttttaagcttaattgtgccataatttgacaatgtggtgctgcagtaaacattcgctaatgagggattaattatgcttaataaatttgtctcacagtttcttggtggaatatgtaatttgttttgttattagactatgtttagtactttaaatatgtgtttgtatatccgacgatgtgacatgcagaggcaaaaaattttgctacctaaacaagccctaagcctgcctatgttctgatccgtatataaaagttgactttattgtgggatagagagagtaacaggacggtatctacttgtagggatgctaatataggctgtgtttgctgctcagggttcctaaccattctttgtcgttttccgcgcatactttttgaactgcggtgtattttttgtaaaaattttctatacaaaagttgtttaaaaaaatcaaattaatctattttcgaaaaaaattaactaatacttaattaatcacgtgttaatggaccgctctattttttttacggagagaaagagttcctatacaagatctccgaacgcagctatagtactgtttagctgaccattcgccataagtaaattgggcgatgctccggtgctctctgtattatactacaagtagaaaagatttgtaccgttcattattaaagataaattagtaatttattaatataataagggtaacttagccattttccatttttccacctcatggatcggcaggtcgatggcatcaagcccatgcaccttgacttgctagttggctgtgagcctgtggctagctcggcacatcgtccagatcgattccatccagaaattaaattggatcgcaagttatggcggcggcgagtggcaagtcctccgcccggcggcgcgtgttgatcctgccggcgatgacgcactccggtggcgtttgaatcttataaatatgaagatgaaaattaagtgtttcatataaaataaggtggtaataacatgtgattaattaagttataattattacaaactaaaaaaaatagattaattttatattttagagtaactttcatatagaaagttttcacacgaaacatttttttagcagtttaaaaagcgtgccacaaatattcaaaattttattctctcttcacagaggattcgagcggggcctccaccgtgcccctttcttctcgtccacccatccccggcaacccatctgtgccaattttgcacgcatgagcatctctccgatccgttccacgcggcagcggcgcatgggctactaggattagtgagtgtaaatgacaactatacccttccacaaataatttttcctgaacaataatacccctccacgattctactaccgttaagtgaggtggtagtagaaataaatttaaaccctttgatcaagcagtccattagcgcgtgatcaactaagtattagttttgtatcaaactgcgcacggaaaaaggattaatttgatttttaagcaactttgtatcgaaatttttttttaaaaaaggcaccgtttagcagtttgaaaaacgtgcgcgtgaaaaatgagggagaggggttggtaacagcatgaaacgaacgcatctgccctgttcagtcaactgatggatgaagattatatacataaaacgagaacactattaacatattgattaatttttaattattttatacataaaaaagaaataatttatctaatattttgttaaaaagttttcgcataaaatacaccgttcaaaaatatgctaaaaaaatcaaaataaaatacgtttctttggctgtgtttagatctaggaataaaaatttttgccgtgtcacatcagatatacggaaacacattggaagtattaaacgtagtctaataacaaaaaaaattacagaatccgcatataaactgcgagacgaatttattaagcctaattaatccgttattaacaaatgtttaatgtagcaccacattgtcaaatcatggagcaattaggctcaaaagattcgtctcgcaaatttggtcgtaatctgtgtaattagttattttttagtctacatttaatattacatgcaggtgttcaaatgttcaatgtgatagggtgtaatttttttgtgtggaactaaacaccccctttataagaaaagaaaagaacagggctagcactgctcaatgctagcagtacccacaatggtcagcaacaacgataacgaaaaatggatgagcaagagacattgagagaccccatgtatccttcggggtcgaacggacatgctacgaaacccctatcctcttgtcaaaggatcattgaagtctggcctgcggcctgcccgtacttgtgatccgcctgcacgacgacggcacagtgcaatggatacaggaaacagtgcacgcctcactgctacacgttcccctccctacgcacgctaaaaaaaatttctctcccacagtgcaagggtcttcatgcgtagctttggttttttcgtttcagcccctcgcattttctatttcagtcccttgctatctttctattaacaaagaaatccaaattttacactttgtatctcgaaagtcagataatacgtatagatttctccccaatcagataagcctgaagctgccgtttcttctcccctcacaacgtcccatccccatccccatcgccggcgcccctccctccccatcgtcggcgccctctctcccatccccatccctgtcgccagcgccccttccctccctgtcgtcggcgcgacgagccgcgatcttgaggttagtttcttgggttgctttgctgcagagactgatctcctgttttttctttcttcttggactgctctttcagatagaattttttagatcggttttctgttgaggaaggcaagttctttcgagggtgatttgttgtttgttctcgatgtcttttttattgattagtactaaagcatctattctagattggtcttgtgttcatgaatacgcttaaggtgttgaagccatcaatcagttcagtgtgtgctaacctgttccaggttctcatctgggttcatgatttgaattggtttagttttttttggtctttgcgattatgaaatttcagtagttagatgttgattttctaatagatgaacagtcgtgcagtgcagtatgtcaatcggtcaatgactaatgcagctgttcatgtcttgtgcttgattcaggagagcgcgggaggagaagaaacacgcgcgcagagagggcgatttggggatgaagcgcgccgggaggaaccgcgcggcgaagacacgcctcagcaatgcgtcgtgccctcgtttctccacgccgccccacctcgatagcattgaagaacgggtgaccaaatttggtcacatgcgctcacgatttgtgggccaacactaggacgtggcggcgatttttggctgctcaactacgtggaccgctcgggctgaatgccagcagggtgcactgtgaatggcctgccagccgcgcccctgcacgttatggccagctgcagtcagctcgtagtaatggcgagctgaagtcagctcgtagcaagggcatgtttgggagttttattccgaaaagcagcatgctggtaacgagtttatgagaatcttttctagctttggtcttctagttcatttttttattctatataactataagttcttagaatctgaataaaaaatgaactctttggaagagcttttgattctgcgagaagtcacagcagctataaactatccaaacaggctctaagacatacttcctctctctctctcttataatgtgttcttatttatagaaaaattaaactctactaaaaatccattaaacttcctagattctcatcctaccatatggcacttctataaacccttctaagccgtcacatgaccttttaataaattgatggacccatagttaagtagatttacatttgcaatgaacccgacattatagggcatatattagatatgttttttaagaaaagttcatgtgcctaggtacgtgcttacgtgaaaaccacgttcggtgcgtgtagctcaccctttctattcctttcgtattctatttcaatgctatattaggggctatttgggataggaggaacttattttagtccctctcgcaaaagtttcagtccctaagtcccttccatccaaacaccaccttattaacataaaaaatcattggtatttacaacaataaataaattttaaattactaaaactgaatctcctgtcctatacacctacgtatgaacgtatgtacgccctccttcctgttctgcggccagtgttccccttctattgtttcttgtttctgtattagttttttttcaatagtggaatataatatttcggcctttgctcaagaaaagctacaactaattattacaaagtagcactcgagataatagtatagttcaaataaaatagaacacatttaaataggaaaagccaaaataaggagaacacatttattctagcttatttgtgaatctctatccatagtttgcataaagttgcataaccattgtctccaacttgcgacatgcaactttcaaaaactctccatcttcatcacacctttgtaattgtgcccaaaaccggagccaatgagttgccctgaaaattacctgcatatagaaaatagatggtgatttatcaaaaaccatatcatttctactcaaccatagagcccaacaaatggccgaagctctgacaagtatcagtttactctttttcttgtcaacccccaaaagccacctatcaaaaatatgagatatactaattggaaggttaaaaccaaaagaaaactaaactgctctccatatgaattttgcataatgacaatccataaagagatgttgaatagactcattattcatacaaaagcaacacctcaagctgccgttccaattccgtctcgccaaattgtccttagttaacacaacccctttaagcaagtaccacataaagatcttaatcttaagtggcatcttaagcttccaaatacacttatttctctcaacatagccattattaattaaagctaggtacgttgatcttaccgagaacctaccgttcttatggtagttccatctaaaacaatcagaagaacgattcaactggatatgcacaatagaagcacacaactcatgccaatatacaagattttgaccaactaaagctcttctgaaagcaacattaagcggaacagaacccatgacagtggcaatagaagacgatctccttcggacaatagcatataaatatggatatttatccttcaaggccaagttgcctagctatttatcttcccaaaatctaatttgttccccatcattaacaatacaagaacccatatctaaaaaagtactcttgactttcatgagccctgacaaaaatgataatcaccttgtttctgtattagttagaggaacaaaatagaaaacccaaaaataatactgctaatttaaattattacaactaaatttatgactcgagagccaagttaattactcttaagtatattttaacataaattcaaacggttagtagagtattgaccattttgcaagagatgtgtgcattaattatatcaaggtccttttattgtggtttttttaatagaactatctcatgatgagttgcacttaatgatgttttactacagtagtatttggtgaaaacatattatattgatttttccatgtcatgtttggagaaggactaacagaaaccttaataaggcaccaagatttattaccacgtcgtaaatttatactataatgattaatattacgaagtatcattggattagggaaatttgaccaacaccgtgtaaaatcctgccggccaaaccatttaacactctagctctaaaatctacattaacatgaactctatatgttgattgagcgttcatatgcatactccacttacacttctatcctcacttcatataaaaatgattaaatataggtattatatttaaagcgtcaagactgatttataaacagacttttatccatgtacaaaaccactaattataacaacctatggcatatatgggcctcaactacaccatcctgtaggcttcagacaagctagggagttgaatcaagggtcaccggcctgtaaggtggtgttcttctctcgtgaagatgaacgtaaattttttttacgtaaaatgaggtggtattaacgtataattgattgagtgttaattattacaaacttgaaaaatagattaatatgatattttggagcaacttttatgtaaaaagttttcacacgaaacgtaccatttagcagtttgaaaagtgtgcaacaaaattcttaatcttcatccaactcttgttggagaaaagaacatgacataagtatgaaaattctaccacatcaatgtctaaatttcatattaatcaatgtcaccacatttaagtaaatttaacaataattacaataaaaattgtggatgaccaatttggaatcactatatatcatgagaaaaagctcacgagtcattaaggaaaatagaaattcaggaaaatagaggtatatctcaaaattcatagaataattagttcaatattatctgtagatctcagctatagttttattgctcaatgtatatacatgcaatcaaaggcgtcaaattctttacgtgtaagcaagctttgaaggaccaatgactgcatgatggggggactgctatatacattgatattttacagaaactttatgtatagataaaagatattagtcatcataaaagattctaacattaatggaaaaaaagcccatggtatcgtgtgggctacctttctaatttgacttaaataattacagtagtattaactattatacatattatatcatttgacttatatttaaaaatacatttatgtgtgatactaattttaattttatagttgttagattatatataatatgaaataaattacagaaaacctacactacggcatcccgtggagacgggatcccctcctcctacctcactcctctccccaaaatcatccgaatcctgtcctcctacctaactctcctctcccaaatcacacagcactgcagccctctctctccctctcccctttctctctctctctctaaagaaggccgagcggagacgaagccggccgggaggaaggggtcgtctccggcggccgaggaggacgacgacggcactgcgtcggcgaggtcggccaaccctcggcagggtcaccctcgagctcgcctcccctcgctgcgccgctctagctcgccgccctcgtcggtcgggtgtgtgccggggagttgtcgccccgaggagggcagaagcgggagctcccctcgtccttgccctcggcctcggcgtcaccgtcgtccctgctgcggcctgtcgcttttgcgccttcggtatggacgccggcagcccgcgtcgacctgcaacaggtatggccatcaaactcctcctcggctcctcctcgagacttctcgcgctctctggctcaggcctcgctcctcacctcgctgtgcctcctcgacgccatcctccgccgttgtggccctccctctcccacgtctcctcctccttttgacagtaccctccgatacctcacaagtatcatgcttgataccttggtaccaaggtctgatacctagatatcacccggtaccttaggcaccgggcatcaggtatcggtcgatacctagttggtaccaaaggtaccaggtaccaggtaccaaccggtacctaaggtaccaggtactaggggagcacatgtccctcacctcgccgtgcctcctcgacgccatcctccgccgttgcggcgctccctctcccacgtctccctcatcgttaccctctgataccccacaagtatcatgcttgataccttggtaccaaggtctgatacctaggtaccacccggtatcttgggcaccgggcatcagttatcggtcgatacctagttggtataggttccaaccgatacctaaggtaccaggtattatgtaccaggtactaggggagcacagaggaaagaaaaagagagagtcacttaaaatattccgttgcaacggtatccgccctcaataaattaatagtcacgtacttagaatttgggcgagcagtcagcaccaatcacgctgtttctgttgacttctactcctaccagatgctacagtacctcccgtgggcccccacactcctactgcttcccagtgggcccccaaccagtccaccatctgctctgttcctgtgcaagtctgtaaccaacgctactgaccaccatggacacttggacatatcacagcacaaaacattcctcgctccatcttccgctccagtctccattccccagctcgtagtagtagctgccttcctttacactataaattcccctaccttacacacagatgtgtccaagtgctcatcaacaccgcctgactcatccagtgtgaggccgtgagggtgagtgaaccctgtagcggcagtcatgaaggtaagccagcgagcgagctagctattctactccacaggacgcatgctgcgttgtcgtcgtcttgttctactaatagtttcttgttccgttttttcttcatgataatggattgatgctgtggatgtgcacgcgtgcgtacgtgcaggagagggtgaggcggcggcgcatcccggcgttcggggagtggaactacgacggcgacggcgaccttggcggtggcggcggctgctatggctacggctaccgcgacggcgactggccggtcacacagtacttcgactccgccatgcaggcccgcggcctggtcatctccctgccgccctcaccaaaaccacccaagaaggtataaacttgtctccgcatcatcgttcattggcaacacttgcaaagaaggtaaacgtaagtgttgttctgaggcggatatacatcatgtttttttttttataaaaaacaagatttggacaaaaatcgtgcttagtttcatttaatggctatcatggatctctgacagggtaaagaagtttttcaaaaagcacgatacatggcgtttgcatgttgcaacctgacagtttttcttacggtcaaactcacgcggtaaacagatgattggacggttgtcgctgttgatctctttttttaccaggcggtgaagtggattgacagcggcgcacttggggaggaggaggtggtggacgagaagcagaggcagaggcagcacaaggtggtggtggggctggcggtggcaggaggagagcacggggcggcgaggaagcaggggaagcagagcagagtggctgacggcggggcccatgcggcgatgggctacaaggggtgcaggccggcggtggtcaaggccgtggaccgggacctctacgagatcccacccgacatgctctgcaacaagccaagggtaacgcacctagtactccgtatctcttgatctctctctcgatggtggttagtagtactccgtaggggtcgcgttgcaccagcaccactccatttgcgagcctgcactgacatttgtgcttgtctcaaaccacaacctcgctgactcgtgtgataccattacatgaatcttttctactagtagtctatccatttcacagtgctgattttgttattcctaatttttttgggcctatttagttcgcgaaaaaaaaatttttatgtgtcacattggatgtttgatcggatgtcggaagggctttttgaacacgaataaaaaaaaataatttcataacttacatgggaaccgtgagacgaatcttttgaatctaattaatccgtcattggtacacgtgggttactgtagtacttatagctaattatggactaattaggctcaatagattcatctctcattttcctccttaactgtgtaattagtttttttatttatctatatttaatatttcatatctgtatttaaagatttgatgtgatgtttttgggaaaaaaaattagtactatcattatgctgaaaaaaaaatcatgttcagtaaaaaaagtttttttatggacaacccaacacggatgcttgtgcaattatacttaatgaagagtagttcactgatgcttgtgcttttcttcgtttcatgtggtttcagaagagggtgaccaggagcctgtggatggggtgcctgggactcagctgcgttgcctagggatctcaccagatagatcgatcgatcacacataccaaacctgccttgttttgcgtgtcgttgtaaagtgaagcagaaacccatggacggaccccatcgtgatcgatgcatgctgtcaccacggtcgcacggcccaaactttcccattcatctatctccctcacctgtctcagcagcactagtgtttggttggtgtctctctgtgcgttttaggagtagtagtaaaatgagatggacatggacatgatgtgtccggcagcgtcatttcctcgtgccaaagaccactcgagtgctgcctctctctctctctctctctccccttttgatctttttccgatgtgttttttttttgtagcctctgcttggttggtgtcccatgaaattacggaggcagctcggtgaaatgtggttatatgggttggtgccttggtggacactcgacactgatgagtagcagtggaaaaaggttgatgtaatggaacgctgtagtctcagctcaggggacttgtgccgcccgtggtgaaaagaaagaaaggaagaaagctttctgttgatccatgtcttgctagtactactacaaatatgtgtttatataggccgagtttagttttaaattttttcttcaaacttttaattttttcatcacatcaaaatttttctacacacataaacttataatttttcatcacatcattccaatttcagctaaacttttaattttggcgtgaactaaacgcaccgatattccggcactgtgctgatagcacctttttctgtcattgatgtgacagtgtgattgtgcgattattatcctgggtgttaggactacttcagtgataaaggctgtgtttagtttcacctcaaaattggaagtttgactaaaattggaagtttgaagaaaaaattaaaagtttatgtgtgtagaaaagttttgatgtgatagaaaagttagagtttgaagaaaaagttgagaactaaactcagccataatcatatcttccaagttatacttctgctttcggccgtgtatttgcaagggcttcttttccctactcacttttgatttgtaacgtgcacatttaattgctatactaagtagtattgtcaagctcaaaagcaattaataccaatgctgaatacttgaaaggaaaggggtgtggcctatcagagttttccgtttaaaaaactaattcctcgctataggtggactgggatgatcgctgatatggctataaagtcgcgtcccgtatcagatacggccacggatactgatacgtatcccacatattcacgattgtaaaaaaacaaaataaaatataactgacatcggcatactgcattggttcgggatggaaggaaaaacacatgtgcatgacgtgagatacgccaacgatacgcccatggtctgtctccgtcttcgctcgcatcagggatacgccgcctgacgcgctcccaacctgatggctgatgtcttttgcctgtacccggttgttggtgatatgggccccgcggtacacaagatagagggaaagaatccttcgatccggccacgtggccgcgcggcctgtccccccgcctcccccggggagaacgagcgctcgtgaagcggccaaggggcctcggggtgccctgtcgcacccctcgggcccttggagcatgctgccccgaggccctcactcggcttccacgtggtggctgagtgggcggagggagaggcgctgccaaacgtcttaaatgagcggtgccccaaccgtccctcgtcgcgtttaatgtgacgtgggcgggcgtgaggcgccgcccgattgacgtgcgtcaatcgggcttgattggtctgtgaccggtcataggcagatgggtggcagcgcacccacgtcctgccccctgtcaggcagagtgggggtaggtatgcctgtcccatcggcacgtagccgagcgtgtccctcgtacacgaatccagaaaagtctccatggaattaagagggaatgataaggatgtctcccgtgtcagccggaggacggcgttgggacccacctgggggcgaacgaccgccttgctttcggtcgaaggcaaggacgacggcttgacccaggacatgtgggccccatccaatgatggactatgtaagacggtgcatgtggtatccccttaaactataaaaggatgaccttgtccacttaaagaaaggacgccacttgagaagcttgagcctagggttagaactcccttgtaacagcacaagcctaataccacgcacaggagtagggtgatacgcttcctagcggctcgaacatatataatcccttgtctctcattctcttgcaaacgacctggtaagctagatccatagcggagatacgctcttgattatcgcgccttatctcccggccgaactcacaaagggcctcgcgacctcccgcttgagaggatcactcctcgacaccggcgttgccgccagacgctggtagtagccgcgcgtgttgctgccgtgcgcggggccacaatgtcccctccgcgagaaggcagagccgctactgagcagaggcgtacctccttcgccgccaacctcataggccaggaccattgccgcgtgagccatttcctctgacaccgggcatagcggtggccagtggcaggctggcagcatggaagcacggaacagctttttctttgttcgcttgactgcgtggccgggtaaatccatgctcttcgaacttttcatgcttgaatgtgggatcccatgctgtttgaatagggactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9286 - DNA, 12013 bp, Oryza sativa
  unsure (1)..(12013): unsure at all n locations
tctcaacgaaagcattttgattattctttttggattcttttgttttttgttcttgttgtgatcggctggctgccacatcttcttcatctgattgagctcaactgcttgagcatccatggccatggcggctgatggtgatcactgccgcctccccgacgactccctcttcctcggcttcgattgctccacgcagtaaccaatttactcccaaccaaatctaatcctaatcctgtgcttgctaatgctaattctagttctaatgctaatggtggtaggtcgctgaaagccacggtgctggacgccggcctcaccgccgtcgcccacgacgccgtccacttcgactccgacctgccgcactacgccacccatggcggcgtcctccgggacccatccggcggcgacccgggccgcgtcgtgtcgccgccgctcatgtgggccgaggcgctggacctgctgctcgccaggctcgcgcccagggtggactacgcccgcgtcgccgccgtctccggcggcgcgcagcagcacggcagcgtctactggaagcgcggcgcggcggcggtgctcgcgtccctcgacccggccaggggcctggcaccgcagctcgccgcggcgctcgccacgacggagtcgccggtgtggatggacagcagcacggcggcgcagtgccgggaggtggaggcggcggtcggcggcgcgctggagctggccaggatgaccgggtgccgcgcgcacgagcggtgcacaggcccgcagatcaggaagatgtaccaggcgaggcggcgcgtgtacgacgacaccgagaggatctcgctcgtgagctcgttcatggcgtcgctgctcgtcggcggctacgcctgcatcgacgagaccgacggcgcggggatgaacttgatggacatcaccacgcgcgagttgcgcagggacgcccttgaggtttgctgcttgcaacacacacattttcagactgagaaatgcaatctttttttttttgtttttggcaactgcttctgatgcatttcaatttacaagtttgtaggctactgctcctgatttagaagacaagattgggaagctagcaccggcgcatgctgttgcaggaactttatctccttatttcgttcagaggtagccattgatcaatctgttttcctccccttttacagtgtctgctaaactggtgtttgaaaaaggagttatgttatagtgaacaacatcatcaaactacaagattgaattattatatgtataaactaacttcagacacttttgcattggggtctgactcgacgaattactgatatgaatatgcttcatttttcatcagatttcagttttcaagcaactgtctagttgttcagtggtcaggggacaaccccaacagccttgcaggtatataagttctcccaattttcctactaatatcttacaacatatggcatgtctgtttggtcaaatcaaaagatgatctgattcaaagcatatgccagaaactttggtcaaaagaatattttcggatcactcctatgtgattatgcaggtttaactttgacgatcctggtgatctagcaatcagtcttgggacaagtgatacagtaatcatctatcaccttgtttttacaaaatctgctccatttgttttcaagggcaatggtaccaacaatgtctgggaacagatacattagaacctagttcttatctaccaataaggcaataacactaactgctgattgaaccttgttttacttgtacttacactgaatacaggattcacaaataaaaaacaactcacaacacaaagttgttctgtacatctatgaaccatcgggccctgtttggcaaatgagttatgggaggttggattgggaaacagaaataataaatgaggcgaaaagaaagaatggctaggattgaattttaccctttggtgtggtgggaaatcttttcccaaacccatttgccaaacaagcccttgttgcttattctgatgcctttatggtccttcaggtttttgggataactgatttacctgaaccatccctggatgggaacatcctccctaacccagtggaccccaagacatatatggttatgctttgctacaaaaatggctctctaacacgggaaggtaccatttggattctttttatctcactgtttaccattactaatgcctatatttttgtttttgaaactataaatgcttatatttttcaccagatgtccgcaatcgttatgctgacgggtcatgggatgtgttcaacaagcatttggagaatacagctcctttaaatggtacaccaatatagttattctttcctttctattttactaaaaggatgccagcccatatattctagaacaaacaggctagctgattggcactagaaatcacaaacagcataaggatattaaactctgttttataaagcttgtacattttggccaagatgataacccagtataattatgctttaaatcccatcaatgtttttttttgaactgtagatcatccaattgatgtttagccagttactatcacacagttgcctttcctcccattcatgatagttacttgcgttgaccacataaaggtagctttcctgaggattcttgaatccccctttttctttctttgtaccaggaagaaaattgggatattactacaatgagcctgagattctgccaccacttccaggttatttctgaccttacatttcatttcccttcaacgtgtagtttttatgtcattactcatgtgctatgcttataaatctgtagttgggtttcaccgttacgttgtcagctcctcagccagtggatctttagatgagatggtggagcatcagataaaccagtttgatcctccttcagaagtacggggacttccataactggtcgttaaacgatctaataaactttccttcaggctgttcactaacagttgtgatataggtccgtgcaataatagaagggcagttcctgtccatgaggggccatgctgaaaggtgtggtctgccagtgcctccaaagcggattatagcgaccggtggagcatcgtcgaaccagatcattctcaagacgatggcatccatttttggctgctcggtttacaccgtccaaagaccaggtatatataagacatgtgcatcacatatggattcgaattaatctgctgttatcatgttttccatctggttgtgagcataattgtgtcctttacatagcaatgctcaattgatacagactctgcctcactgggtgctgctcttagagcagcccatgggtggatttgannnnnnnnnnnnnnnnnaccagaaaggcaagtttgtgcctgtttcatgtctgcactcggacagactgaatagaacatcactaagcattaagctggctgctccatttggagactcggaggaggacattgaccttctgaacaactacacgttgttgatgaagaaaaggctggagattgaacagaagcttgtcgagaagtttggtcgacattcatgaagcatttgtgtatttgtgctagaacttaatgcggcggtcccaaagtctcaacagtggactgttctccagcagagtagttcggcatttctccgattattgtcgccttataaacaaaacaaatagaaaacaatgggctactgtaaacagagattgaatcaaaagtaaagtagttgtacaatatagataccaggttacagttgtcatgaaaattatgagttaggtcagcagtcacattttgtgaagtgtttttattcaatatccaatggatcgtcaaattcagaccaaattctgaatcagatgttgcctctcttactctttttggaaatgctgtccttgtacttccccattccagtggagaaccatacttagcactgtcctgaacaatatcacctttgtcgatatgtagtctgactatgggttgaaaacttgaaatccaatgagtatgtttcttgaccttttcttgtcttactgttgataaatcaccaagtcaaatggcatgcatgttctgctggtgaatggcatcctactcaacatgaacatggtgaggctacaccaaggatggccaccaaatttgcaaaatctactagtgagctactgctatttaacactgcatgcacttgtgccacttactgaattagtggattcttcttatagacaccacagtccagcatacgtggccactatgtatggttaatgatataaaggctctagcaagcttagatacctatggcaccaagttcttgcaacttgctagcaaacactttttttcttttaacatattgttgcctgtactattttctgctttttttttcctttgttatgatatgcctgtttatgaaagggtaccttagggcagagcacaatctgatctgaagtattatgaaaattccctatttttttcagaaaagaaggtaagaaatttgagtttctctaagacattagaattgccataaattgagtgattacatgcacattctttacagaaaagggacttctggttgtgggattccataatctggctacaaaatcatgtaagctatatgaaaatgaagcaatgaaagtgacaccaatagttntgagacatcctgtgattggcatatagatgaaaagattaaaaaaaatggggtatggcctggtaactttactctttaatgctttaaactttttcccttgaaatggcactgtaccataaagtgcttcttggtaaccaaaagcataactgagggttttgtttgttttgcatgaaagaattttatttttatttgtcatataatgaaaaataaaatctctcgctctctctctgccccaaggaaccattattatttttattgtgtgtaactttatttaaatatatgagagataacaacttttcatacgcttcttaagatttctttttaagtaatttgatgtctcattatgccagaattttggcacgtggattacaagattagtgacttggatgccacagtggcactaatcatgaacctattataaatttataataggctgagtcaacttccatggcactcgtacgctaatcattcccttgtatcatgcaaatatgcaatgcactcactgccacgtcactgttggggccccacaaacagaatctaactaccttttcaactgcacatgtacactacacttgcggccaaaaacttcttccatgaatgaattttcctcagctgaaaaaaggaaaaaaaaggggactcgttatcatcttagctttagttcagaaattttaatcccttgagaaaatgttatttaaagaattatgaaaatttagaaaaaaaatgataagatagatttttgatatgtcactcaacaaacatataagtttaaattcaatccacaagttgtaacaaagggaacataataaacttgtactagcatacatgtgctcacaatcgtatttttttaaaaaaaaatatagaattcaaatttaaacttatgtgtttgtgaagtgatatactgcatattaatccaacttgttagatattttttcataactatttgtaaaacataccaaaaaagagggagcatctccttgagagattaaaagagtttcccttcagttcatgctccacgctgtcacctcactcactcagcaaaaacaaaaggttggagaggaaaacaaagaaagaaatgaaaaggtctccatcgatgcaaagagaaaggaacatttcaaagctgaatgcactaattaatatatagtatatatatttgcatccatgtatacatatatttgatatatatatttttatattggtccatccactgagagcatcagattctgcttaaacaccaagcagtatatgtgaatggtacgtgacccaaacccaaaaaaacaaaaaggcagctacgactctacaaatactagccatatatatcccctagtgcaagagcgaacaacctttgcaacttgcctcttatgattctatctacataattagtattattacatgtaaatataattagtagtaattaatattttccccctaattaattagttggagctagctagctcatgaacaatctctcttcttgcttatgatcactagctactaatccggccggataattacacagtacgtttgcacgcattagctagattaaagatgattattacagctttggctcgccggaggagtccttcttgttggcggcgtccttggcggtccggccggcggcggggccggcctcggcgagcatctgcacgacgtcggccatggtggggcggaggccggggatgctgcaggtgcagcggacggcgacgcggagagcctgcaccatctcctccttgaaggggctccactcgagccgcttgtccagcgcctcgccctcgccgccggcggccaccttgccggagacccactgcacgatgtccctcgtgtcgccgaactccggctcgatcggcttcttccccgtcgccagctccattagcaccaccccgaagctgtacacgtcgcactttgtcgtcgcctttgacgagtaggcgtactctgtatgcatgcaccaatcagttcaactcaaaattttaaccaaaaagtttaaaccgataagaatacatatacatatgtatatccatcaatcagtttaaccgaaaagattaaactgatatgaaaagacaaacaactgatcagaggttaaactgataagaaaagattaacagctcaatctaaaagtttaagctgatgagaaaagacggacaattgatggatgtgttacctggagcgaggtagccgtaggtgccggcgatggtggtggtggaggcgtcgcgatcgccgcgggcctggaggaccttggcgatgccgaagtcggcgaccttgggctcgaagtcggcgtcgaggaggatgttggaggacttgatgtcgcggtggacgatggggaagaggaggtcgtggtggaggtaggcgaggccctgggcgacgccgagcgcgacgcggtggcgcgtcggccagtccaggaagccgaagccccacccgccgccgccgtggagcgcgtcccataggttgccgttgggcatgtactcgtacaccagcaggttgctgtcggcgccggagtagcagcagtagagcttcacgatgttcttgtgccggatgctgcccagcgtctccacctccgtccgcagctcgcggtcgaggcaccccccgccgccgccatggccgtgctcctgcttggaccgccgcgacacccacagcttcttcacggcgaccagctcgccgttgctcagctcgatcttgtacaccgtgccggagccgccgtggccgacgatgttcttgtcgatcagcgcctccacgatctcgtgctggtcgaagctcagcttgtggaagctcgtcacgtcgtacgacgagctcgacgccggcgacgtcgggagcccgtcgtgctccccgtcctgccgcgcccgcagcacccaccgcctcgccagcgccagcgtcgccaccacgcacaccagcgcgcacaccgccaccacccacacgctcccggcgagcccccgcatccgcagcctcgccggcttggggcacagcggcagcgccgggtcggtgaggttcagccggaacgccacgcacagccccgggttgccggcgacgctctccaggagcccctccctgatcagctgcagcggcaccggcccggacaggttgttgttggagaagtccagcgagttgggcagcagcgtgcacagcgcctccgggatctcgccggcgagcgcattgtacgacaggttcagcacgttcaggctgtggaggtcggcgagcgtcgccgggatggagccgttcagccggttgccctgcagcgacagctggttcagccggctcagccgccccaccgcctccgggatcgccccgccgatctggttgttgctcaggtcgatcttgaccagcgtcgccgcgccggcgatctccggcggcaggacccccgacatgcggttgttcgacgcgaacagcgacgtcaggttggtggcgccggcgatggtggccggcactggcccggtgaggtggttgtaggagaggtcgatgatggaggcgtgcgggagcgcgaagatgcccgcggggacgtcgccgtcgaggtggttgttgctgacgcggaagcggagcagcggccggcacgcggcgtacgacgccgggatggcgccggtgaggaggttgctgagcacgaggatgtactggagctggccgttggcgcaggcgtacggcggcagcgggccggtgagctggttctccgacacctccagcacgttgaagccggagtagcggccgaggtcggcggggagctcgccggtgagctggttgcggtagacggacaggatgcggagctgcgtggagttgccgagcacggccgggatggcgccggtgagcttgttggtgtacatctggagcacgcggaggcgaggcagcgcgcagatggactccgggatgccgccggtgaggttgttctcggagaggtcgatgtcggtgagctgcgtgaggttgccgagctcggcggggacgacgccctcaagcaggttgtagtagagctcgagcagctgcaggtttgggaggcgcgccagcgacagcgggatgtggccggtgaggaggttgccgctgagttccaggtcggtgagcgacgtcatgttcccgagccacgccgggacgccgccgtgcatgcacgtcgtcgacaggatgagcacgcggaggcgccgcagcgccatcagcgactccggcggccaccagatgtcgaacccggggttctcgttgaagttggccacctcgagcgtggtgacgttggcgatcgacgtcgggaacgcgccggagaagtagttgttggacacgtcgagcacccgcagcgccggcatccgcgacaggtccggcacggcgcccgacacgccggagcagctgaggttgagcacctccagcgacgtgcagttcaccagcccgccggggaacccgccgcggatgtcgttgtacccgagccggacctcccggagcgccgggagcgcctcgcacacgccgccggggagcctaccgctcagcctccacgacgtgacgtcgatggccgtcacgttgccggaggcgtcgcacccgacaccctggaacttgcagtagtccacggccggcgccgagaagtcccacctcgccatggccggcccggcgaactcctgcttcatctgggacaggtacgccgcctgagcatccaatgccgcctccgccaccaccgcgccgccatcgccggccacgaagaagacgacaacacaccacaagaagaacaacaagaagattggaggagaagagagattgatcaccatagcatgcacagatcagatggtggcttaatttgctccttctttttgcctcttcttgtgttgttgttcttgagatgtagtatatgtatatgatcaccaactccaagtgtagtgtagtgtagtgttattatgttagattgagaatatgtgtgtgtttgtgtgtgtgtgatgtggtagaatagaatggttcataatattgtgatgagaaatggagggagtatataagtggagggagaatctgtggtgatgatataaagagtggggccccacaccagagagatgcatggctttagcttaaagaccctttctttcttggctttattttgcattggggatatatgcccaaacacttacacaagctctgctagctgattatcactcactcatgcaatgatgcaatatgcagtgacaaccttctccagcctcttcttctcttcaggaccagtcaaaccaattgtgacatcttctggaactgtggatgggcctcacctggcccaaactagctgtaggcccggtatccacctaggcccggcatccgcataggcccggaccgaacccggtctctcactttcagttgtagccaagtcagaaagccatgcccattcagcactttctcatcagacaagccatttctcaatgatgaccacacacataattatgacataatgcagtaagcattgcattttctcctctttttgctgaaatggatggcattgttactgctaggctctagattcttcactaacactaacactactactgcaattgagttgctgcatatacaggggagctaagattgcacaaatctgattgatagacagttactgtagctaatcctgcaaactctatggggaacaaaggaactgcaagttggtgcctgtcccaatcattgccaacactttaggaggagatgaagcaaggagctgacaaatctgaggcccttttcttcctaaaaaacaattcagtagtaactaacaaacagtcagtgatcagtgatcacacacctgcatcagaaagtaggagtagtagtagcaactaagcagctactgcatatctgtgcttagtggcctgaatgatgatgtgtagctcattaacaatggtcgcatacgccaatctgcatctttttccgtttagtgtgtacttgctcataaattaatcatgggggtctccatctagttttattatattcacaaaagtagaggagtaaagcctgaaagcatgcatgttcgggagatatgtaagaaatcttttgagggggaattttacttcagagagatttgggaatttcattcaaagtcacatagtcaacattcttcttttgcaacatggaatgtgtaaaaatgtaaaagaagtaatttgatttatccactcttaacattagtgctacctagatcatttctagaagtttggcacatattctgcacagttattaaaaatctcacttgaacaacacaagcatatgtatgaaggcacacgtgtgctccactctgttcttttatcttccatctttccttggtaggaatataggtatttggatagcaccgaataaaatgagtaaatgacatttcccattatattgatgtgtacaaacatttgaaggaatttcacatatatttaaaaaattcaaaaatgagtttctccacttacttttttggtgaaaaatgaacaggaacaatcctttttgtgtggcagtgggtccatttggaggaatccatagtggataagcaggtatgttatgtgtgccatggtgtcatggtaaggtggatgaacacacatagatgctcactcaaaagggagcatttgtgattagataaaaaaactcaccattgtggggaggtggaaaaggagattttgacatgccaaaaaaatccccattttttcacatacacactcatgtgtttcttgcttcaattgattgctattgacattagttagttaggtccagaaccacatcaggccactaattctctgttaaacatagataagcaacacggttcgccacatatggaaaaaagttggctagtttgttaatcttgatgatgactgactgacctctaaacaaggttactattaatctattatatatgaatacaggagctaattgcatgcccaaattaatgcagtgtttttgtggatgctgacaaggcatgttgtacaagtgatgaagtggtgagaagaattgactgataggaacagtaattttcttattgacgagaacagtaaaattgctatccaataaagcatgaattataagttgtaatgtggaggactgtgtgtttgcaatcaattaaaaacaatacataatcttcaattgcacttgtatatatgggactcttgaatttgtatgcttcaggtttttggtggtgcttgtcaaagttgccagcaatctctggaagctgagtagatatacttagtggtgtgtgagtgtgcttattgtgtgacatgaagattattacagcacatggtgaaaacggcagagttaggtatacatggtaaaacccttttaattttaccctttttcaccgtggaaataatggtgttaattaatcaacaagttataaaatgttctagtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9287 - DNA, 9423 bp, Oryza sativa
  unsure (1)..(9423): unsure at all n locations
taggtgacactatagaatactcaagcttttgtctgaggaaaacgttgttgtagttcttgtagattttcccatgtcaccacagcagagtctggacctgaccatcggattagaacctgctccaccatcttagcacctttatgcacagatcgacgatctatcacctgctgaggaacaggagtaacagcatctgcatcatccaggattggcaatttggaatgaacttgatctgatggagctactgccttattgagttgtgagacatgaatcaccggatgaataagacaggaagggggtagatcaagacggtaggccactgatcccaccttagcaagcacctggaatggtccatagaaacgaaatgacaacttcctattggtgcaagtgaccacagactgctgcacaaaaggttggagtttcatatatacccagtcaccaacagcaaacgaacgctcggaatgcttggtatccgcctgatgcttcatgcgcatttgtgctcttagtaaatgctcacgaataagagtctgcatcttgtctctctcatgaagccaatctgataattccggtgcagaacatgcagcagaggccgtcaacccaaaataacgaggtttatgaccataaagaacttcaaatggagtagtacccagcgaagagtggaaagatgtattataccaatattccgcgagggctaaccaacggctccattgtgaaggactagcatgcacaaagcatctcaaaaaggttttgagacactgattcatcctttcagtttgcctatcggattgtggatggtaagaggaactcattctcaactgagtgcctgcaagtctgaacaaagtagtccacaggttactagtgaagatacggtcctgatcagagatgatagcctcaggcaatccatgtaatcgatgaatgtgttgcatatatgcctcagcaacctccaaagttgtaaatgggtgtgccaaagccacaaagtgtgcatacttcgagaatttatccaccactaccaagatgcaattaaaggtagaagaccgaggcaaaccttcaatgaagtctaaagagacaatttgccaagattgctctggaaccggtaatggctgcaacatcccaggatacttcacatgctctcctttggcctgttgacatatggtacaatgttgaatgaacttcactacatcagatcgagaccaatccaagcaaataactgtttaatcctttgataagtcatagtaatgccagaatgtcccccaatggcagctgtatgcaagtttgctaaaatctttcgctggacaataggattatttcctatccacattttatccttaaaatagagaagaccatttttcaaagtgaaatctgggattgcagaattattgatacataaggtttgaaccttactaagagagtcagagtcctgggcatagccttcaatcacttcttgagtccattctggaatacaaactgagagagctgacagcaccacagtttctttatcaggataccgagacaaggcatcagctgcactattttcagaacctttcttatagagaattttgtactgaagaccaagcagtttggtgagtgctttgtgttgccaaggtgtagtgagacgctgttcatctaagaaagccaagctgcggtggtcagtacgaattgaaaactcggcatgttgcaagtacggtctccaatgatcgattgctagcataattgccaaactttccttctcataagtggacaatcccaaatgtcgaggacccaacgccttactaaggaaagccacaggatgatttctttgcattaaaactgcacctattcccttatccgatgcatcagtttcaaccacaaaaggaatagagaaatctggcagtgcaaggaccggtgccgacacaagtgtgtgcttaagggtgaggaaagcttcattagtcattgaggtccaagcaaacaactgacctttacgcaaaagattagtaagaggcttactgatgatgccgaaattcttgacaaatttgcggtagtaccctgccaagcccagaaaactgcgcaactccttgaccgattgcggtgtaggccaatctctaactgctgcaattttgtcagtttctgtggccactccatttggaccaatgctatgccccaagtacgataacttttgttgggcaaatgagcatttactctgtttaaccttcaaaccatgtttgttcagaatctgaaaaactgcccgaagatgatggatatgatcttctagagttctgctgtagatcaatatgtcatcgacaaaaaccaacacacaacgtcgaagtaatgttgacaggatgctattcattattccctgaaatgttgctggtgcactggtcagtccgaacggtagcactctaaactcgaagtgcccatggtgagtacggaaggcagtcttatgctcatcctctactttcattctgatttgatgatatacagcgcgtaaatctaactttgtaaaccattgtgcacctgacagttcatccaacaactcatcaattattggcaaagggcatttgttcttcactgtgatggcgtttaggtgtctgtaatccacacaaaaatgccaagatccgtctttcttcttcactagtaagactggagaggcaaagggactagtgttgtgttgtatgatgccattttgcaacatttcagtgacctgagcttctatttcatcctttttgtgccggtgtgtaacgatatggtctcacattgatcggttgtgccccaggtagcaatggtatagagtgatcaaagggtcttgtgggaggtaacccttttggttcagcaaaaactgtagtaaactcctgcattagttcctgtacaggaactggaatggtctcaggctcaacatcatccgtgattgaacaaagttgaaccatatgtgccacagccttgcgttgttggaactgttgcatttcatttgccgaaagaattttgcaatgagccaattctgaatgcaccccttgcagtgtgacggtagttccctgcaagcttaaagtgatagttttcagagaccaatccactgacattggactgtgtttcattagccaatccattcccaagatcatgtcatagctggttataggtaaaacccttagagttgtctgaaatttatgaccctgcacttgccattcacagtttggaataattgctccacaacacaatgtctctccattcgccactcggactgacaaccttctagagagaggctgtattcctgtcaatccttcagctatctgtgaactaatgaagctgacagaactgccggaatccactaaaaccaataactccttaccctgtaattgccccaacattcgcatggttccatctggttcagtcccttgtactgcttgtaaggaaatggccataagttccctagtcaaagaaccattctgtccagcattctctgattcaacatgactgtcttcttctaagaacagacatagtaactcttgtaccacattcaattgcactgatgaagcacacttatgatttggagaccacttctcagcacagacataacacaacccttgagctcgccgataagatttcagagcagacactttttcagttaggcttgtcggactgcgaacagtatctgaactgcgtctctcatctgcacgattactgacaggcactccccctccttttcctggtggtaatggtaatggccaagccccttttccattaatcttcagagaagagcttccatctgatttcttaaactctctgacagtggtaggtggagaattttccatcacttcttcctgcaacaaggcaacagcaagggcagactcgaggtccttgggacgttgtaacaaaactgcatttctaatctccctccttaaccctttagtaaatctatgagtcaagtactttgagctaagagttgggtcataaactaacagttgattcatcaattcatcaaagcgttcataaaactcccaaactgtaccattctgttttatgctatccatttgcctaatcaaattctcatgttgatccctatcaaattttgcagaaacagcagcacaaaaatcttcccacattggaaatctcaaatgagctctagaagatctcaaccaagatgctgctcgtcctaggaagtaaatggttgctatcctcacccataaccccgggaaagtattgttaacatcaaaatagtgctcacacttcatcctccactcctgagagtctgaaccatcaaattttgggaagtctaacttaggcacccgatgattgtactgtctatcaccatgctcagaatcaaattccccagactcccaacctcccccatcaaatttagaagtaaaattcggggtgaaatcaatcgtacccttgcccggggctggaccctgagtcgaactgaccaccggtgtccttccccggaaattcatctgaacgtggtggcctgcagcccatttgcttcctccttcggctgcggcgagttgggtggaagtcggcggcgtcggaagccgcgccgccttcgcctccgatggagtcggcagcagcggcgccttcctttcctcacccgtcgatgggactcaaggggaagacgcagccggtgcagattgctgagatttgccgacgaggtcgagttactgacgaagttcgctgacttcctcgcgcaacccctgaattgctgattccacttgaggtctccatccactcactcccgcatcnnnnnnnnnnnnnnnnnnnnnnnnnnnnnnnngcttggtgttgagcgatgcgagggattcctggatgtcgccgaggattttgccgaagtccagattctgcttttccatcgcctccacttgcaattgcaacctagatgtatagcgtggcttctccaggatgattgctctgataccaaattgttacgtctctgaagaatttgtgccacaacaagggaagaaattgaggatttagggagagaattgagagtttggggaagaacagctaagaacaggtagaggcagcaatagaacagggagagatttgaattgatttccgaatatttgtttctacaatgtttgattcgttctcttccctgccggtctcttatagcgatgagctatggacctctctccctcactgtggcccagcccaattctactgggtccacacactcggttggtacaagctgttgggccgcttttcacgtgtcgatcgccgcaacaagggttgctttgaatcttgtctcctgccttgctcttcgccttcctgagatggtcctgaagtagtgcatgccgtgacaataatactttaaaaaatcaaataaaatctatttttaaaaatttcaataattaatatttagttaataatcatgtttctcgttttaggtacagttaatcggtaaaaataatctacaaaagaagtcggccttagaatgatttacatactggagtactagtagtaattctgctgttaggaggcccaaggtgtgtttagtttgagaaaagaaaatttttgagtgccacatcggatgtttgatcggatgtcggaagtggtttttggacacgaatgaaaaaactaatttcatatctcgcctggaaactgcgaggaatttattaagcctaaataatccgtcattagtacatatgggttattgtagcacttatgactaatcataaactaattagactcaaaagattcctctcgcgatttccatgtaaactgtgtaattaaattttttaatctatatttaatgctgcatgtatgtgtttaaagattcgatgcgacttttttagaaaaaaaaattgggaactactcaaggcccagtttgtttatctgtatggaggttattgatgcagggttgcagacgacttgtcttttatttatctctcaccaccaagcaaaaatcaaagatctgaaatactttttacagttttactccactgctagtgtggtgtgcaggatgaacaagcaagaagccaagaagaggataggagaggagaagaaggcaaagacatggaaaaagatggggagaatcggagcagaaaaaagccggggattgggggctgccatgtcgacccgccattgctccacttcctctgcctctgcgtctgggagtgggaccccactcgatcgatcacttcccgcctcctcgcctctctctctctctctctttctctgctctctctgcacttgcagagttgcagcagagaagcgcttcttcttcttcttcttcttcttcttcaattcttggaccattcttcccttctctcctcctttccccaacccaaacacaacccagccgcagcagcaacaaacgaaaccctagcctagccaggacggcatcatgtcgctgcccgacctcttcgagaagcttctcggcgacggtattgcgctgcattcatcatgtcttcttctcttcattctttattcttaatctaatctcttcctcctcctcctcgatccctttgcctgccattcacgcgcagatcaggacagctggcccgcggaggccaacttgctcctcgccgcccacgacggcaacctccgccgcatcaagggtacacttctcttcctcgccacccctgaacacctgtacttgtacatgcaagaaaacaaaacaaaaaaaaaaatctttttttaaaatctttttcgggcttcttgattccgctcatggaagtgatagaacgagacttgcttgcttgctgttgtgctcaatcagagatcgccgcgacgctggacgacgacggggaggggatcgcggccaccgtggcgcgcacggccttccacggcatgaacgcgctgcacgccgccagaagcctgcacgtctaccgctacttgctcgaggtggccaacatggacgtcaacaagccggacaccactccaggtgcatgtcaagattcatcctcctcttctgcttccttttgtcctcttcgccagctaggagtactagctagctatttcagctggatgtctcactgttattgtgaatctggttttcattgccttgccacgctaggtaggaagactcccctcgagcgagccattgccggtggggacctgccctctgtcaggtatctcattgatcatggtgctgatatccatcatgaacgtgaaggaaacatcacttttcttcattcagctgcaaagaaaggtataaacaggggaaaccaatcctcagatttagttcaacttcttctttttctttttttgtttttattacaaaagaacaatctgagttatgctgtactacccggcatactatgtgtcattcggaatactgcttcaacccaatcccgttcagtggaacagcattatgcccttggatttattaggggaatatcctatcttcttgtaggattccctgctacatccaatctgcattctgtcatgatgagcagccttacgttgaatgtggagaaaaatgcagacaatactgtaagggcctcattgtttgccctatggcttataagctaaagccaaaatctgaactttaaaacttgatttttaatttgattttgatgttttttttttcaacatagtttttttttcagctttgacttttaagtcgctaagaatatatatacaaaagtttttttcgcacaacattttttaattgctaataagccgttacggcttataataagttgtaagcaactgatggggaccttagcgtctagcaaatgtacaacaaagcaagcctaatgcagcatttcctgacgcattttgtttttacaggtgttgtttaagtgatatagaccttgctgatgtacacttttcatgttcatcagcctatacatattaattcatcataagaaaatgttaaaatatatcattcacatcatcatagattatctgcactttaccattcatcctagtataactgttggactgtttctacttcataaacctcatatttatttatcaacctgctgccagggtttctttttgtgtgtgtgtgttttgttctagccactgaaacatgttcctccaagagtgaactgctctttttgtgtgttatttaggactggtttgtctttttcttttattatcctccagttaagcagttaagtgttaaattgcctctttgctctggcttctcaaacttgtctgcccccaaattgtttctctcatacatcagtgaccttcaatttttttatgtgattgttcagggaggactgaaatagtaaaattgctgctttctagaggagctcatgttgatggcaaatcagatcatgggacacctctgcattttgctgctattaaaggatatgaaagtactgtgaagattttgttggagcaccaagcagatgtacgatgcttatacttttcttatgttggggcttactatttcctcccactgttccatccttactctcattttggttattgatgtgtgagcactgagctagcccaggtctggctgagccgtgatccacacattaacaactactccactgaataatcaataggaacaacggaagaaacacaaacaactttcttaaattatctctttctctaggaactgtcaaatgtatgataatacatttctttcttttccagcccaacaaggttatgccttcttctcaagcaacacctttatctgcggcgttattcactacttccttaccttgtgtgaagctattgatccaggtacaatattttctcctttggactgctgcaataggataaggctaaataactgatactatatatggctagagctgttataatcatcaagttatgtgaagaaaatgtataatcattttgtattatacataaacatttgtaggctggagctgatgtaaatgctacaaacaaccccctggcgagagctgcagggagtggattaactgaagctataaagttgttgttgaaggctggagcaaacccaaattgtcctgacacggtgagccttctgttttgcttatcacaccatcactatcagcagattgagtttgtagcttcaatgattttaggcctgtggcattgatatgcatcactagtatggaacaatgaaatgtattcctgaaaattcacatatgtggcacacgcttatttgtaaaagatactaggcaaaattggttatagagcatcgaaagttcacagtttttggttataggaaattcttttttctttcggaaacaagattatgcaaaagatttggagcatttgagcatcagttgaatagtgtgatttgatttgtgagacatgtgtacaccattctgtggtgtgtttcgcagaccactatcatctgcttctagagttgacacaagcctgctaaattccctgttttcattttcatttagctttttttgttggtcaggtgcatagagataattaatagtcggtgagcataatgctaattggtcttttctaatggcaacatgtttaaaaagtttaggacaacaagaactgatggtagcaattttgaaaaaattattgataaaacaagtactattccatatt

SEQ ID NO: 9288 - DNA, 2841 bp, Oryza sativa
attcctgcagcccgagctggctgctgtgtatggtacaagggaagatgttgagattctatttcctttgaccaacccaattgcaactgttgctgactggagcgttgatggggtaattacttatgccaatctggaacgcaagaagctagaggtatgttactatagcagttgcccatacttgctagcgtctggttgctctctttagctttcttcatgtgggcttgttttattgttcttgcaaaaagaagatgaaggaagtttgtttctatattaaatttgcttccctgaattgatacctggtgagggggattggtacatgcttttctagatactgatacacatcaggtttcccaggatcactggtaaaaatggtggattaccagcggggtctcaaaccctgttttgacacaaggaaccacaattgtttgtacccattgcaggcaacatgccaccttgttctcagcagcaggatagtttgtattagttttgacccaaagttaacaatagctcgtagcttgttcatcagacctaacaatagagaaacagggtttatcaataaacatccccttttacttgttacattgcattttgtcacattggacctctgaatctgtctgactcatgctgttataaattgaacaggatgatgattacgttaacacgaaaatgtctgacctgaaacaaaaagggaatgaagcatttgatgagcaggattatgaaaaagcatcagtgtggtacacacaggtacattcttctatctacttaaatagtgcatcgactattagaatgctactatgctgaaagactagtgccatgagctcatcacttcttttcattcaactcaatgcaaaattttctgtttccttgaattgtcaataagatgcagctttcttccatttcatggattcaaaaaatcagcagttataccttttttacaggataagcaatgattttttgatataaaatcatcatgagctttgtgcacaaagtatatgtactacgaaatagtgtctccttcgagtagttattttgatgattcagtatgagttgagcaacagcagttatgtgggatgatatatcttctaggaattctgtcatataattgctatgccatctacagttttaagttcttgttgatatgtgaatttcactatgggttcaactctatctgagataaatgagaaatgtaactttgtgacaattaaatttttggatgtggcagcaacactatatttgacagatactgtttggttcaccgcaggcactggaagttgatccttgtgatgccacaactcttctaaagaggtgtctttgctggcttcgcatgggtgagggaaaaaaggctgtgaaagatgcaaccacatgcgcaaaacatcacccgaagttgtcggaggcctaccatcggctaggagaagctctaatgcttgagaaggtgcagcataaaaaaaacttcaattcaccattccattctcattgctaactaactaccatctcatttggctgaccatatgcgcattttgtccttcattaggattatgagaaagcttgcgtggcgttgacccatggtatagagttggatcctgaaagtgatgagatggacaaactgttctggtaagagattctcaccactactcctggtatttgtgcattgtaagttgtgctttgatatcattgtgttggatgttctaatggagatttgctctcagggaggcgatggacctgaagaactgagtaatgccgagtgacccgaagcccttttttgttggtttagagacagtttaactagtagctcagctgcaattttgtgcatatgcagtactagtacttggcattaggcttgaattcatggtgggagtatggagaacggcgtcttcttcggaagaattagaactgaagcataggttaatggcaactttgacatcctgtttgagatatggattcttacaacattcagcccagactgtccagtaagcttgtggtgattttagcatgcgagacgcaggaatgatggcttttatttgctccagatggagaagaaatgttgttggaatgatgaactaaatgctaattcttccttgtgatagttgttgagtatgttcggatgattaatttgcttcacctgccgcgagttgcgtacttgcgtgtactcctatgtcaaccataggcattggactgttggtgttcctagccagcctcaaattctttcagtaaaaatgtttttggaaacaaaacctctgaaaatgagaaaatgagcatgcttgtcgtgagcattgaaaaggtagacaggaatgccagtatgagcagctactatttggaagaaaattattcgcgaacgtgcaaaagaattacacggaaagaaaactagaaaaaaaaaaggagaggaagaaatataaaaaatgtctggagataggatgggctgggccgtattccggcccatccgtgcggccttgcacttccttcatctctctctctctccccctctctctcttcttccgccgccgccgccgccgctgctctctcgcttcgtttgtctccaccggcgccgacgccagctgcgtgctgaagtaagcggatggacctcactcgccggcgccgccggaggcaacctgccccgggcgctcccctgccatcaggtaaccctgttcctcagttcttggttttttccctgcttgtctaggctagccgctggcacagataaacgcgagctctctgaacagccattggtgacagcatgatttgggacctgttcactttgatgtcattttcaaccttaccaaattttgataaagttgccaaaaaatggctatatttagtttgctgtcaaattttggtaactatataaga

SEQ ID NO: 9289 - DNA, 19492 bp, Oryza sativa
gcttgcctgccgtttcacttgcactgcattcggctatatcgccagattttcgtggtactgaaatatgattttattcatcacttgctctgctagtgttaatcactaattcttacctgttattgagagatgttataagttaacattgactaatccttgatgcaatttggtcatcaaatctgataatttcagtgttggtttctgtgcaggtcattgttaattcaatatcacttcttacaccagcagacgctgtgaagcttctcaagttcttcatattgcttatgcaatcgaggtaggataattcgttagacgcacttttgcaattcagtacaaagaagatgggcttaggatatacaattcgggttattatgtaattcatcagtagacatgaaaaaaaggagagcttcaattcttttttctgcatctatgtttgactggattttcatgggctactcaaacaatgattatatttacatactgccaagattatttggttatattttgacgtagaggtcttatgttttccattttttcccctttgtcaggggtgcagtgctggtttccttgctcccatggctgcaaagtttgctcagtcaacacatgagtagcatagtttctcaggagtcttctctgcttctgctcaactcactctatcatgtgagtatttattaactaattctgattgcataggtagcaattagctacatttatgtgaaggatattgttcagtaattgagcttcttctcaactcactctatcatgtgagttgtttaaaatatgtttttcctttatatcctttggagcaacaaatatttttttgaaaaaccagcacatcatttcctggtgattgatttagaactttactgccccacgtgaagtgaagttgagagctttctttacctataccagatggtggcctcctgaatgatactagcctctggatatctaagcaccgtattctcaagtaacctgtttagcgccaattattatcttgaatgtatcagtatgcacgctatagctcagacatgaagagacagattgcaggtcatttttgttttgaatgttagtgttaccgactgcatattctttctgactcgtgggattatttccatatatatatgcaacatacctctgagagtttacatacctatagcattagcagcaaagtatggcctgtactgcataaagagttgtctccgtatgcaccacttacaacctcctttagtgatgtgcatcaggatgtctgcatctaggctatacagccccttggaatttgtggatgtcaaaattactgtgaatatgtcagcttttagtgcactagtggagacataataacaattataagtcatgtgctcatgtttatttttggattttactattactgattgcatttctctcagctaattgatgcaagaacatcgaccttcaaatcatcgctgcagttgtctacctgtctagattatcttttcagtgaggtaagttttacttttaccccaccagcaagtgccatcattttgagcattgcaaatccataactgaaagtatgtatctcccagattgacgatgatggatccggagaggaagaaggatccccgccgataatttatgaggacaaggatactgatgatgaagagtctgaagttgatgatatggaaaccagtggggagggtgaagatctggggggtgttactgatgcttctgagcattcagatggaagtgaggtcatgagcgactgatgaatcgatacctgatgagctcttgatcttcgtgatgagagttggagttgtgagttaacctcatgatgggcagaagaagtcgataggatagtttctgaacacttttcacattgattttttctgatgagttgcgagttgccttcaattctttgtgagcatgttgttggaattaatgggtaactcagtcttgcctgcacttgtgaaacacatatactctttaccatgaaaatacccttttagatacatacatctagttttgacagtaaaagaaggcaagcatgaaaacttacagcaaaagattcatcatttggtggaccactgaaatagcttgaattaagatgcatatatatgtacttaccggcaattttgagttatgagatctgaaagagcggctgacaacaaacattgagacgggtggcgttttgcaggcagggttaggcaaacatgcggtattatattctcctccatcataacaatttacaacacaagtcgcagatacaacacgggttacaaatatgacacgctcctttattcattcatcattacgtgatggagtacaagtttataggtacggttacacacacaagtagtagtctctgcagtagaggtaatgaaaacacgtacatgcagcattcgaacaagtaaaaaaaaacagatgtgcatgtccgttttccagaatatatatgcaggattagttaagaacatatataggtagaaatatattttgcaccaattaattaagcagattaagatgggtacgtagtagacattagcaagcaagcaccaaacctgtagattagatagatagatagatagatatctggagcggtatcatcagctgatgatgatgtgtatagatgaagtattgagctgatgcaagaggaggccttggattcgatgggtgaggaaatgaagtagtaaaatgatcagcaggtagcttcgcacttggtcgagcagtcgaaggagcagccgccgccgccaccgccggcggcgtagccattgccggagcggctgaaggagacgaagcacttcttcgggcaggtcagcttcttgccgttgcatggccccttgtcggagcaaaccatcgacggcgcctccgccccaccattcccgaacccgccgacgtcgccggcggcggcgctgccgtacccagctgcccacgctgcaggatcgccgttgtacgggttgttggtgccggggacgaagaagcctgccgggatgccgaagtcgtaggccggcggggcctggccggccgggtcggcggtgaggtcgcgcgcggcggcggcggaggcgattatgccggcggtgaagaggacggagacgacgacgatgagcagccttggagccatggtggccattgttggtacgtggtaagagagatggatggagggagggagggaggtggtgcaatggaagctaaattggcttggagaggagaggagtctaattttagataatagaagctctattaagactgggttacgttcgtccacagatgattgtgagagaaaattcaccttgttttttcacgtgcacgttttctaaactattaaaagatgtgttgtttgtaaaaaatttagggtcacatcttttttgtcttagtataagttatatgccaataccaaaagttgattttgaggtttatttttcgtagtttctttttttagcttgaagtaaaaaaaacacatatataaaagttttaacccaaattttttttcacaatagccaaacatttggcgtattatccgtaattggccaaccgatgacaaccttatatagaaaagttgcttttaaaaatcatactaatctatttttaagttaaaaataattaatactcaattaatcatgcgttagtggttcacattgttttatgcattttctcttttctccttctctcaaacactccctcagtcagttacaccaagatgatgtaatcgcgcgctctgagcccatccctgacgaggagtatatggtcatgtttggagaagctttaagattctgagaaacaactagttggtcgccagattatgagaatctagaaaagctgagaaactcggcttttgattgttagtttaatttttgaattctacaactacaacttcttagaatctgaacggaaagctaaattatttgaggaaccttctgaatttgaaaagctgcagctatcaaaaactttcggaacaggctctcaaaactagaaagctgggaacctaggactttgagaggaagaagaggcagtggtagcaaaggccccagcatgagcatgcatccatgatactccatacgtaactttctcttgtcatggccggccggcagatggctgtctcgcaccaccaccacatttgcaatagcaacagctagcgacacttgctaacaataataagctaaagctaccagtaagctcaacatcatttcatgtccatctaatactaccttcattaaaattttaatgtatgacgccgttgattttttatccaacgtttgatcattcgtcttattcaaaaaatttatgtaattatcatttattttattgtgacttgattcagttctttaagcatgacataaatatttttatatttgtacaaaacatttgaataagatgaatggtcaaacattagataaaaagtcaatggcgtcatacattagtggagggagtatatgttggtgtaaacggtttgaactagcgacatggattgatcgatggatgcgtcggccgatcgaattgattcgatcgcgaggtcaggtgcatgctggaaaggaagctggatgattttgttcgtagtagtaaagtagtagaacgtagtttctgctctttcacacgtacaggaagagaagtattaaagtagtttctttggcaaagtaaagtggttgcgatccctgcttgaattttattgcagacgtaaaccaacttttcatgctctttctaactgtatactcctctgtttaattgtgttttgatttgatcccctccaaatgagaaaagagaacctcagacagatgcatatataagtactgcagccagtgcattgcatgcactagatgaaatagaggagctcagagctggcctgcatcttggatggatgggattgaacaaccatacagatatccattcaggttcagttgacgaaagaattaatagtagaggattgttgccggccgacaggggaatcccggtctctctttccatccatcgatccctattcctgcatatcaacaaatgcgatgcatgcctgggcttttatgccctaccacgcattttatttttacaagacgacttctacacaaattgctactggtagatgtttgcttcagcggttcaccagtaagctctgcatctcaaaattttctatcaatcaatcgtcaaacatgtattattttttaataatgaaaatagattgtatctccgccttcaatcataagacacatccaaaattttgttaaagataaaaataaatcaaaataagaaataaggtgatgaaacaaatccccaactcccatttattattgactagcgttaaatcacatagatttttttagctataattctagcaccacagaaccagatcgatcaatattgaaaaggcccattcttggtccttcaaacccccatcttggtccaagccctgtcacaagtttggcccattcttgttgcactggaagggaaggcccatgttggttgtatccgtgcagcccatataaaatgggcctgaactgtaagtcggtaatgcgacgtgcgggcgaaatgtttgggccggtacgggtttctaacctacaagaggcctgtttttgttgggccgaaatggtaatgcgacatacgtgaagcccattttgattgtgctaggaattttttaaaagaacccctttggttaatggtagcacatatagcggtcccgtatttcctttgcatatatgccgtgtttggtgttggatcctccgtcttccccacaaggaaagggaatcgccgtccttctcgccgatggccacggccactacccaccagtcgtcatcatctttatctggagctagcaagagcaaacgatgatgacgattggtgggtagccgtcgtcactccactgcgctctcgctgtccgccgcccgcctaccggatcgatcagtgcggccaacggccggagaggagactcactggttgacgtcgacggcgatccgacccgatcgataacaagggcaaaacctgttaggaaacgttaggcaaataaacgataaacaatgatagatcaatcacaaaagacacgaacatcagtcaacaaaaatatctttattatattgggataagattacagcaccgaaggtgaaatcttaaaaggataacgataccctacgcttcgctccggccaagcctccaataatgggcttccgcttcgctctgacagaagctggtctttatatatgtgcaaatgaatttggaatacaactcaacaaaaccgtcaaaccataatagttaggcctaggatgatctatctttgatcgatcgatatattcgcgcgcaagaatcgatccaagccaaggtgactcaccactccactccactccactagtatcgatcgatatgccgatgcgcgccgccacctcctcgccgcggtgcgcgtccttctcctgcaaccgcggaggcgcccacgcccacctgggccaaagctgcggccgcccgctgggccgagctgccgggtgcctcgccgccgccttcttcgcgtcgctggagcgctgctcctgcgtcgagttccccacggacgacgacgacgaccaccctcccaggagccgggacgtcgtcgtcgtcagcgaggcggcgccgctgctgccccgcgccaccacggcggcgccgaagaagagcacgtcgactacgacggccgggaagggcaagatcagcaggggtggctttcgctgttgtgacaacaccaccactgctaattaatcaatagtcttcaattcttcttcttgcagtatgcatgttgcaaatgaataaaccaattgttagttagtttctcgctgatgaattgtactatgtcataagttcattttggatgaatcatcctacatatatactcctatatgtgtatcacactccaatggtcttcggttcaattgctctccagcttaatttaatctggttgaaatgtaggaatatttagcgtgcagttacgtactgatcccccatcttcaattcttgattgcacggatgaacttacgtggttttcatgagattttctacggtgcttgggatttatctgggagcatgtttactgtccagcaagttgtaccgcctggtactggtaccggtcggtgccaaaactcatccgaccgttcaattcgggatggataggattgggagagaaaattagcagtggtgcgctcaatttcagcaccgacggcgtgtgagcaggggcggcggagttgaggatactttccctgcgctgagggcccgaggaggagtagtccttcctggcggcgacggatggagaaggaggattctttctcggtgccgagaggatgagtacgtacttcctagcggcgaggggcggacgaggcggagttcttcgcggcgccgcacggacgaggtcgacgcactccaggcagcggcggtggcattggtgggaaccctatcacactatccgcttgactcccatccatctattgcacgtgaaattatatttttgcctttccaccttagttcttaggtcggtactgtaccaaggacagaattggtatctcacggtaccaaactctaccagctgttggatcgggtctaggaattcagtaccggccgttggacggtaaaaaaaactctttatctggactgttgatagaaggtacctgaggtacctttcaagcaccgtaaaagacctcggttttcatacatatcacttaatcctaactaaatgatgatgaatctgttccttgtgtttgttctttcttctctctttctttttagactggttttcttttctctctttttctgcacggcctgattcgcaccatccatcagcataaagctagctaggattagaagccgttgcttctacagagtaggcctagtttacagcagcccagcagctggatggcccaagcccacatgcccaaatgtccatcacaattcacatttccagtgcctctccatcaacatctcattaactaagctttctttttctcaagatcctgcttacctattagggagatccactgattatctgaacctgcgggggtgtactctcaactctgattaacacctttaacccatcacttgcccatttcctaatggccccaggcagcatgacaactgcatgtgccctgccttttctgttttaactgcttggtttagctttgaaaacaaccaatggtatactgtctacatgcatcatctcctgatctcagactcacataggagtgtttacttcaacaagaaaaaagaacattattgtgagaccttttgtagtgagagtctatgcctacctgtcacatgttgtgcaatatgtgactcttaattctagttcctaatccaaaggcagtaggaaattaactatatacaccatatttatacatttactacaaaagatgcatgcctgcctactcttttactactagatttagtcatttaatcgaaaagtaacatatttcaagtgacactgaataaagttgacaagccacaataattactactaaaaactaattatataagataaaggtgtatgcagagaactgttgctagcatatagccggacacctggcccaatctcctcagtgcatcctccctgtcaaaccaaacaagaaactaagattccaatttctgaatttccaaaagcctccctagatgcggtcttttctccaaacctggaggcaaaccatgtgcctgcacttgcaaatatatgcagtagtcgctagatctcatcgtgcgtgcatgcatcttcagagacttcaggtacagacaccaaaattcaggctttgatggataggaactacacatgcatggaggccatctgtccatccatggcacttaactaacataactccctgcttttatttcactatattatgtgattatactcgtactgttagctaactaaactatacttttatctccaatgactcttcttgattagtaccctagctcacagtactcttctcagactgtctccttttccctttcactaagcaataggtatgttgatctttctgtcgagctagctagctagagcttaccattgtctggttgatcttccataccttctctgtgttgtctcgtgctacccacttgctgtaacagaaaggtcgtgcctcaacatcgcctgctttattagtctagctaaaggaggcagctttagtacttattagatcttatgcataataatgcatatacatttaaacataattaatgatgcatcattgtttttttttttgaacttgtgaatgttgcctttgagatttgcactagagtatgacttacaaattggagttaatcccatctttctgaaagctttgctatgcatcatgcgaccatgcagcttgcatgcatgatctctacctaatcaaattacttgcacatagcactgacagtcactaaatattgatgcatgggtggacactgtgctgatcattaaaggaaagatgcaattaccttttttagaggaacagtggaagattacttacttgctatgatatgcaatactactagaatattccacatagatggaagcatatatagatatatgttgtctacaagttttattctttgagatgatgatgggtgactagtgtaacattagctttgatgctatatattccagtggctgagcatatactccatcgaccagatatctgtattccttcatgaaagagctaaggtagcatggccaaccagaatgtttatatatatgccccccttttgagttaattacatgtagctttcgatgacctatcatcgaacagtcatgatcagtaagaatgcactagctttgctgcataaaaatcaagggcaggtttgctggtgtcccaaaagtagtggtgtgggtgcgctccatggtttcaatgtcataatgtaatggcttttaatttctactatcaggctacatatattaatttaatttcacgattacattgtgtccatgtaataatataatatagaattctgttagttatactagtactgtttaactgtcgcttgctttcagatatatagatcgatggtgcaatccagcaagaaattcaacaacatcttatcaaataattcaggtcagactgactaaggatgggtttaaacaaacttttcgattgctagtcatagaataatcatttatcagtatataagacagctgagcatgcaaatcaatagatcttgctggccctaggcagcaaaaaaaaatcgaatataagatttgctatccaatatcttgtgggcgtgcaaaaaacaattagaagaacctgctagctagctatatacctctccctttccttagtgattaaggttttagagcttctcaatgagagtaactaggtcgggctttaactagtttttcttcccttctcgatcctctgtaaaattaaaggtgtttttattattattctgtgataaacaattgggcattggagattattggttttgttatttggaatttattcacgaagtggttttggagatgatcggatttacaggtgatcgcaggatctatcattttatgtggactagtcagaccgtcagaccggtgtgtattgcgcggtcagacaggcgcaacccgcggtctgaccggccgacactgtatcggtttcggtttcggattgtttatttggatatccgagtttatttcatgattatgacttctagatggatactatacgtatgtaatactattgtttgctgctaatgagtcaagttagagatagcttggtctcagaatatggtttctttgtttgttccatgtgtaggtgactcgatgtctcaggagagtatttgcagtgatggacggggagtcggcttggggataagacgacgtccgtggtggtcagagatcatgcgggatacttaggctagagttgatgcacgtggttgatggagattccatatggtatacgatggagttattgtgtgcgtatgggatgcggagtcgaatttggaaggagtccaaatttgatacgattggttatgtaaagtttctttcttgtactaaagggtttcctaaggtgtttaggactcctagtatgagtttggttcgtggctttaggctgcctacctcatgtataaatagagggggagcgtgaggcttcccggtatcgctttagagagcaatagaattgagttttgagttagggtttcgagtttagtcgaaatttttgtaaggagtgatgttgatacactttgtaaagacagagagaatcaataaagtcgttatccactttaagagttctttgatttgtgtttaccgggtttcggcgatctaaccggcgatctaccggctgtcagaccggcggcaagcggcggtcagaccggcgggagcacggcagtcggaccggcagcggcgacaggcgtagcaggcgacttcggcggtcagaccggagattctacaccggtcagaccggcggcatccactcggtcagaccggcagatcaatttcagtcagaccgactttcgtcgatttcgagggtaacttttatttccactaaaagttttcggtttttgggtataccaaccattcacccccctctggttggcttagttcttgtgattcgatcctatatcttcttctctggagagtgaagactaccaacctagctaagctacctacctttcattttcacagatgataatctaggattctcccttgtccatgtaagaatatgcccaaagcatcataaggtgtacacagaacacagccaccctagatacatgtgaatagttcttgagcttttgtagttcacaagattctattgctaagtatgatgctacacggatgtgtactatctatgtgcggttacacggccgtcaggttaaagttggtaaacatcgcagtatctgtaatttaatttgtagacaattgaactagctagtcatgcaacctttttactttgcagttaaagttttgcactttcatagggtgaaaggtgaaacaactctgaactggtgtagctttcatctgcaaattgtaccaaatactgcaggtaagggtaaaaccagggtagaaactagaaagaatatatggttttgacatgcgcaatcttctattatatactaaaaatccattaaacttcctacaaacgctctcaagccgccatgtggcatcctacaaacgctcataagccaccatgtggcgctctaataaattatggaaactataagaaaaaaacaaaaatatctgaccgtcgattttcatttaaaacagtggacccagtgattttaaccatcagatcaaaataaaatctctcctcacccttctctcctgggcccacacgtgcactttcccgacttctgtacgtacgcatcctcccctcattttctcgtttttttcttttttctaattaaggtagttattacgagatacacaccataacgtattattgtaaatggttatatcccttcttgcatggagcaacaagctggctgtgcaacctgcaagcagtaattttttttatggacgatatatacttttatgatatacgcttgaatggttgtattttttatttaaattaatcaacaagctaagtcctatattcactatatttactatgtttttatatagaaatagacatgtgatgggtatctaatgggtaaaaaaaatttagccgtttgagatataagtatgggatatgagttcctctgttacatgcatggttggtggcggatcgttacatagtataaatgattgtatataaacaatagatagctaaatgattatatttttttaatatattcatttttagtttgatccatttaggcctttcttgatatctgataaatatattgttaggcataaacctatatcctttccgtgacaactaaacagcaacgaaacgttgtataaaaattgacaacctatatcatatcatcatctgttagatgtccattacaacatctctatgtctacacatttcacatataataaattaaaaaaaacataaaaattttgagaaaaaaaaaagcatatgaccatgagttttatttaaatcgatggacccttccctctccgaaaagctcagtgctctcctctcctcttccccttcctattatctagctaaagtctattaaacttcctacaaacgcttctaagttgccacatgacactctaacaaattagagaaatcgaagaaattacaagaaaaaagcaaaacatctaaccctcgattttcacttaatacggtggacccaatattctacattattagaaaaatcccaaaacccatctccaccgccccctcctcttgggccacctcttctcgcggtacgtacatccctccctccctctttccttccttcctttttttaatcttctagctaacaaattaataaaaatcataaaaattctaattttataaaagttgatgaacccattaattttaaccatacgatcttcatttgaaaagaaaatctggtacctgcaccctcaccgccacatccatacgtgcgtgcgcacataaccctcctaactctcccctccttttctatttcttaagctaacttctattttttagctaagactcaatctatcaaaaattaataattggatttctaaatgatcgtaaatctcaagttaatttttttctcattttttgaattattgtgctatatataattaaatacataattcgagatccatatacatagctcaaacttctaatataaatgtttaagagcaaatttttaaacaacatattaaacaaatattaaatttagatcctataaacgctcctaaatcgccacgcggcaatcataccaatgctcctaaatgacatgtgactgctcctaaatgacatgcgaccctctaataaattataaaaaatcacaggaattatatttaaaataatctaaccattgattttttttaatatttacaatcattagatctaatattaatcttaacctacttaaaaacttcaagatgattctatcctccattgcttgatgatgccatccatgagtcagccgcatgtactccgcatatatgtttcgttcacgagggagagagcgcgtgattttgactcaaattgaaaaaaaaaagaaccaaatcattcgactcagctcactgaaagaaaaaagcaaatggaaaaaacatcttacttctaatttaaaattaatttgccatacctgtttttaacaagccaatacatatgcccgcgtattgcgcgggctaccttcctagttggattaattaaaagcagtaacttgtaactttgcaatggatcaaaaaccacggcaatgaaaaggaaaacagaatatatatatattcgctgattattaccactttctacaaaatttggcaaatcgtcaatgcgagtggacatagtatacttgcaaagttatatgcgacgacaatccacctgtctgtctatgatatgaaatgaagctttttccaaagcttcaacagaggggactggaaggaagagcaaacaaagttggctgccacgtcagaaaaccactagtgggccccacaaacccactgggttgaatcgaatcgacggctataaaatgggcccttccttcacttgttccctcccttttccctctccttccactcgaccccctctctttggttgctaattaccattctgcccctctcacctccactgccatggccggcctccccttcccctccgactccgacaccgccctcgaggccttcctcgccgacattggcttcggcgcaccatgtccggaagctgctccggcgccgtctccgtcgcatccggacacgacggcggcggcggctactgatgagccggtgatggccggtgacgaccaggccgacgaggagcggcggcggcggctccggcggaggatctcgaaccgcgagtcggcgcgccggtcgcgcgcgcggaagcagcggcacctcgacgagctccgggccaaggcctccgcgctccgcgccaccagccgcgacctcgtcgcgcgcctccgcggcgccagggcgcgcgccgcgctcgtggcgctcaccaacgcgcaactccgcgacgaggccggcaagctcgcgcttcgcctcgccgccgcccgccgcgtcatagctctccggcagctctactccgccgccgccgccggcggtggcttcgagatgcaggcgctcgcctcgttgatcgcgtaggcgatcgatcccacgtggacgcatgcatgcacgtgccgacttttttgacttggtcaaacctgggccggttaaacgaattctccaactcgaatgaatggatgaactgatgaactcgaatggctgtagataaaagtagcaatcattttgctgagataaaaaataatcacagtgagatgaaattggcaaggacgagcaaagctaacgatgaacgaacgctctattactatcgctcgaccatcagttgctcatttttctcgatcttggaggacgaattgtcccgaattcaatatatcatgccgatgaaatttgatatgtcatgacatgaacttgagtgcaccaattgatcgatctatccgggctaaatttctccgagatcaatcaaatcagccattttacttttcgttccgtgctgtcaaatcctgtgggggtatttggtacttgtcactctcgagcaagcagagatggaattgagtttggtgatcactaaagttgatgtttgaattgcacatattcttgtcggttaattaatattattttttccttcatatcgcatgggcgaaagtgatatatgagatgcatatacacaaatgaaccatttgatcaaagatccatcggattctctgcatccatcagaaacggacttctcactcacaatcatagagtttacagtataatcgatagcagaagatcataagctagcggtcagttgagctgagctaatcacccgtggttgatcaaagcttaattagctggtcagatgctatacaattaatgtcgttttcattgctgaacagaacattagttacagtgagccaatggcggctggcttttatacatgtactccctccatttcaaaatatttgacaccgttgacttttttagtacgtgtttgaccattcgtattatttaaaaaatttaagtaattatttattcttttcatatcatttgattcattgttaaatatacttttatgtacacatatatttcatgtacacatatagttttacatattttaaaaaatttttaataagacgaacgatcaaatatgtgctaaaaagtcaacggtgtcaaacattttaaaacagagggaagtattagaacaagattttttttttcagtaatttgatcgagctggtggcgagtcaccatcgccacgtcgaaagcacaaacgcgatcgatcgatcgattcgagctagcaatgtgttttacgtctcgtttgctaatggcgcttgtgttgctctcgccacttttaattacttcgtgccctgactttaatttgtttatttgattccatggagaaatcctgggagcctaagcctactagctaattaacatgtctaattgctttctcttcttttcgtttgttcgttgagttgttacttctggattctggtagtatgtgtctacagatgcaagctggtagatacattaatctgaaacaatcactgtgctttgctgtagctggatgtgtttgcatccaacagatgtttggacagctttggatggagccttcaggaaaaagagaggatcacaccatggcgattcgttgttgatcctctttcagtgtcctactgtgctgccttttgtgatggatacacctgaagtggacaaatttatcttaaataacttggcaaaatttgcaggaggcatcattgtcctcttcaacttgtatgactgaatggactaagttaccccgctgaactatatccaactggtattccttcgcttctcgaataatcgacaccggtattatttaagttaaaactttgactacctgtggacaactgaccggttacagatcaagggatggccaaataattatttcttatagttatgtttccggaatcttaaaacctatcgttcaaatgcctgctcgaagcaaatttggtttggagttctcacatggttgtgccaaggacacttcatcctgaaatagaataagagtagaaacctcttgaattggtggacataagaaacaagtgacccagaagtaataaaacaaaaaaaaaagacttagatctctcttattgctcatcgcttggaaaatctagaaggaatggaagaatctttagataaaaggagacgacagcaccagatgctcaatcgtatctaaaaggagttaggttggtgtggtatggccggcgctaaacacattgggagaatgttgtcatgaggagctaggagagctacgagcaaggttgttttgtacgtaggcatgtataattttttctcttcttcttatattatagaagtgtgtactaagaccaaaatgctatattccattatcttaaaaaaaagaccaaaatgctactattccattatcttaaaaaaagacgtgtgtaatgtgttgcattataaatatataataatacaactttcatttatggtaatataaccatctgaaagtaattagtgataggcggccatcgttaacagtgtcagttagttacagagggtttctcaaaaaaagaaagttcgctcagagggagtacaatttatacagggcccattagcctgtgagctatgggctgcagattttacagtagcagaggctttgcattttggtccattaacccgttcgataaaggccaatttgatcagcctctctataccaacacaagagaggcccagcagctttctcaaaagttctctgtttttttagaaacaaataaaaggaaaaggaaaaagaaagatgttggtacagagaggctgatgactagttggttgccatactacagtactatagttggagacttgaagtagtgaaaatgttacttctactcagtattgtaagattacacttgcatactgaattactgagcctgatgactgacagaagatctcgtgcacgccgcatgatgtttttatgtgcaaatactactagaattactgaatttgaaagttcaggtttgctgggtttcaaaaaaccaaacacaaaacacaatgcgcgtgaaatgtgcgttgaaagagaacaaggacaagggaggcaagatggcatcagtcccaaggcagggtgacaatctggcagtggcaggaaagaaaagcagcagctgtggttacaatcacaagcttactgtctacagtgtttctgcttgttttcatttttttgatgagactttttgttggctggttggttggttggtttgtgcaggcaagcaagcaaagctgtctgtttggtttctttctcaccttcctttcgtcgcttctttttctttcttgaacactcttttctttcattcagtgacgagaaagaaagaagtgaagtgatggcgaggaggctagtgatcgaagagataaaaaagatactcctggtcgtttttttgcattgaaccatctcgtcatcggctaatagagagcaagatgtagcagcaaatgcatttgtttcatccattcattgtttgggtgaaatatacaacagcaatatatacagttgttgcacaggattggaatgtcaggccagagaaattcaaatattttgaatctgcaaacgccaacatttatcaaaaacgcgtattgacactgttgtaaattaaccatgcacctaacttcgtctccacttttacactcgttggcaactgaaccggtgttgctgtggccattttcttgagctaatgaacaactctgtgctgcacagcagaaaggtacccaatggaaggacatgcaaggactcatttgcactggtactacactccactgctcttcttgatgcatttgcttgcatgattttcattgcatcaatgaattatgcatgaatggcctgacgatgaactgacgctgatcatgcatgcatggtcctgctgagtgatcagtgggagagagagagggaggggaaaaggttggcgctgcagtgcaagatgcaagctgccatggagcccatctcttgcaggcctttttgctaagctgccccctctcagctcagccctacagccaaaagatgacgagtactacgactacaactactacagctgctgctgatgttggttgtaaggctagtaatgaatatcttaccaaagtgactgaatattgactggagtattactagctctgaattttgatttgacatggttttgaatatcatgggacacgaacaaatgaaacaagacacaaacctgcactgctagtgctaagcatggtggtacaattataattaactacgagtacagaactgctggatgcatccatatacttatgtctggatgcaacaaggggagctgcgtgggcgtggcctaacaaacaattcggcaggctctgctgcatctgcaaattctgcgtgccactacggcaaatatgatacgctggctttggtttttcagtgaatcagctcactctctcacatcttctcctcacttcggctcaacatgtgttttcatttcatttaggagtactacaactatggagctttctgcttgtctcttcccatgtcttcttgtactccacctgatgatagctcaaccacgcctgaatccacaa

SEQ ID NO: 9290 - DNA, 7994 bp, Oryza sativa
ccaccgtaagccctgatctctgctgcttcgccatttcaagaattcaattctgactctgttttctccatacaggtgagaaggacgacgagtcgccgtcgacttcagggaagagctcgccgccgccgccaccggagcagaatccgctcgacgccgccgccgctccatgcttcaccttctacgaggccggcaagaattgcaaagcggagacaggagacgaagaagagtacgagacgacgaggtccaagctggaggagcagatgatcatctcctcctgggagaggatctccggcgacatctcgaggatccccgcgctggtggagctcgacctcaccggctcactgcagcaatggaggcggctcagggaggaggaagcatcgcaggtaggggcaagcatagaggccatgatcttcgaggagatgagagtggaggctgtgcgtgacatgatgcttgttgcctgaatctttgacacctcctgaatgtaaataaattccaattgggcacaacatcttgttgatgattccaactgtaaaacgaaaagaaaaaaaacaactggatagggttctttgatgtgtaacacaaatgagtttttcttttctgttcttcagacaaaagtagtttctttttttttctagtgcaatttttttcagtggtaggaattacaggtctcctttgtgtgtaaaagtgttattgtatcaggttgtagacctatgttgtttgcctctgataaagtgaagaagctaaatgacaaatcaaatgtacaatacgtgcactaatatggaatcctctcaagattcatagagcattattaattcagggtacttattaatatgtgcacttgtgtgtttggtctctgctgctgctactagtagttaatctctttcatgtggatactggcatgttaaacaaatggcaattggatttgaggtctggagtaaccaattggatgttgggtatcatgtgcatatatagtatatactccactctcctgcatgtttcctttcttatgacagctacacttcttcagatgctcgaggaatacttgagctctgattagatctgatcatgaaatctcagagctagtgacaacatcatacaatcttaattaacactctagacttaacctgaccccatctgcaactttctctatctgaatctggaacttttcctgcctgaatcatctgattggtgctctgaaatttcctgtttttcttatggaaatggaggaggagtggtccacttaactgggattcatgattcatctcatcagagtatagatttggagcagctggacaatatcaggcaggtactgaggtgtatactacattacaggcagaaatctgcagctgcagttgggatcagataaatctgtttaccattgacatttcacaagagtctgaaatatattcaaaatctacaagtctgaaatcctttgacatgtgtggctagcaagctggtgaactgaatttgcactggtctgtatatgaactgccacattgaaaaacactgtttttttcccatgcatgcataaactccaaatgcaatttgtcaatagtgctcagaaaaaaattgctggtatgacatgtttgccatgaggacagtcactgtatttgttaacaccaattactgcagcttcatttgctgatggccctacacccatctaactttgcatgctcagtcatttaatttgcaggttgttagtatcgaccttacaatctaatcagagatatggtaattaacagtgggacatgcagtaatagatgactaactagtcgattactattgtacttatataggaccacacgtgcacatagagcagaactacttgctatgcaattaactaacttatctacaagtatcagctaccataatcagctgcagtttttggatgcagttagcaaaccatgtagcaacacttttctttgtaatcaaatatccccatgccaccttggacgctcgattgattgatctcgtcctgtaccatacacctgcaaactctgcaaagctagcatgattccactcgtatgttaacacgttgttttgtttacaaaaatgataagccgacgatcgagctggtgtttaatctccagcgtcgatgtatttcaaatcaaaatgttaattgtgcattccaggtaaatccggcatccaacaaggagtgtatgaaaatgaccttgacactcgttcacgtacttgtagtacgcccaagtcttgaacctttgatctattataatggtaggctaccactctagtgtctgtgtcgtacaagaaaacgatctctttgaaaggatgaaatccaaatacttgagagatgtatcctttgtactgcctatcttcaccggcgctaccattttcatcatcagagtcgttccattcgaattcctcttcctttactagtgattccttgtttttctttttggtgtcaatgttatgccatatccattgctggccaccgtcgttgagagtgtagcctgctgctagcactggccctaggtctgcgtcatgcttgagcacccactcgtgctcatgatccatcgtcgtcgtctccatgccaccgccgtcgccattgatgccaccacagtatgaattcgaataagaagaatatgatgattgatattccttgaggaaccaaatttggagtcgacataaaccaataaccaatgcatagtacactccctcttgggattttcctaagtaaggatcgacagtaatattttgatttcccacaaaatcgccaggcaatttgataatcctatacctgtgatttgcaattgtgattctgatgacgcaattgttttggcaatgcacgtagagcgatccccggaagtagacggagtaggtgtcaaagggttcccaccccgagcttgagcacacctcatcaatggtgcccatggtggcgttcccttcccggacgaatgatctctcctcccaccgccatgtactcccctctggctctgtcctcgaggagaagacatggaggagcaatggcgaaggcggccactggcctgaaaccgtggctcgtcggaggacgtagggcatcaagaacacctggtagtgcggcgacatggcggggtcaaagacgagggcgtggtagccgtcgaggatgatgtcgctgcccggcgactctggcgggtaagggggaaggcgcgtccattggcgcgtggctgggttgacgacatggtggtcgagcaggatgaggccgttgcagtggtcgactatggtgagaagggatttttcgatttgattggtgtcgaggtagtctaggtcaaggacgccggggatgggtggcctcctcgtccccgccggcgaggggcgggcgaagaagccgctcagagttggcacgccgatctggacgaagatgccgcggagcgtgcaggggaggagcgcggccgtggcgagcagggagcggtcgtctatgatgacgcgccaggactgacagacgcagcgtgaggcagcgaggctgcgtcgcggcaggtggcggaggacgtcgtcgggtaagaggtgcatggccgctacggttgacgcgcgttagtcttgattgattgatttaataagagagatcatagatatatgctatactagtacgagtacgagtagtatatacatacgtggacgtatgtcgtcggacgagggaggcagagccagcgagtctaaggccgatccgtctctcgttgctctcctggaccgatttttaatatattttaattttattaatgctaatctacgtcgattaaaaataccaggattaaaaagtcccttcactatggcattaattatggactgtgctatgatatgaacaatattagaggcaaagcaggagaccatgtcaaaatgaaaccgaagactctggcagttgcatcattcagcaaggttacagagttaattgggaaaaagtattaaaatattgttcaagtactccattggttagtcaagtactccattggttaattggaaggaaaattaagtaacctggaattcattgatctgaaaacaagcttccacttccaaaaagaaaaaaaatcattgatctgaaagacagacaaacatcaatgaagaacctaaatgtatgcaaatcaatgttagagctggcaaacataactaactctgctctgtgtttaaagatggggttaatttgatccatgccattataaattttcatgttttaaaatataccattataattccgagaaaactaagcgcatacgcgctggcggcgcgcactttctggcaagccacgtcccacgtgaggcccaggcctgtgtccaacgattatccggcatgtgtgctaccgtgtgaatggattggagtatatttctactcgcatgagttagttttttcgtgttttctcttaatcaagcacggatgaattttttcacgatctttttaagtaacaggttaaaaaatatatatacgtcaagtcaaattttgaaaattaactttcaccctatatttgaaaactttcaacgcagatttgaaaactttcaactcaaatttgaaaacttttaacacaaaatggaaaactttcaactcgaaatttgaatttttgaagttaaaatttgaaaactttcaatatttcatctcaaatttgaaaaactttcaactcaaatttaaaattttcaatccagatttgaaagctttcaactcaaatttgaaaactttcaagtcaaaatttaaaactttcaactcaaaatttaaaaactttcaacttaaatttgaaaactttcaacacaaaattttaaaactttcaattcaagatttgaaaactttcaaattggcgaagacatggagaaaacaccgtggctcgtcgtccgaggacgtagggcatcaagaacaactggtagtgcggcggcgacacgatgagggtcaaagacgagggcgtgatagccgtcgaggatgatttcgctgcccggcggcgacgactccggcggcgagtaagggagaaggcgcgtccattggcgggtggctgggttgacgacgtggtggtcgagcaggatgaggccgttgcagtggtcgattatggtgagaagggatttttcgatttcgtcggtgtcgaggtagtccaggtggagggcgccggggatgggtggcctcgtcgtcttcgtccctgccgacggcgaggggcgggcgaagaagccgctgagagttggcacgccgatctggacaaagatgccgcggagcgtgcaggggaggagcgcagccgcggtgggaccaagaatctgtgttgacgagaaaatagaacacaccggcctgggagatctgtttagctcctgtgcaggtccaaatcttgattagatgcgagcgtgccagacagtttgatcctgcaactgacaagatatgcaaatagtagatccaaacagccgatcggctgacaagccgatggagtagttccagccgatagccgataatagccgatgctaataccagccgatagcgataggatttaagcaatcggctatatgtccaacgtagataatgatatgaaggcaatcggctgatgaagatgtaataaaataacaataatataatccgatagaaaccaatcggctagaaacaatatataataagcactgatctgaaggttaaagcatacatcggctggaggttgtcacgccccgaactagtaccgaccggaactagcccgtgacgctccaatttaacctgttaatcgataccagtcaaaggaaacagtgctggtatcacagggagacagaatatcacatcaacaggggtctctttattatagagtagaggtacagtcatgttgggctgcggacagatcccgagctcacaactgcattacaaaagggaaacggaagccaggatttggaccaatcaacacatgcgcgacttgggaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccagggaaataagtgtttaatgcaggcttcaaggaaaggcggctgtttttgcaattgattttatttgaactcttttctaaaaacaactaggtgagtgcttctcaaacgacacggatgagacagtgcatctcgtccggtcggagtatgtgcaatgtattagtctttagaattgaaacaagattggcacccggccaacagcttttcaaacggccacccgggccaacgactttacaaacggccacccgggcctagctgatcccgtcagctgctgatttttcaaacatcgaacccctttttcataacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccagggggtcctcttcgacaccaccccggcgaatccacatgtctctcggcatcatggctcccctgataagctagttactcagccaggggtgtcccattccacccatgtggtcgtacttgtcttatgttcggatgaaattccaaggaaacggtccttaagtgcaagagcgggaaaaccgtacccccggtacgttccccgatccgtggttttggaaattcatttagttcgcaagcaccgacccaggtgtcgggttttccaagtcttttgtaaaactccagttttacccaagttgttactcagatttttaagtttgaaggcgaccgtcgatactcgcacagagtgcacgaatatcgaggcgcaactgggtggttacaaggggacatagtatagcaattaacaatggaaggatcaaatgcaacaagtcaggtaggtccgccaatctgccttgcagacgggataaaagattaagtgcgatcctatcaatgcataatattttgcaagcaatataattaaatttcaaatataggctcaagatgttcgggtggcttgccttgctcgagatctggagcttgatcctcgaaatcctcgcgctacgggtcttcgggctccgaaactacacgcgaaacgggacaactcaacaaacggcgaaaataaagccctattaatgacctctaagcgtgccattagatagatctcgagatttgaggaattttggaagttgaacggagtcaaacggatttacggttgggaagatattgaatttctaagattattggatttttggtctaaatgaaaaggatttaattaaatcctttttggaaaagaaaaagaaaagaaaagaggggggggattatagacttttcctcgggcggctaaggcgcggcccaagggaattggagcggaccggccgatcttaacgggccggccggcccaagaaggcagcccagagcggcccaagacgcgcgcgcgcggaggaaggagagagagtccggtggaccgggctcactacgcgcggtcccgggtgggacccgcttgtcagtggcttggctcgccgtgcggagggagcacgcggcgcacgcgcgcgggcgggggaaggacgcggtgcacgcgcgcggctcgcggtggacgcggatgcggcgggcccacgcgcagcctcacggctcgcggtggaacgcgcgcacggggagggactgaccggggttggcccatcccgacctcggctgagctggcgccgacgtggcgcctacgtggctgccacgtgggctggcgggaggtagacgacgacccggccgcgaatggacggcgggcggcggcggcgagcgacggagcgaaccacggcgatacgggcaaaagcgagcacaccgggcttttgttcgtgatgaggggagacgagccaacggctcggatt

SEQ ID NO: 9291 - DNA, 10251 bp, Oryza sativa
ggggcggcgccggctaactacggggaggctactcgagctactaccgaaatctaaggggggagatggagcgaggaggaagaacggagggaggcactaccgtgcaggacggggcgctgtgacgagaggccgacggcgcgggagtaatctctccggcctcgggccggggaagaggaagaagagggcgcgctcggagtccccttccgcgtcctagtgtgcaccggctcctccggcacacacgcgacgacgaacggcgacggcgaacaggggcgacagcaatggcacgggggcgaatgggagaggaagggaaagggggggaggctgggtttaaatgggcggaaatgtcggtttgggagaggggaaccgacattggatggtcaaggcgcgagctggcgctccggctagcggccaaaacggcgacaggaggatgacgccggcgaggaggaaaaaggggaaaaggagggggagaaagggggcttgcccctttgccgattcgggaaaaggaggaggggagcgggggcgacgcggcagagggaggagggacgctgcctccgccccttggaggctagcgcgcggagtggcgggggccgggcgatgatgacggcgatgacggcgggcggcagacgcgacagacgctgacgacggcggcgaccaggcggtcggccactggctcgcgcgcgcggcttgcaacgggcggcgtccgcgcgggcgcgcgcacgcgaacacggcgcgcgggaagcggcagcgagggagcggagagggaggacttggctcggcgcaggcggcttacgcgcacgcgcgcgggcagagcggaggggcgcagggcgcggctctcgcgctcgcgcgcggcgcggggcgaggcggagggtgagagggagagagacagagagagagagagagagagagcgcccgggagagaggggggagatgggtcgggggagaggggaagatgggccgagagaaattcggcccatcgaccccgggggaggcaaaatagacttttgcggaggaatttgatttggaaggatttggattcggaattgaactcgacgatagatcggggattgagatcttgagatggcacggacactagacaacaagcaaagaaacaaatttcgcaactagggtttttaagagataattttcccgctaggcaccacgacggaacgggcgctacagaggtccgatgtcatgaaatctacaagattagattaaacagtgaaatctatgttgcgatcggctaaatccaacttatatgtatatgcaatccttatgagccgatgcaacgtccagataactcatcggctgaaaccccgatgaaacccttattggcagtcaaaaagcaagcgagagattatggttctaagcacgacttagtagatcaaacttaactgatgcagcactaagtatgaaaagaaacacaatatctagacaatcaagccgttgactgattttcagggtggtagatgtctaggctaatctaatatagcaaggcgatttagccgataccggcggaaaccctaaagcgagagacaaccgatagagctaaattgagatgctaggactagattaacatagacatatgataaatagctaggcaaatatattatccaaaccagagtaatccaagaggtcgaatgtactgatgcagccttgaacgacgccgacgtagacgatacaattgcctggaccgacggaacattggacttatcccttcgccggagatcgaacaccgatgcagccccgcgtcaagtgccaagtcccaccggacgataaaataaagtagaaaaggtaaaaggtggcgatgcgccgaattgtattgatcgtggagatagattacatagaccccgggtgtacatatttatacccatgggttgatacaagtccttgtcagacaagaaagaaactaacctaaagataaaaggaaaacataaagtccttatcggacactaaacacaccttcctaaagataaaaggaaactaacaaactattcctaattaatagataaactgccatgccgcatcctctttaaactcggtcacttagggataagcttcctttagtagattgatttccttaaccgaatatagcaggaatccgactattggcgacttgataactcccatcggctgattccgagatgctgcagccgataatgattctaagctgatgacgtctttgccgattaccaaatttcactgttaacaggttgacgcgcgtttacaaagctctatcgaatttcgattgagatcagtttgttccatagcaagatcatagatgagcttcatttgtgggaaatggcaggtgtcaagggagtgaagtgtattatcatatgttaagagattaggcttttgtttttttagggagtgcaggcaggaagagtttctctgggaacgcctcccctgccttctcttctgtacagtttctctcacttcttctataatataaaaccagctcgatgggttctttcaaaaacttccattatttgattcaatcgagagtccaaggctgatccgaggaaagctaacacattggtccaattggcccatatatggtctgggccgccctgtatttttcgcagccgtactaggcccatgaacaagccggcccagcccttctccttttgcaatggaataagttcacttcatgaccctcaaatgtgatcgaaatctaaaccatgaccctaaactacaaaaccggatatctcgacccccaaactcctaaaaccggtgcaatttgactccctgggcggttttgagaggcggttttgctgacgtggcgccacgtggcatctacgtggcaatattgaccgagtctttgttacacgtggcgttgacgtcgcacctacgtggcggtagaaataaaaaaatatgcgtgggacccgtttgtcattcacacataaaaaaaattgtggggcccactgacatgtggaccccacatgtcatccttcttcctcctccctctttcccttctctctctctctctctccccttcatcctcttcggccggcggcggcagcggagctagctggagtggcggcggcggtgggctggagcggcggcagcgggcggtggaaggccggagcggcagcggtggcgggtgggtggctcggccctgctccaactcggagggccggaacttgtggccaccgccgccgtcctgctcgtctcgtagcggccccaagtggccgcctcgctcttccaccccggcacggctgcgccgccggcttcgaccgcgtggaccgccgccttcgacctccgcctccgtcttcggccatcgacgacgccaagggcaaccaccgccggtcgacttcctccacgacgacgaccccatctcgccaagcgctagcctcgccatcgttgactcctccactcgggggaccgccgccaccgtcggaggggggtgaccgcctcttcgtcgcgccgaggtccatcgccgttgacccggggacgagctccttgcgccacctccgtccaccacgccggcggcgctccagaacccgttccagctatctcctgctgccgccggcgcttcagctcccaccggccgccaccacaccgcagcccatgcccgccgccggccgagggtgaacaagggagagagagagaagggagagagggaggaggaagaaggaaggaggatgacatgtggggcccacatgtcagtgggccccacattttttatctgtgtgaataacaaacgggtcccacgcatattttttatttctaccgccacgtaggtgccacgtcaacgccacgtgtaacaacgactcggtcaatattgccacgtaggcgccacgtggcgccacgtcagcaaaaccgcccagggagtcaaattacaccggttttaggagtttgggggtcgagatatccagttttgtagtttagggtcatggtttagatttcgatcacttttaagggtcatgaagtgaacttattccttttgcaattgcaacgtactacaggaatccgattgatccgatggacggctcataatcatccatcttaattagggtatggcagaaaaaaagactagtacctaccgagattgctaattcgcgcgtacgcgcgagatcagcaagtcgcgagcgtttcgcgacggcaatgcctcaacttcgtgtctgacatgggcctgctgtcacgcctcgaactagtcccgagcggaactagcccgtgacgctccaaattaacctgttaatcgataccagtcccaggaaacagtgctggtatcacaggaagacagaatatcacagcaacagaggtctctttattatagagtaggagtatagttatgttgggctgcggacagatcccgagcttacaactgcattacaaaagggaagcggaaaccaagacttggaccaaacatcacaggcgcgacttgggaactaggccgaaaaccctaaaactcatcgtagctgacttgctcctggaagaactcctcgtcagcgggatccgcttcatcttcttcagcaactggggggggattatttatatagagcaagggtgagtacaggagtactcagcaagccatgggaaataagtgtttaatgcaggcttcaaggaaaggctgttgtttttgcaattgattttatttaaactcttgtctgaaacaactaagtgagtgcttctcaaacgacacggatgagatagtgcgtctcgtccggtcggagtatgtgcaatatatcagtcttttgaattgatcaagattggcacccggccaacagctttcaaacggccacccgggcctggctgatcccatcagccgcagattttccaaacatcaatcccaaaccacctcagcaaatttcacaaagcagtagtcaaacaaaactacgctaggaatcacctcacatccgcccatgaccgggggcacggctgttcgaacagtttaataacctctgcagagggggtacactttacccacacgacattactaacccggatcatccagcgcgtgcagaacggccacgactagagaccttaaggctttcatgacaaggcatttcgaaagccgacacaggttcaccatatgccaacgagaggggtcccagaccaacaccagattaggtcccagaccatactgtgccaggaaacccgggggttctccccgacaccaccccgttaaatccacatgtctcttggcatcatggctcccccgtttagctagttactcagccaggggtgtcccattccacccatgtggtcgcacttgtcttatgttcggatgaaattccaaggaaacggtccttaagtgcaagagcgggaaaccgtacacccggtacgttccccggtccacgattttggaaactcatttagttcgcaagcaccgacccaggtgtcgggttttccaagtcttttgtaaaacccaagttttacccaagatgtttctcagattttaagtttgaatgcgaccgtcgatactcgcacggagtgcacgaataccgaggcgtgaccaggtggttacaaggaaacatgatataacaattaacaatggaaggatcagatgcaacaagttaggtaggcccaccggtctgccttgcagacggggcaaacagattaagtgcaatcctatcaatgcataatatttttcaagtaacataattacattcaaatataggttcaagatgttcaaatgtggcttgccttactcgagatcttgagcttgatcctcgaaatcctcgcactgcgggtcttcaggctccgaaactacacgcgaaacgggacaactcaacaaacggcgaaaataaagccctattatggacctctaggcgtgccattagatagatctcaagatttgaggagttttggaagttgaacggagtcaaatgggcttacggttgggaagatattgaatttctaagattattggatttttggtctaaaggaaaaggatttatttaaatcctttttgaaaaagaaaagaaaagaaggagggagggaaattagactttactcgggcggctagggcgcggcctgagagaaaggggcggctcggccgagcttaatgggccggccggcccaagaaggcggcccaaggcgcgcgcgggcggggaggggagagagagagccggtgggccgggtccatcccgcgtggtcctgggtgggacccgcttgtcggtgactcggctcaccgtgagcgaggtgcacgcggggtgtgctagggtttgggaagggagatgcggcgcatgcgcgcggttcgcggaggacgcggtgcggcaggcccacgcgcagcctcacggctcgcggtggaccgcgcgcgcgagggggcggagggaagcggcggaccggggtctgcttgacccggtcgcagccgaggtggcgccgacgtggcgcctacgtggctgccacgcggaccgtcgggaggtagacgatgacgccggccggaacagacggcgaacgacagcggcgagcggcggagcgaaccatggcgatataggcgaaggcgagcacaccgggatgtcgcacaggacgaggggagacgagccaacagctcggattcgccgggggatgctcgacggcggcggattgcggcggcggcaaccggcggtgggagaagggggaaacagtgatgaggtcatgaggggccgattcccggcggcgagagcatctacacggctacgggaatccgttgctagtgtcgaattgggcggagctacgtcgagcgaggccggtgacgagcgggtgctacggagcacgggcggcgatggcggcgagcacacagcgggcggcggcaacggtcggggcggcgccagctagctacggggaggctactcgtgctactacccgagtctaaggggaaaaaatgaacgaggagagagaacggagggagacactaccgtgcaggggtgatggggcgcagtgacgagaggccgctggcacgggagtgatttctctagcctcgggccggggaagaggaaggagacgagcgcccggagtccccttccgcgtcctcgctcgtggcggctcctccgacacgcgcgacgacgaacggttggcgagagggacggcaatggcgcgggcgagaaacggggaagattgggagaggaaagaggaagggaggcgcttgggtttatagggcggcgatgttggtttggaaaccgaccttgggcggtcaagggagcgagccagcgctccgcggtcgcggccaaagcggcgacagggggggaggatgacgccagcgggagggaaaagggaaaaagggggagagaaagggggcttgcctccttgccacttcggggaaaaggaggagggagagggggcgatgcggcagagggggggcggggctcagccttcgtcccttggaagccagcgcttagcggtggcggggccgggtcgatgacgacggcgatgacggtggactggtttggagtggagcggcgacacgggcggcagacgcggggcaggcgcggcaggtgctgacagcggcggcgactggccggtcggccaccacggcgcgcgcgcgcgggtggcgcggcgatttggcggcatcggcgggaatggcagcaagagcgggagggagggctcggcgcggctcacggcagagcgggcgagagagagagagagagagccggggagggagggggagatgggccgagaggaattcggcccatcgaacccgagggaggcaaatagacttttgcggagggatttgatttgggaaggatttggattcgggattgaacttggcgacagatcggggatttgagatctgagatggcacggacactagtcaacaagcaagggaacggatttcgcaattagggtttttaagagatagtttttccgctaggcgccacgacggaacgagcgctacacctgctgggcctaatgactttttcaacgatgattaacgatgattcaatagtaacacactcaattggtagtagtatgtgctaattgtaattggaaaacccacgtacatacatgcatacagtggttagaacatttaactaaactttttaacaaaagatttaatttttaaattgaaaattttgaaaactttcaactcagaatttgaaaactttccactcagcatgtgaaaacttttgattcaaatttaaaagttttcaactcagaatttgaaaactttccactcagcatttgaaaactttcgattcaaatttgaaagttttcaactcacaattttagaattttcatctcaaaattcaaaaactttcaactaaaaattcgaaactttcaaatcaaattacaaactttcaagacaaatttcaaaaactttcaacttaatttttgaaacttttgactcaaatttgaaaactttcaacttcaatttcaaaaactttcaactcaacttgaaaacttctatgtcaaaattttaaaatttgaaataaaaatttaaaactttcaactcaaatttcaaaatcttttgactacaaatttaaaactttcaattacttttctaaaaagattggtaactgaattatgaattatgtatgttgttactattttaaaaataatgctaatgacagtaattaacactaattatcataattaccggcggcagcgcgtgaactagtcgtcagggggacgcgcgcggctgcgccagttaagcagccggcacgcacgcgccccctaggaaccccagtaccgactccctccgttcctaaatatttgacacggttgtctttttaaaatatatttaaccgttcgtcttataaaaaaaattaagtaattattaattctttttctatcatttgattcattgttaaatatactttttatgtatacgtaagtatagttttatatttttcacaaaagtttatgtataagacgaacggtcaacatattttaaaaagttaatagcatcagatatttagcgactggggagtaaaattttggaaaaaaataatgtcctttttacatctggactggacttaacagcggtgatcaatcaattatagaacgtataaaaaaagaagagtttatatatatttcaacttcatcagctcagctctttctcggtgagtactaaacatcgatccattgcgatttggcaccttcgtctatagagagagaacttgactgatgaagatgctttctcaaaaaaataaataaaatgaaaagaaaaactgaactaaggatgctttcacaaaatatcacggataatcagcttgggatctgacgacatctgattctttttttcttttgggtgacatctatatatatttccgggaacacaagtacaatcttttatcttaatttctacaggtattagggtggcgcatgcatacaccaacctgcgtttgttgaacaaccatagcaattctctattcactaaacattcagccattcaatatgaacaaattaaaacatcaatggaattaattctaggaaaccttggtcaaactgtgtctttgacaagctaagttgccattcacacaaaaacggacgccattcaccaagagagagagcgagagagaaaagagcatgcaagtcacacacaatcttgaacttatagacagatgagcttgataatctcctgcacaaatgatatgctccattttgcaaagaaagatgaaacaagcacacatctacatgtgccttcctctatacctctaattaattcctaagtaccaagcaggcaagcaagtcttgatcaccatcactaaaaattccaaatcaagaaacaaatcaaagaaaacaaacaagagaattgagacagaagatgatttttttagactggtagaagatgagaatatatttaactggatcatcatcactaagcatccctaggatgaacctcaggcagtttggccatcttcaccatgctgtcctccacaactccatttgagctcttgcaagagagcccgagcccaagcccaagcccaagcccggcccatctggaccgcctctgccccttgctctcccgcgcaacgccaccgccgccgccgttgctgctcttggtgcaggccaggtacgccgccaagaacgggtcgtcctccggccggacggcccgggccttggagaagctcttgctccccgccatcagcatccgccccggaggcggcggcaccgacagccgccgcgccggcggcggcggcgccttcctggggctctcgggcatgtcgtcgtcagaagccatcttctgcttgggcacgcccagctcctgctcccacgagaacatcacggtggccggcgcggctgctgcttcttcctgacccatgcagagcagagacttcttggctctgaacacagagaaagagagagagagagagagagagagaaacagtg

SEQ ID NO: 9292 - DNA, 3202 bp, Oryza sativa
atggagcttattatgctctttaatttgtttcggttacagtttagtgtagcttggaacacggaaggctaacggattggaacatgtgacctcatctccttttctcctttttcttttctttcctgtttgttagtagtatttgttttagccaacagcccaactgcaagacgatattgatcactgatgtacttattttaatttcccatggtttttctaactgaatttcattcatatacgcctatgtacgtagctataaaataaaatggatcatgtattgctgcaagcaaagaaatacagagattgcaagcaaagggtggatgtacagtacattagcatgaattcgttaaagagtagatgagcttcaagttcaacagcgacagattgacatcatatacatacacaagcatccttatctgatttttctttttgtcattggtttgttctttccttgccttggtgtttttcaacacaaacacacgcatgtcatccagtacaacaaaactggcggcaatgtgttcgtcagtacgactgctagctataaaaattgtgtaacatcatcaaagcaggatgaattaattcgttcgtgcatgcattatattgcatctagaagatggggcttcattcttgggttaggttctatatactcgtgtttggtggttgtttggattttctttttgagcaaaacatatccatttggaaggtttggtttgtgatcgatttgaataacacatccaaaacttgaatccattgaggggggggggggaaataatagtagaaaccaaaattaactatgccaagttgatggcactacatttgacctttcatagaaatggcagaggcttttgtttacacatgaaacctcctataacctcgtgccgatcagttactacagacttacagctcacaatacaacagtcaaagcaagttcttgacttcccatatactacaagtttagggtcaaattactcttctgaagaaacaagttttagctactccctccctttctattaggatttttccttacaaaattaatgttattagattcgcatctaaaaaaacttatggttatacttttacattacataaataatatattagtaaagagattattagttgtaacaaaacaaaatataccttataattaataataaaaggagtatattaggacagagtactgtcatgtaatttgattacgaattttgtgattataaagaaaacatagttcagaacctacgaaaatatataaggaggcatctgatctaagctgtagaatgccaattgtttacctgtctgtcagttacagacttaacagtcaagcatgtggcatgtgggtttccgaatcccaatcacgcattaactttgcaacaaactatttgaaaatcgaagacttcatcttgcttaatccgtcgatggttttagctatctgcgtgttatatgaaaaattgttattccaaatttgagtttatagactgattaggtgttatatatgaggatcatataaggaattttctcgataaattccaaaagattattgcaagcagtagctatcaaggagttggaaaatccttctcatgtccgtggtaggccacaaaaaaatgccaaaccatcaacattgaccactactgacacccggaaggaggagcaccaaattgccgggaaaactacaaaatagcaactaatcagaaattggatagttctctcgccaacagttctttaatgctttggaatattatgcatgcaaaaacaacgctatcttagagaatttttgtccttttaattttaaattactagtaaaacttacttatctggccatgatgtacatatgtgttttaatgctacgtatgttagtcgcatatcagtcatctgattgcaaatgactattccaacatcgtcataaatttggcctgcataatcatatataattctttttcttattctctatcttttgttatgacttctattctagtcactctctgctaatattatcatttagtgtgctcggaatattgactggtcttgttcaacaaaacaggcagctcaatcaagaatgaagcttccttgctgatttttgtcttgcacaataccgtacaagtagatccatccaaaaaaaaaatagaaatcttcccaaatgcaattttcaaaatactgcgtgacagtgacaaacggggtgatatgatgataatataatgatgatgacgatcgaagggcaaattttccatcagaaaatgactatactagttaatcatgtccggaaatctttctagagatggttttggtttgcagccgccccctatcctagtactacgtttctaaatctctgaattagtcagagtaatgtgattcatatgtcattctacagaaacttacaaagttacggttgcatctagcgtgtgtctttttgtttagttgctgctactggcttgtaagcatttcaaatggctaatcagcagaaaggaacacatgaatctttttttgcccattctgccgctgtttagacgttttaatacatgctgattaagcaggtaagcaagattcgtcagtccaattgtgcaagtaataactaatgtattctcagagcaatcgaattctgttataacctgggtacgcttaagtcagattaccaaccctagctacctgcagatagacatagactgaatcttgatagttccagcctccaggagtaggttttttttttttccttcagaaaacaaaactagttgtatactgccagtagattgtaccgtaaaaatcttcatctgaatggagaaaacttagctgaagctacatgatagtattatataagcttggagcatatgctgggctttgtctctggaattctggattgaagcttgaagacacaagagcactgtttcagaaagcagagcccaaaaccaaaacaatgggcctaaagtaaaacaagagactaaactgaattttcagtgaagagaagcagagcgtttatacttaatttggcgatcgaaatcatgctacacagacggtgaaaagaaatcctaaataaacaagcatatacacacaacgaaatggatcgagcatgcatgaacggcaacgaaaacgattaattccaagcggaagacgccatgagcagccgcatatccctcctgcatattccttggcgacggaaaccccaatcacaatgttgcaattataattacgtgcattgcattgccgcactaataatccatgg

SEQ ID NO: 9293 - DNA, 11779 bp, Oryza sativa
ccagctccggatggtgcgcgccgtggcgccgcacatggcgtcgcggcgttccgggcgcgtggtgaacgtgggcagcgtggtgggcacggcggcgacgccgtgggccggcccctactgcgcgtcgaaggcggcggtgcacgcggcgacggacgcgctgcgggtggagctgcggccgttcggcgtgcacgtggtgaaggtggtgcccggcgcggtgaggtccgggctgggccacgccaacacggcgcagctcgccggagggcaggcggagtggcggctgtaccgggagttcgcggcggcgatcgcggagagggcgcgggcgtcgcaggcggggggcgcgacggacggcggcgtgttcgcggcgcacgtggctcggcgggtgatgagcgcgcggccgccgcgggagatcgtgtacgggaacatgacgttgctgttcgcggcgctggcggcggcgccgctgtgggcgcgcgacgccttcttcgccaagcgcttcggcctcgacaagatgctaccaccgcgctagagaagaagaagaagccatcatgactggtgtattcaacttgcgtagtgggctgggctcactgggccttttattttatgccaacatatctaggaataagttcatgttatgttactcatcttgataccgagttcgaattatatcttaaatcgcaaaatatcataaatattaaaccccggtcctcatctttttaaactaggtgaaaccccgcgcgttgcggcgggcacattagaaaagatgaaatatgcatgtaagaatgaacaattagattgtattatttgaatctgaaaacaaattgataggtaaaataggcactgaagtaagaaatacttgaaatgatatcaagctcataagctaacaatgtggagctttgttttactgcttgcaacacataatgacttatagtatagtgcaacttaatatgaggaggaatataatgttgaatgaaaggttgccaattgagacatacatgattgtttgaactatcttatagcaaataatgtactctgtaataacataagcattccttgacatgatatgagcacacagatatagagactctctactgctcaaattaagtttattgcaattgcttacctggttaacgatgagcgaggtggaatctctttcatagtagtcattcctatccatgtgcaacaccttcaaatacatgacaaatacatcgttctgttagctgaactcccccaaaatcactatgccgctactcttttaagtgggatagggaagtcgtaagctcaggcacgcactcacaattcctccccaaacgcaagcaaccaccacaaccatggcgcaccacctacccagccacgatgtatgaacaatttaccatcccgctacgcttgaataggtaagtaaagcagcgatcaaatggcgaggtataaaaaaaaaaaagcaaccagcagcagctcatccgagtgccgagtgcggctgcgtcaagcccaaataagatgaagggggcaggggccgatctacggatcgggcttcaaggactggatttgactgcagacataaaaagaatatgtagcaaaaattcaattggaatataactaatttaataatacaatggccttccaaaaataagaactcgattcattacttcgagaacttgttgctctactattcttccctcggtagcagctcggccacccaaataggcaagatatctcataagcattttgttgtttctgttttacccacgccgctctcaccactcacaagaatagagttgcttttcccttcatgaatcattgctctgtttcatgtaaaaagacagcaggatgatccacgatttataggagtagaaagttagaaacactgatgactcaaataccacctatcatatttactttacctgtatgcaacatctgccatagcgaaacatgtggacttaactctccaaatggtgctcccttgtactgttgcatcatatgtggatcatacaaatatggcaatctttggaaaggattgacggcaatgagaatgtttcccgtatatgtctgtcaaaatgttaaagttataggtcatacagtacgactgaaacaatggcatatttacagtaaatggccatgcagaataacatatatatatttcattaagttcatatctggttgccaaattctgcagaactcctggttcatggaggtatgatagctttgtcatatcatcaactccaccagcagctgcaatgatctaaaagaattgacagcacaaacataagtagcagtacatcaaactgaaggccaaaaacgaattagcagcttaccttctttccattggttgcttggatcttggcctcttcgcctttgatcttaacaacttctccatcgacccaggcaagttcagggtcttcagcccaaacatgagaacctactataatattaactttcgccccagcaatagaagaaaaaattggatatattctcatgattccattcgtcattgggaaatttacaatggtgtttaaatgcattcatgttttacctatatatgcagaaacattgtaatcctctataaactacaaaataaaaatctctctaaaatgatgtttcggtttgaactctaaaacgaattaacatgggaaaaaaatattaaatcacttcgatttgaaaccgcattaaacgaattgctacaatcaggaagcttcacgcaaagcatgccaatgatcaaacatgagcaacacatgttcagcgactgcatccctcaggcggacgcaagaggtaggcggctttaccattccgccgggttttggaggatgatcagcaggtggacgctgtgagggaaggcgcagatgaactcatatcatatctcgtggtcggtcgctcgtcgaagctaaccctccgtcgttgccggtctccgggcgggggatgcggtggtgggtgcaaaagcgggggagtggagagggaggagccgatgtgtagaaggcagtggagggcggagagggggcgggagtacgttgagcggccatggcaggccctcccttcgatctctgtgcagcgatcaaatggcgaggtaaaaaaaaaaaagcaaccagcagcagctcatccgagtgcggctgcgtcaagcccagatgagatgaagggggcggaaggccgttctacggatcaagcaccgatccgagcacgggaggcggcggatcaatcggattgggtaggagagaggtaccttgaggccgtcgacggagaggaggccgctgaggatgcactccatgaggcccgtccccagcacgatcacgtcgtactcctcatccatggcgggcgggcgggcgggcggcgagcggcggcggcggggaaggagaagtgggggttgacgaaaggcaacagcgtcgtttgggagtccaaaagcgtgggatggtgagatgagaatgagatgggaggaggaaggtgacatgggcctcacgtgctgtgaaccctgagcctttccatccgacggctaaaatgggatgtaatctaccgatccaacggctgtaaattaatgatgacgtggaacattgaggtttgagctttaggagattaattgcacttagtgggggataactttataggaagaagggattgggttactttgtcaatttcaaaatataccggaccagtcttccggatatacaatcaaacaaataaatcactctttgttacaaatgataaacgagtgaaaaagctatagggcaatcaaactccgctccgtccaacgtgggcatatatccataaatatacattaaaatcaaccgtagtgcattccaggcaaatcacgtatccagcaaggtgtatatggaaatgagcttaccactctatctgtattatggtataggaacatcatacccaagtcttgaacctttgccttgttgtagtcatatgcaacaactcttaaatttgtatcgtgcaagaagacgatgtctttaaaaggatgaaatccgagtacagcggagatgtattctccattatggtggatgctttcattggcaccactaataatgtcatcagagtccttatcgatagcccattcaaattcctccatatcatttacagctggtaattccctggttttgtcttgtttagtgtcagcattatgccatatccattgctgacgaccatggttgcaggggtagctttgtattattggccctaggtcaacaccatgcttgagcacccactcgttgtcgtcgtatgaagaagaagaagaagaagaagaagaagtttcgttgaggagccaaatttggagtcgacttagaccggtgaccaatacgtagcacactctgtcttttgattttcctaggaaagggtccctagtctttctgtttgatgcagagtcgccaggcaatctgatgacccgatacttgtggtcgttaagtgtgatcttgatgacgcaatcattctggcaatgcatgtagagcgctccccggaggtagacggagtgagtcttgcagtggtaaggtacccttgccaaggatacatcagccatggtgcccatggtggcgtcgccttcccggagaaacgacttctcctcccatcgccccgtcgtggaggagaagacgtgcaggatgaacggcgacggcggccactgatccgacagagacgcagcagggagtcgatgaagaatcaggtagggcatccagaggacgtcgtagtgtggtgacgctgctgggtcgaagacgaggccccgatcaccgtacattatgttgggcagtgaggcgtacggggggacaggaggtagacgcatccactggcgtgtggccgggttgacgatgtggcgatcgagcaagaggaggccgttgcagtggacttcgatggtggcatcgtcgtccaggtcgtagtcgaggtcgatgccggggatggtggccggcggcgagggacgggcgaagaagccatggaggcacgattcattgaggcagacgaagaggccgcggagatggtttgggaggagcgcgaccgcctgcgtggtgagggaatgttcgtcgacgatggcacgccaggcgtggcaaacggcgcgcgcggcggcgaggctgcgtagcggcaggcggcggaggatgtcgcggcgacaaggtcgcccggcagctgggagcagcagtccatgcgtagctagcttagcttaattgcgttgctggcttgggaaatttaattgagttaaaatatgagattcgctagctactgcatgcattctatttgaggaggatatggattgcatgaattaggacggattaatggagacggaatcggatatggacggaggaaatttcaccgttcggcttgcacgtgggtgaaggcggtaaagaaaatttcaccgttcttcttcttcaattcttcttcttcttatataaaaaaaatatccgtgcgttttaacaggtgaaaactattttaatcttattattgttatgtttatttaaggtgaaattgactataggaattcgcttagatatgtatatttttagaaaatcataataagttgcagttagcaggctgttcatctcaaattaacatgcgagttttttttaaaaaaaatagatttcttatttgactccttctgtatttctaaaagcaaacgaacttaaaaaccaactcaaataacgtatcaaagtaccggcaaaaatatcttcgatttttataattgtagagaagagataaactgggggactccataatatacagaccgcacgaagtagcaatcccgttccggcccaataaatatgggccgcatgtatgtcattgatactgttctggcccaaccagaagagagagtcgcattcccactcaggcccatctaagcctacagatagcgcacgaaatagccataggagttcggagtttaaaggaataagatcactttgactccctcaatttaccaccgaatctaaatcgtatccctcaaccgcaataccagaaatcttgacccctaaacttacaaaaccggtgcaatttgactcctttggtggttttggagggcggtttcgctgacgtggccgcgcacgtggcaatgttgacctggtctttatcccacgtgacattgacgtggcgcttaggtgacattaaaagaaaaaaaatatgtgggcccatttgtcattaaaaaaaattgtgggatccactaacatgtaggtcccacatctcatcctctctctcactacccttcttcttcctcctctctcccttatttctctctctctcccgcccttacatgagccggcggcaggctctgcacaaaatcatttgcaatgtttggttaaaatcatttgcttgagaagtcctcatactctgcacaaaatggattaattctctctgagcaaaatgagagaagtcctcagactttgcacgccatgcatgaacatcactacatcaaactgagcaaaatggactgtctcaaaaaacaaaagacccatgaaattacttgaaaccaatcagccatgcagcatctagctaggcagctactcttccatcacgagatggagttcctccaccttctcggccccttccacgtcggcgctggacatcttggccagcctgcccagcttcttgcacctgttgttccacgccgacgagagcacgagcgaatggggatcggagcctgacctgattggtagaggtagagacgccgcatggggattgggatcgagagttagggcgaagcctaagctgagctgctacgcctacgcgccgccgcgcactccggcgaggcgccaccacgccatgccgtggaggaggagatatgttgatcgccgtcctctggtggcgcctcgtggtagggttcgctctccctccctccgccgcccccgccatttccgccttccccggcggcggcggtggcggcgggaattttttttttgtgagaatgaaaaatgggccccgcatatatatttttattttagtgccacataagtgccacgtcaatgccacgtggcacaaagaccgagtcaacactgccacatatgcgccacgtcagcaaaaccaccctctaaaaccaccgagagagttaaattgcactggttttgtaagttcgggggtcaagatttctggtattgcgattgagggatacgatttagatttggtggtcagttgagggagtcaaagtgatcttattccgagtttaaaacaccgaccctcgtcgaccctattacgattcagattttgagaacaaagagttaggctgatcctaacaattagccactcagacaacacaaagcatcatcgatggaaggatgacagatgatgtcaatttctttttttttttagagaaattgacatgcaatttgtagatcatcagcaagtatatttggctggcgtacgtgttgtttagaatttctccttctcgtggatgacgctgcatgttaggctggctggccggtacgtacgcaacgtgcatgtgaaatgtgtggtggatctttgtcgtgtgtcatcactgtcttgttattattggacagacagcttctgccgaattttctcaatatgtaccacaattctatatttcctcggtttttttatactacacgtagcgtaaacttttcgcacgatgttttatcattcatgttattcaaatattttgtgtaaatatgtaaaagtttatttgatgaaaaaagtcacaataaaacaaataatatttatataatttttttaataacatgagtagttaaatatcacgttaaaagttaacggcgttaaatattaagaaaccgatgtattatatctttttggatgaaacgctgatcgatctgcattttatataatatatatatatgtatggaaggaatttctggtggaaactactcgtagatggtaatctcacacatgcccactgatttttcttctcttatagccacgtcaaagtccataaaaatggggaaaagaaaagcaaagtgtccttgtcttggtcggcttgatcaattggtcttggattagctcacctgcctgtgcccttccattgatgatgcctaattaaggtttagacagctgccacgtacgtaaataagtgactatactatgtattaacctctttcatattatatatatggatgttagcttgactttttacaggaacttaacacttagggagttgttaagattgtagctaaaacacaccttacaaattttggtatttcggtaagttgacaatattatcaaaattatgacagaattttttttgtatttatcaaagtttggcgaaaaaaaataaatccaagcaaatctttggtaactttaaaaaaaatgatatgatacattccaattaggaaaaaaaccccaccgttaacaatatttggattatatattatgaaagtatttatcattgtgaatatagatgctaattgcataggagtaacttacaagggacttttttttttataaatcttataatgttagtacgaataaatggatgaatggtgcatgccgtaaggctccccgaactcaaatccaaacacaaataaagatgctaattgcataggagtaacttacaagggactttttggccacgatctggataaacaaaaaatcaaatcatgctctttgattaatttgatgtcaagatcgatcgatgtgatgaattgtgtgctttacttgttggtaaccaagcatgacaagacactgcttggcctctgattccaatggcccggtgagaaccacgtgtcatcacggcgtgcgtgtgggccccactgttgggaccaatccacccccaccacgttctccactgcccaccttacgtggcatctcctttttctcatctcaattttaattttttttaaaaaaaattgataggagtagtaaaatgcaccaatcctttattcctcggaggaaaaaaaagaaaaagaaaacttaaaggacactgtagtactccgtatttgattttgcaataactcctgggggcttcttcccttccactctcgtctcgtactctctccaaacccaaatcaaaaccaaaccaaaatcgaaaccaaatcgaaaaagcgagagagagagagaggaaaaagtttggattcatcatccccttcttcttcttcctcctctcgcctcgcctcgtctcgtctgctccaatccagtccgcatctccccgccattgccgccgccgcggccgcgcttaatttaacccactcccactcctcgtcgccgtggtaatctgctctcctgctgccttttttttttttgctgctttgtgctgcttcgttggttgatttccttctcattctattggggtttcacttaatggcggcgcagggctccaccgaggcggcggcggttgctgtgttgcgccggcgagcgggcggtcgacttggaggcaagttaatctcgcctcctccttcgtcttctctacttgttcgttttagttcgtcggatttactacgcgttggtttagacagaaatttcagttgttaatccccgttctttgtccatcgatttcggagttggattctgttccttctcttgctgcggttgcggttaatctgttaatgggggaggagtcgcggttaatgcgatgtagtagtaattttctgcttggtttctatactaagcctgcagggtcaggtagagttgcagtttgcaggcaatccgctttctgtcgcgtggtgttgtggtgatgcggatgctcacacgcaaacaccggttccaaccatcgaatctaaacccaacctgttcagacagcttggattcctctatttgcagccttgcagccaacgatgttgacgcctcttgcatcgtgttcttctttttaattaactactccacttggtagtagaataatatataagcagccctcatgtcatttgggcacatgacattgcatctggagtgttctacatgctaccactactttttgttttagccaattaattactacttattatctccaaggttccactgtccgtacacccactccgaggaattggcttcattctcaaatctgattttaccttggtgccacttttggaatgtgcgtttgtttattcatggtgtagaaataggcagtgatgatgttatctgttgttttgctatctttcttttttctctttctctttgtggagattacagaatttgcagcgatttgtacttgcaggattgatttgatttgctttagcgatctcttcctgcaggtgctgagcctctgggtaccaaggatgaaatttgtgcttgtatttggatgacataagcgcgccacgcacttgctaggaaggaatgaaaatcagcggacttctgacctctgctggcatcaatatcgctctttctgtgctgtttatatcgctctattctgttctgaggaagcagccagccaatgtcagggtctactttgggaggaggattgccgaggagcataatcggctccgagaagcttttatcttggagagatttgtaccatctactggctggatagtaaaagccctgcagtgtaccgaggaagagatcttggctgctgctgggctagatgctgttgttttcaatagaattctagtattcaggtatttttacttccctgtattgtttatatattattagaaggtggtatctgattgctgagtttttaaacttcaatatgggcatgaatcagaaggagaagaaaatttgtagctgtataaagcataagttcctgacttgttgtaatgcacagtagcacatcccctgtcttttatttaaagatttatattccttattttttacctctatccaaatttacatgctaatacatttgtttttcaacagcttacgcatcttctctctagctgccattctgtgtgtgtttggaattctaccactgaactactttgggcaagatatacatcatgttcggattccttcagaatcattggatatctttacaattgggaatgtgaaagtgagatcaagatggtgagatgagaaacttcttgtagttttactacagggtagtttaaccaatgttctacatgacatttacgcctcttgagtgctggcatttagagaactccctccgctctcaaatagacgacattttagaatgtgtgcaatcaaatcactaataaatgcaaaaaaaaaaagacatgtgaaaatagatttgtcatcaaaagtactttcatagaatcaataatttcttctttttttttttttttttgagaaagatatgatttatatgccggttgcattgcaggctttgggtccattgtgtagccttgtacataatatcaggagtagcttgcattctcctatatcttgtaaggcctttttctcttaggagtaattgaaacattctcattcctcatattgaggagtagatttgatataacattatttgtctgataatttaggagtacaagcacattgctaggctgaggctccgtcatcttacttgtgcaatgcccaatccaagccattttactgtccttgttcgtggaataccaaaggaaaccaaagaatcatgcagtaatgctattgatgatttcttcaccaagtaccatggatcaagctacctgttccatcaagttgtttacaaagttggaaaagttcagaagataatggtaaaatctgcactcgaagggatgagctgcatataaatttgaacatattgtaataaagaatattgctgattgtttattgggaattttaaaagacggccttgatagttgttgtcatttgatattaattttgggtctactatcttgtagttgggtaatcactgggggaaacaagcaaaacctatcacattcttcccactaatttgattctcagctctgtgcttttatatagagtagtgttcattaatctccggttccttgaattgaatttatggctttgcatattttta

SEQ ID NO: 9294 - DNA, 3915 bp, Oryza sativa
taccttataagcagctttggattcgccgaatagctacgctccttggttcaattgtttttatgttattctttctgataccagtgacatttatacaaggactatctcagctagagcagttgcagcagaggcttcctttcctgaaggggatactggagaagtaagtatacatgttaaaatggaaccaatctcttgttattacaaagcttgttcttatttgtagtgcgaatcgtatctcatgtatatatatatattttaaaagtgaggccctattcttgtgattagaccaattaatttaacatgttctgcagttagtcaattcaaatgtgtaaaggaacacagtttgatgtttccttttctcttgtgttgctgaggcaatatttaatgtagaaatacgggcttctattcatttctatgcagcatctactgagtactctttcgtgtgcaggaaatacatgagccagcttgtaactgggtaccttcccagtgtcatactgcaaatatttttatatgccgttgcaccgataatgatattattttctacattagaggggcctatatctcacagtgaaaggaagaggagtgcttgctgtaaagtgctgtacttcactgtttggaacatattctttggaaatgtactatctggtactgtcataagccaattgaatgtgttatcaagcccaaaggacatccctgtccagcttgctagagctatacctgtccaggtaaatattgtccaaacacctttttgtctttgtgcttcagaagatatgaatagtttggagtacatgatgaaaggtttctccaaaaagatactgtttttgtcccttagtttttttcttaacttctctctgctattctgtaaatattttcaggctaccttctttatcacctatgttctgacatcaggatgggccagtttatcatctgaacttatgcaattatttggtttaatatggaactttgtgaggaaatatattctacgtatgccagaagacacagagtttgttcctcattcccatatcacacagaagtgccaaaagttttgctgttcggactactgggcttcacatgctctgtactggcacctttgatcttacctttttgttagtgtacttcttccttggttacatcgtgtaccgcaatcaggtgaggaacctcttcatttctacttggagtattatatgttcataacatatttttattctcaaatatgaatatcttcatcaatgaatattttattatgttgcaaattgtaaccgtggtggtgaacattttttacatgaaccttactgcaccattatatttgttgagtagctcgcactgtttcatgcaattaaatttggaaagaaaattgcatgttcttgtaaaaatgtttactgaaatagtatttcttatttcttagcttcattcttcaaccctattatttccccatgctaatgatattctattcgtggtgttttcagttgctcaatgtttaccgcacaagatatgacacagggggtttgtactggccaatcgcacacaacgcagtgatattctctctcgtgctcacacagattatctgccttggtgtatttggcctgaaagaatcaccagtagctgcaggcttcaccatacctcttatcatcctcactctgttattcaatcagtattgcagaaatcgacttctcccattattcagaactaccccagcacaggttcgtattagttccatcatagtgtatagtgatggacttaagtggacaacaaattaaaaaataaccccatggtctccacattctatcattgtggtgactggtagagatttttgctcgtgggtgattgactactgcattttgattgtacaggatttaattacatggacagggaagacgaacggtcaggaagaatggatgaaattcaccaccggcttcattctgcctattgtcagttccacgacactgaagatatacccttggagaaaattcagactgtcgggagcgatgaggaacaagggtgtagctctgataagtcgaatggaaaagaaagcttcgaggaacccagagcggagttgtctcacccaacactgaatggactcccagttagccgtcttcggcatgctgtgaagtcgattactttccttgtcagattgcagaaaagaggtttgtcagaatagaataggatatctaactactaaccccttcatcagcctgttcagcgatgaaaatgtacagccacatacatcatacaacatacattgagagagcatcaggatacctgaaaagcaattttgttgttttgatccgtttgatttccaagctagtgactctaggacatgctagttaatcagtatattcaagcctttgccatgcagatattgttgtagtgctaggtcattctgttacatgaaatttaaacttgtttctttggtaacctcagctactctgcaactcaattaccctcctcttctaacttcaactcatctgagaatgtaaaactgaaatttccatgcctgttagcttagagcttgtcctggactgcacatttttttaatttaatccatatttgtcaaaaagcatgtgccatcattttgtatttggtggcagttcttgagatttagcgttgggctgcaatctatacatatctgtagctgttgggaggcatattccccatcaaactttacagccaccatcagtctttgtcatcaaaagagctcaggggattatcctttgtgctgtgcatcacaaatctggtgcatgctgatttcagtgaatattttcttttgtccttggtggtgtttccttcctctttgtatggagtactccatctctttaggctctactgtttcttgaaaagattaaaagaagagtaaattgcattggtggtacacaaacttgttaggtgggtgcaatttagtatataaacttataaaatgctcgtttcagtatatgaacttgcctagttcgtgcgaacgagaaccaaaataatttggcaatgttaattttataaagttgatgttgattaggatgtgacgtgcatacgtgcagtgattattataaaacatgcaatatttataaatttagtctctactttatccttcatcattgaaatgatgaatttcatatgtttctaacccttatatcagtgctcgatttttttaatctttttctacattcactaaatcctattctatattttattgaataggtgtatgtctaatggcatcctcctcatatatatgttaacatagtatcctaatcagcctctaagtcaataacattagtcatgtcctttttgacttctcccgcacgcaccacacaaattcgtgcatcaaaatgaatattttacaagtttgtgcactagattgcacccacctgataagttcgtgtaccgacgatgcaatttactcttaaaagaaatctgatttttgactgctgccagtgctttgaacagggaaattaagcaagaactttttgttgcctccctcaaagcatatgcttttaagagttgatctgtaacataagcagaacattttcagagtgcttgtacacagtttgggtggtgtttttgctgctgcaacttatggtctgggcactgtattattccacacattacttgtgatgatcaggtcagggcagttagcctgcagctttggtttttctcaccaggctgctcccgcggtatttgaaccttgcggaaaactggtttgtgtttgaatttgacataagtgtagtacagtttgaagttttgaaccacaagggcagagtcattgacgtcagcagattagtgatgctgcgaccagtcatcaaaatctgttccaattttcaatcgatcgatcgacttcaactttccaagtgtaaaggatgactgatcttgttgatgtcagcggtgatctgtacactagaatttctggacagagcagctagcttccaggtc

SEQ ID NO: 9295 - DNA, 18853 bp, Oryza sativa
atacaagttgctgctgctgcacaccagtttgtaatttgccttgcaaatattgtagctggttttggtggttgtgccaattcatcatcatcatcagcgcgtcgtccgtgctccgattctgagctgatgatgaacaatcgccgccgctcgtgccggtggaacggaagatctcgtcgagctccgttgcgccgccgctcgtagctgccgtcgactacaacgaatgaccggcggcgaagacgtcgtcgtagccgcgtccttcttctccgactccgacgtgcatgccgccgctactggtgctagcaacgtgcagctggtgggcggcgaggaggaggaccggcctggtgccgacggcggcgtggagggcgaggatgaggcggtcgtcgtggtcggagaaggcgccgtggcggatgccggggcggaggtagttgagccagcggaggcggcagctcttgccgcagcggcggaggccatccagttgccgccggtgccgtgctgctggatgtacgaccgcagccgctcgtcgtcctccgccgtccatgccccgcgcttcggcttcaccgccgccttgtcgcagcacgccgacgacctccccatcgctcgctcgctcgatcgaaagggagatgcgagagtggccaggtataaataagctagctagagatcgatcgagttgttgttaatttgatggcgtgtctgcttaattgtgtgttcgtcgttgcttggactgcatgagtatggttttcatgcatgcgactaatcgctcgttctgcccacctgctcaattgattatatactataaacaacatatgtggcttagttttctgatttttttagcaataatattattttaatgaaaaattataaaaatagaagttgaaaatcacaagtttagcatcctgtcgaacaaccgcagtttaacgggggcccatatcaaacaaactgcggttgttcaacaggtgatatttttttaaaaaaaaggagaacaagcactgtgcaatattgttcatgcgggacatatcgaactttgtaagttcgatatgcccctgccgaacaatgcgtagcactgttcatgtactttttttttatggaccaactaccctatcgaacctgtcgaactgcggttgttcgacaggatattaaacttgcgattttagctgatcagctcctatttttataatttttttattaaaataatattatttctaaaaaaattctagttttctcccctatccgtgatcttcctatgtactatctctatttctctctgttaggataatataaggttttgaaccgccattactctgttgtaatattatttacgcgatgcaaaattgtgttcataaaatgtacttttaattcatttttttaacaggtggtgtgttgtctataagtataccgctgcgaaattacttaaacggtactgtctccattttaaagtcttaatatattttattttgtgatttttccaaatgagatgatcgtatttatagaggtgtttggttgccattcacaatctgccacttctaaggttagttaagtttgatcaccttgacaaccatttggttgtagctatagatgtgacaagattttcttccaataaaccagatcccacacgtcaatgactaaaaaaaagtgtccctgcaaaaaaaaaattactcaaaaagtatatatagcaagatttccttaagcttgtgaagatgtacatcgcctcaacttagataagtatgataatatttattggtaaatggtgataaaatatagctaggaacctaacacattcttcacacattcaacacttaaataaagagattgtcgttttgttttgtggtgctcgattgaattgtttaccggaacccgagtaaccatctttaatacacgttgcatgcatgcatacagtttttaactgcatgcatatgggatgagtttgttacacgtggaatgagttaaacaaatttagtcttcgtgacaaattgaaaggagggagtatgaattaaaacaaaaggacgctacaattcattctcgatggatgcacgtagttgttgaggtgatggcattaatagctaggtatactgtatactccctctgtattttaatctatgacgccgttgactttttaactaacgtttgaccactcgtcttattcaaaatttttgtgcaaatgtaaaaatacctatgtcatgcttaaagaaaatttgatgataaatcaaatcacaataaaataaattataattacataaattttttgaataaattttttgaataagatgaatggtcaaacgtttatcaaaaagttaatggcgtcatacattaaaataaggagggagtaagttaaatcaggatgtctgtatggttagttgattcattgcttggactaatcaaatcactataaacataatggggcggccggtttcaaggtaataactcaatctcgcccgtttgatgatcagtcggaaatcatagttgttaagtacatcctagtagctaattgactcgatcgatccataaatagcgacgaattgggagtatatggccaagcatgcatgcaacgatttccgaagaaatgaataatttatgtggatcaaactcatcgcaaagtgtttagcttagaccaatagacctgcatgcgcatcctctacaaatagtactgtagtagtggtgaagttaattagggggaagctacatggatggagacttcagtagtgaccggatgatgatcttcaaacacatttcaataatcaggatatgaatatttcacatccgcacgtttcctcggtgagcctcacacactgatcaggcactcaactgcctcaagatcagaaaccggccggttaagctaggattattgtgtaatatacattggtggcagctgtcatacaacacactacaaatataagcattgatatcttttttaagcagagattaagtgaaagaattaaagatcgaaagagttttttttacgacaatgtccataattaaatgcactttagaaagtgaaacagtgggaagaaagggtccactattactgaggggtacccattatctaaaaaaaattactgaggggtactgaaaggacaaaacagtaaaagcgtcacataaatgcttatataacaaattactagatgatgccccacgttttgctgcgggatataataagttagatattggagaaatgatttagattgaaatattataaaaatgatttgagaatgataatttagcatgtgtatgtttagttttagaataaaataaattgtagactatatacttacatgttgagttttgtgtgcttaatgggttgatgtggcatgtttgcacataggttttataagtgctaataaatactatgcttgcatactaaaagatatttcctctgtttcaggttataagactttctagcaagaggtagtaagaattatcttaggggacgataatgctttcgccgaaataacaataactgggccagaatatttgggtcggacactgtgtgggctggatactgtcaagcttacctgagtttgtttttaagagaactagaaaaaatgcccgtacgtttcaacgggggtaaaaacgttttatttatcctatacattttactcccttggttttggaccgaatgcttccttggttttggatcgaacgctcattccttcctttccagcttcagtcctagccatgtccgctacctccctctgctcagcctacctctcttcggctcagcccacaagtgaaactgtaggcccagctcgaacaataccgtgcctgtaccataacggagccgatcctcccattaaatcggtccaatctttctcgatctccaaaatttaatccggtcgagcttgcatagtccagtgtccatacaatgatggagccgatcctctccatcaaatccggtcgaatctttctcaatctccaaaattgttgagggattttgatctactcgatctccgtcttcctttttaatcaaaatccccaaaattgttaagggaaaatgacaaatccggtcgaatctttcttgatctccaaaattgttgagagattttgatccactcgatctccctattcctttttaatcaaaatctccaaaattgttaagggaaaatgatgagagagtagtcgggaatcttcttgatcttcaaaatttaatccggggtcgagctcgcatagtccagtgtctgtacgatgatggagccgatcctctcctgaatctttcttgatctccaaaatttagagggattttgatccccttgatctcctttttccattttttttatcgaaatccctaaaattgttgagagaaaaatgatgagagagtagtagagaatcggtttttgcaatcaattggagaagaaaacacatgggaaagcaaatcaacgtgaccgcggtgcagggttcggcacgagaaaaactgcaaaaaaacgacaaaagaaagaaaaacggcgaaaagaaaataaaacggaaaaaaaacgaaaaagaagagaaacggaaaaaaaaaagaggaaacggaaacgggaaaaaaaggaacggacagcgaaaagaaaataaaacggaaaaaaataaaaaaaaaagaaacagaccaaacatttaccggaatccttatgtattttttaattaggtatagaatagatatagatataggcacactccctatttaatagacggataatagtacggaattcctcatgcatatcatgtgaaagtaagaaaataaccaaacaaaaaaaaaagaaattacaagtaattactagtggacctcaccctcgcgtcaaaaatagctttggcgccacaaaccaacccatgcatgcgtgcgttagttcgcgccaaaattagcatgtcgcctctcttcaaattaaaacttgtccaatgctacgtacacacacaagggaaaaaaaaagatggacaagatgatgcgcacggtgatcgccgccgtcgtggtcggcctcctcgccgcggcccacacggccaccaccgcaccggaacaatcctacggcggcgcaacggcgaccgtggcgccgaagcagccggcggcgggggaagacgtcaacaaggccttggcggcggagacggcggctgccgaggcggaggacgccgccgaggaggaggacgccgcggccgctctggtcaccggcttcaccgccggcgcggcgaactccgcgccgggggtgactgccgtcatgaagccggtgctggagaaggcggacgccgggcaattctaccaggacgtgccatggattccggatcccaacgacgaggggaatcctcccaagtctctgccggcggcgcaggtcctgccggccaagggcggcgctggcgcggcaggatcatcgccgccgtcgaaggaggtgcaggtggattactacgcgacgacccagccgaagaagccggaggagccgccgacggtcgcggcggtccaaaaggacaattgcgtcccgccggcggcgcccaagccagctgttccggcgacgccgtcgacgtctcctccttcgaataaggagtatgctccggcggcgccaggcgtggtgccggtgaaccagccttcttccccggcggcgccagcaggcgtggtgccggcgccggtgcagccttcttccccggcggcgccagcaggcgtggtgccggcgccggtgcagccttcttccccggcgacggcggtgccaaagcctccttccaatgacccgtacgccccggcgaccagcaacactccggcggcggaggagcagaaggacgggctgaacgagaaggcgatcagcgacatcgtgagggagcacaacatgttccgcacgagggagcacgtgccacccatagtgtaagcatcatgcacgcacgcaagctgttcgatggaatgccaatggcaatggcgatgatcgacaatggcatatataataatggcaggtggaacgcgacgctggcgaagtacgcgcaggagtacgcggatttgaggagaggggattgccagctggagcactctcatggcccctacggggagaacatgatgttcgggacggggaagcagtggacgtggaagaagacggtggacgagtggagcgacgagaagaagagctacgactacaaatccaacagctgcaaggccggcgccatgtgcacccactacaccgccatcgtctggaagaacaccaccgccgtcggctgcggccgcgtcgtctgcacctccggcgacaccatcatggtctgcagctactggccgcccggcaactacgtcggcgtcaagccctactaattcattcttcatcatatcgatcgatccaccacccctgctgctgccctccatctctcacccatcatcgatcgatcgtcatccatgcatccaccatcgtcgtcgtctcatcttattaataatatatatatgcatcagattcttaattattataactaattaattaatgttatcttaacttgttagtgatatgccctagaggctatcatagagatgattatatcacacactatgtttacatatttatccgactttgttccttgaaatagataaacttattattggttaatgaatgtgtgattctttcataagactctttatgttatgtgttgctatttctaaaggatcactgatcaaatatcatatgtggaacaaatatgtatagatgatcagcacatgtattaattgataatgtgggcacatgttggatcatggtatagagataccaaattaataatgtgggcacatgttagtgaacatattgttcgatagacccaacatgagacactgtaagaaccatatatgttgtgtcatcagtgatctcatttagtgttggtgttgaatccttagacttgagattatcatgattcccaacatgtgtagtagcttacttagagactgctaaacgctactccgtaattgggtagttataaaagtagttttcgggtatgctatgaaacatgtagtgggatatgaataatcaacatgggatttgcccctcctatgaagagatatctctgggcccctcgatgttgtagattatggaagtgcatggccatgccaaaggtgattgaggagtcaatcacaagttatataatctatcgacaggttcgagtgaatgattgagctattagaggatggcatatatctagccttgaacttaatcgatatcgtgaggcaaaggggttcatacaagtatacactagaggttcagccgatatgatctttatgtatgcccggtgagtcaatacgttctgctaggggccgctgttgacgcgtggaccgaaaatgagttttcgggttacagctgagtatatatgaaactacagggtcgcacgcttaatgggccggaataagaggattggatggaggtaacgccccgattttcggtcgggattaaaaaatcatttaataatgcattttctagaaattaaataaaagttaaagcaatttaataaagtgaaataatgagggaatttaaaatttcctttaaaaatcatggccgggaatattttgtaatattctttgtgccctaatgtactctccggaattttccgtgaattttcggagctcaagaaataactataacaatacaaagttcatataatcaaataaaataaaaagaaaacaaataaaatctccctccatcccccttgggccattttcggcccaacccctccttcccctcccgcgggccgcgcgcctcctccctctctcggccggcccacgccttgagaaaagtctgctttgcgtccccggtttccctcccccctctctctctccagccgacatgtgggacccgaggccccacatgtcagcgccgtcccctacctccagcctcccctcccgcaactgccatggcccatggccgccggcctccatccccacgtcgccgcttcctccgctctccaccccaccccgtgtgcgcgtggaccggtatcattcaccccgcgcccatttcccccacttctcccctccaaaaccggcgccaaactgccccactcacccacgtcaccggcgcccctttcccccttcaaatccgtcgccaaccggcctccccgtcgactctcgaggctataaaaacgatccccgtgctctcctctcccatttccccaactttcccgagctccccgcgctctcgcccgctctcccctcgccaagccgagccgccgccgctcgccggagttcaccggccaccttttcccgctgctccacccactgtcgcaccaatccgccaccaccgtcggcttcgcggcgccgtgctgcaccccggcccctactccatttcccctctctacctccagaacatcgccgcctcgtgcaccacctctctccgccgtcgcctccagccgctcaccaccgcctccctagccactgccgcgacgcgccgccgccgccactagtttcaccacgccgtgctgcacccctgcatccacttttcctccccaaaccgccaccgaaattcccattccaccaccaaaccgagccaccacctctactcgccgcctccagccaccaatcgttgccgctcccgtccatcccgcgctacgccgtcgcctccttcggcttcgcaaggacggggagagcctcggccaccacttcccgtcaccggagcgccgcctcgcctccatcccagggagcacgccgccgacggccatcggccgtcgccatgccccatggcggccgcccctcgtcggcgccagctcggtgagcaccctcctccctccttctctccctccttcgccgctccccgcgccgcccgccggtagccgtcgctggtagccgcgcgcgtcgtcgctccaaggctcggccgagccggctcctcgtcgcgcccgtgctttggccgcccgtggaccactcccgtggtccgggtccatggtgccgcccaggccgcggtggaccgagtccaccgtgcgccctcccctgtgccgctgacgtgcggggcccacctgtcggcgcgcccctttctcttgatgacgtcagccgtctcttttcctttggaaaaataaataataattgcgtcataattcgatgataattctagaaattcatttaaatggctcaaaacttctaaaattcatatctaattcattcgaactctgaattgtgccgttcaacttgcaaaattcatctaaaattgagctctacatgtttgtttactttttatgtactattttcttggtttttattagagtttttcctcgttttgcgtgccagcgtgtagaatccgttgtttcggaagtccgcggtcgcgaggaaaagagttcggaagatttttttgaagaagcaaggcaagtcacacattccccttgaacatgttgatcccaatttataaatgttttaccgtttacaaataaacatgcatgtcttgctaattacatgggattcgggtattacctatctgcttgcgtgtgccatgtttacttgatatctgtcctttgtcaaccttgggtaataaatcgactagctcatgttacttatgtgacctagctagaactgtatgcttagccatgcttaattaccactagctcagttgatgggataattacagtattagacctttttagtatcagaatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtgcttaccacaagccagcgtgggcaacggctgggcttgtagtgtagctttcctctagctgacgcatccaggcaagggtgggcgtgatggagtttggatgggccctgcgacggcctatgcggcttccggattcacctaggcacgagaggggactgcccgctgccttgcgaggagtgggggtgaaacctgaggtgtgtaacgctccgcttttcgtgaggcgttaaaaactaattcggcaaaaatcctaattgcgaaaatttcgttctttgagtgttgagtctaagttgtgccaatgatctcaatttaatcccgttgttccctctcatcgaaaccaaaatcctctacctccaaattccttttccgattcgagtctctgaaatcaaattctgaaattcaaatccttcctttgaatcctcgccaaatacttctacgaatccagaattattcaaatcccgcctcgaatcctttccttgactccaccctatgatcccgagaacaaatacccaagtattccttttgaatctttcccatgacttctccttgaattccccttgatacatccctaaaccctcgagttcgaatatcaaatttgaattcgaatccaaaccctaaatctctccaattctatccaaatcaattttctctgcaaaagtctaccttacctccctgtgattttggatgggccgattctcctcccccggcccatctccccctcccagcccatcatccccccctcgcacgtgcgttgcacgcatgcgagccgagagagagagagtcgtcgctcgctctctctgtctctctcgctctcgctgtttctctctctctctctcgatgtctctctcccgcgccgacgccgcttcccgccgtcgccgcccaaaacccgccaccgccttcgccttttcccgcgctcgcgcgtggccgaccggccggtcgttgccgccgtcagccctgccgcgcctgcgccgcgcagccacccggccccgctccatgccaaaccgaccgccgccgtcatcgtcgacgtcatccatggcccccgccactccacgccgcacccgtccaagagtgggagaagcagctgctctccctctcctcctcctcctcactctccctcctccttttctcgttttggcaagggaccaagcccctttcccccttctttttccttttgcccgacaccgccggcgtcatcacctgccgccaccttggctgcacgcgtcgacgaccgccagctcgtcgcccttgcatcccttgactgccaatgtcggtttccctcctccaaaccaacctctcctcctcgcctataaagccgagtccctcctctcaatttccccgcttcagtctccaccgctgtagcgccattaccaccgaaccaccatcgccgccttgttgccgcttgtcccgctctcgtcgtcgtcgtccgtcgccgagcaccggaggagccggtgcgagcgtgaacgcgtgacgaggagctccgggcgccacctctccctctcttcttccccggcgcactcgcctcgacgccgcgccgcctcggcgtcatccgccgtgcgccgccgctcggtcgcgtgccgccatcggccttccacccctttccatccccaaatcgccgccgataccgttcccgcacgccggtgagctcctcgcccaaattctcgccatctgcatcatcttggataagccccgagccattcggttgctcgctcgtccccttaaacgtgccgccccgccgttgctctgcttcgccgccgccgcacccgcctgtgagccgccgtgggccctctcgccaatacctcgcgccaccaccgtccttgagctccctaggacctccccaaaccattccctagcgccgtcgccgcccagcacagcctcgccgccattgccgtccgctcccgaaggccgctgctcgtcgccagccctcctcagtgattctccgccccatccgacaccggaaacggattccttgaaccccggagatgctccaccccctttgaatcgaaccctcatcgtctcgtcgtgattcccctctttgctcgccggcgattgccgccgccacaatccgccggattccggccatcctccggcgaatccgagccgtcggctcgcttcgtctcgtctctccccttcccccggtgtgcttcctttttccattgaggtcgcgccttgctcctgcgaacgccgccgccgtccgccgtccatcccggccggcctcgtcttcgtccttccgccgacccgcgtggctgccgccacgtcggcgccacctcggcacgaccgagtcaacagacccggtcggcccctcccttccgtttccccctccgtgcgcgcggaccacggtgtgccatgcggctgcacgtgggcccgccgcgcctcgatccatccggtgcacccaaaaccctagcgcccgccccgcgtgcgccgcttccaccgtgcaccgtctcgccgacatatgggccccacccgggaccccgcgtggtgggctcggtccaccggaccgctccctcccccttccgcgcgccctaatgggccacctttcccgcgaccgcgccggcccaaatggcttggccgagcctccttcaacccttgggccgcgcccttgccgcccgaaaaagtctaatatacatccctccatccttttctttttcccgggatgtaataaatcctttttcctttgtcccataaatcaattccttattccaaaattccatgaatcattttccttggtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgatatctatttaatggcactaataattagtctaaataggatctttcttttggtcttttgtttaggttttcgattgtttgcgtatagttgcggttatcggattttcgtcgatcgcgggttttctcgaagattcgtgaagcttcgtgaagactttgagcaaggcaagtcaccctttgatcaattgctcctataattgaaaagtcattattatttcgtttgcaacttgcattattagaatcacacacttaacttgcttggcctcggtttgcatgccaaatcgacggacctacccagtagtcgcactaattttcgtaggtcatactaccctgattccttgtcgctccacccttgtggtacctcggtattcgtgctctctgagcgcgtataccaaatatcccacatacaccgttgtttgtcgaaaacttgggaaatgggtttgtgaagccatcaaaacccgacatgtggtgtcggtgtgtttgaaaataaaatgaattgtgaaaactcgcgatgcggaggttgtgcctatgtggcactgtcccgtattcgcatataaggaccgattcctatgggaaactcatcgaacataatcaaagtgcaaccacaaggtggaatgggacaccctggctaagtaactagtcggttcagggaaacctcgcatgccaatagttggggaacgccggggcggggtcgattggagccaacccgggttcctggtaaggcaagaatgcgaagcttgccaggttaccgatcgaggtggttggagtttgatttgtgaaaactgaaatggcctatatttatgtgaggatttgatccttctatgtggcatgaggtaaccctgggtcggcttgggaaaggctttgttgcgaacctccgataccgacgggtgttcgaaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacaaatctgtgtgattcgggatgtctgcgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattactaaatgagctgttgaaaaacatctcttaatgtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcacccttgctctatataaatatatatatatatagttccccggccctgaagagaagataaagtgaagtgaagattagggtttcgtcctggttcccagccgtcgcctgtggtgttgggtgttagaccgttggttccgctgctgctgctgttgttggtgttcgcctcgtccgtgtcgtcggttgtattctcgggctgtctgagctataacctaagttaaggtaaataagtcctctatttatcttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacaaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtctcacacttaataaatcaacctaatgcactgtagttcaggtgggttggttgggcctgttcaacgtggtgtagcgttgatcagtggagatttaaggttactttaattactcaactgttttactgttttgcttaataaaatgctttacaaccgcttttatgcaaatagccacaaaccgtccttgtgttccccttgcacgtctgcatcattggtgtggcttgctgagtacggtggttgtactcagccttgctattgttcccccttttcagaagtgtaatacttctgagttgaagacgaagttagaagaccaaggctcagaccccagttgagtcttgcctgtggagtggagctgaagccccgctaagatcgcctttttccgctgctgtcgttctgtttcggtgtgaggactaagtgcctcttctgtaagtattttacgctgtatttacgtttggaactgtatattacttgtcgttttgtgtaccctggctggtcctggacagggatttaatacgcaaaatagtctggaaatttgggctaaatttctgggcgtgacaatggagatccaatatgagcttaattcggatagggatccgaataggagtcctacgggccttgaaggcccgagtgatggatcctatatattcgtgaggggtctgactggcggagcattgcatcacgtgagaaaccctagccgtcactttcctccccgagcaaaaccctagctgcgcgcgggtgctagcacatctgcgcgtggcgttctgtccctgtacgtacgtgcggataccggtaaaggcgccgctggtttgcggtgctgatcggcgtgggagtacggtgaggagaacgcacgaggaggagaaggtcgagccggtgcgatcgactacttcctctacatcgacgcgcgctacttcgcgagagttccttcgacttctcagcgtcttcttccgctgcgcagcgtgtcgagtggtaacaatctatgatctaatacttgcatggttcctggtttacgtgatagaaaattttaatttttatactatcgtagcctatacgtatcccaacataactatcttgtaatacagcgcacaaatgtaactgttgcctgaatgtgctgtaaaattaaacaaagaaaaataatcgagaggattcttatgctccattgatattttacacttttattacctctctgagatttccgttataaacagaaaaatgactggctagctattggtcaccgtcattctcgtcatctcccattctcccgcaccttctcctatttattttccttcctcttttggttgagttaaggtcaatagtactttagggctaattataaactaattaggcttaaataatttatctcacgatttccatacaaactgtgcaattagttttttattttatctatatttaatgctctatgtatgtgtccaaagatataatgtgatgttttcagaaaaaaaaattagaaactaaacaaggccgaattgcaagagatggattttcatatacttctactggagtgtacgtacgtattgcaagctttcagccttcatgcattactcagcggactgcggtcagtgctcacaagcggctgaagccaaaatgttgagaggcctgcacaactagctagctactcaatccaacaagtttttttatccatccgtccaaaaaaactaatcactcctggaactacgaatctcgactattcatcgtcggtcacgtctccttctagtttaaggttttttttttatggaggaagtaggtgctctgctgatcaaggctgccgcttgcattgctaaagactgcagcgacgactcatctgaaagttgaaagtaccatcaaacgattttgtaaacagactactccttgcactgatcgatgtgctagcttcaccattcgatcgatgcgctctactattagcaggcagcaggtgttgtctactcaccctgtgaaaataaaaacaaatagactatggctgtgtttattttccttcgaacttccaaaaatttcgtcacatcaaatgtttgaacacatgcatgaaacattaaatgtggatgaaaaaaaacaaattgcacagtttatatgcaaattgcgagatgaattttttgagtctaattacatcatgatttgacaatgtggtgctacagtaaatatttgctaataacggattaattaggcttaatagatttgtctcgcagtttacagacggaatctgtaatttgttttattattagtctatgtttaatattttaattgtatgtccgtatactgctaggactgactactgttactgccagtctctcactcaagtgagatcagatcaggtgtttgcatggtccactccacgcacacatcgacgatctctccttgttttttactcctcctcagataatgttgcacatctatagtggagtggtatatgatcatctatctgcagcacctgcatatgtttgcacgtctcgacgtgcgtaaactcatctatggtctctcgattcattacagtggcagcaaccagctgcagtactacacatctggcccgccatgcaaggtgccatctaggagctagtactgtactgtatctaagttgaacaagctgctgctaccatgtggggaaatagttttaaaattgagagggtagctgaaaacaccatttaaatagttataaaagaatctttaaaaaattaacaatattcgtacaacatataaaatactactgtttcacaaaatcttaaaataaaaatccactcacacatagagaaataaaaaaagagatagaattaatactactcagccgtcgagcttgtccccgctggccgccgcctttctccccacccattgtcagctcccttgaaggtttgggttgagatgggaagaaaggagagaggtgaaagaagattgtgggctgacatgtggggccgtactaactcagccactatgtcaccaaaatcggagagcaatattgctttgggatcaaaaggtgactcagtttataccagattaatgatccattacctctggtattccggttcagggatggttttaaaactcgacgacaagataagggaccttaggtgaactttacttttttcgtagaagaaatatttccagcctgatgggcctgtgcgtatgacccataggccataggcagccggccgcagagcgacctcctccatccatcccgtctgccgccggcgccgatctccatcctgcgagcagagcagaggtggcgccgtcgccgcagaggagcgggagcatggccggaggcgggaggatgccgttgttgggatggtggctgatgctggtcggctccctccgcctcgcctccgtctggttcggcttcttcaacatctgggcgctccgtgttgccgtcttctcccaaactgacagtacgtgtgcttctcctctctctctctctctctatatatatatatatatatttacatccacctccctcctcccgccatatgcgtggcgcgagtcagtcatccaagcggagcgggtggatcttgcttgtaccagatcgaaacctgagagcccgtggatctggttcgggatcgtaccatgtagtgtgacacggtcgttaaatgcaaacttctacctcaaggctgacacctgagagcgtttttgaaacacatgagctgcaataggtctcaaaactgcatttctttttttttgtcctgtaaaaatttggttgggtttgtgagcttggaaatttgctcccctgctggataaatttgtctactaccttcagcttcagggccaagaggatggctttgctgccgttctgtcttggaaatcggagtttgattacagaactgaaccacagagctaaggttactagtcaaccatagaaatgtgcatgtgcaaattggttgtttatatgcctatctctgaaaggattgcgtattagtcatcgtcattaggttggtgagcttgatggcaacattcttttgtgacatttggttaattcctagttgcttccaagcggagatcatgtcggtcttcttattggaccgtacgagtatattatgaattctcagctgatctcagcttctttaggtaacctaagcagaattgttctgttttttttttaacttttccttcaaaaaaaaattgatgagattatataaagaaaaaatttattcctaggaaaatagataaagttgacagctattgctatgcttctacatcgtatcaatcactttgtgccttgtt

SEQ ID NO: 9296 - DNA, 730 bp, Oryza sativa
ttttccaataataacatagctaatacaacaacgtttgccttctttacatgcagtgactgaaatacatggtcgcacttttggggtctggacacttttgacctgtactctgtgctttctgtgtgcattcaacctggaaaacagacctctctatctggccactttcctgtccttcatctatgctcttggtcatttcctcaccgagtacctgatataccatactatggctgtggcaaatctgagcactgttggcttcttcgcaggtaatgaatttagttttgactgtgttgtttgctcagttcagccttctacttagttatcatgcaactataatgtcaactgatgatatcagctcaaacattcaatagtcaataataacagtcaaacaccatgcttgtacatacaccaaataggttgatgtctctggtgcttaagtagtggaagatttgttcagtacagctagcggtttcttgtgcatgcttactctttaaaatcacttagcattcacctttataacagttatcttgccatctcttcagttttatcttgtaatactcaaatgacatgcttgaagctcattggactacataaggaggttgaaaattatttcgtttcatgcaccaagtagttcgcctatatgatttatcatgttactcctgctgagctaagctgatctgtggagcaacagaaaaaaaaaacaattatgatttatgttacttcggttagaaataga

SEQ ID NO: 9297 - DNA, 223 bp, Oryza sativa
attcgactcgccagcgtaaatcagtagctgcttggcgaccttggtcgacccggtaaacaccaaggtatccacgtccatgtgcagggccaaggccttgccgacggtatggccgtagcctggcagcacattcagcactccggccgggattcctgcctcgatcgccagtttagcgatgcggatggccgtcagaggtgatttctcggaaggcttgagtactaccgag

SEQ ID NO: 9298 - DNA, 411 bp, Oryza sativa
ccccgcgccggtgctcagccgtgcgctggtgcccaacgtgatgtggatctggcgcaaggtggacaatccgctcgatccgcggcgcggcctggtcgcccagttccaggtcggcggcggcgccaaggcggcgctgtccgaccagaatttcgtccgcgtgcacagccgcagccaggtgtggctgccgctcggcgcgcgcgacaccctgagcctgcgggccgaagccggctacacggtggccgattcgcgccagcacattccgcaggattacctgttccgtgccggcggcaccggcagcgtgcgcggttacgcctaccagagcctgggggtcaaggaaggcgacgccaccgtcggcggccgctacctggccaccctgtccgccgaggccacgcactggctgagccaggactgggg

SEQ ID NO: 9299 - DNA, 659 bp, Oryza sativa
acgaactctaagacgtaatatgtgtatggcatgtgggaccggatattgatagtatatatagtaagcaactattatatgaattggctattagattgactatagatgaattgaagttagcagtggactatactattaaacttgctctaattaatttcctactacaacagtttaattaatatcctggtcatccaaaagcccaaacaacacttctacttatacagtgaagagtgaagagtacataacacttgtgaggcccagcctaatgcagttgtttgtagctgctgctgcctccttttgctttccaacgagacagtcaagaagacgaagagaggtctccatgtcgagcttagctttatatacgcacccgtcgccatccacaccccaccattttcatcctgattcctgattcttcttcacacagaatatataattctgcttcttcttcagattgagagagtgagagagagagaattcatgggcgagagctgctacgtcaggaggctctcggacctgctccaggagcagcaggagcccttcctcctcgccggcggagcttccctcgccgacgcatgcaggcgccgcctgctcgccttctgccaccgccgcgccgccgtcagcaacaagagccgcgcattggggggcttgggcgccgccgtctt

SEQ ID NO: 9300 - DNA, 704 bp, Oryza sativa
tcctgcagccccttcggcaaaatcctcggcgacatccaggaatccctcgcatcgctcaacaccaagcaggcggagacgcaagcagccgtggtgaagttggatgcgggagtgagtggatggagacctcaagtggaatcagcaattcaggggttgcgcgaggaagtcagcgaacttcgtcagtaactcgacctcgtcggcaaatctcagcaatctgcaccggctgcgtcttccccttgagtcccatcgacgggtgaggaaaggaaggcgccgctgctgccgactccatcggaggcgaaggcggcgcggcttccgacgccgccgacttccacccaactcgccgcagccgaaggaggaagcaaatgggctgcaggccaccacgttcagatgaatttccggggaaggacaccggtggtcagttcgactcagggtccagccccgggcaagggtacgattgatttcaccccgaattttacttctaaatttgatgggggaggttgggagtctggggaatttgattctgagcatggtgatagacagtacaatcatcgggtgcctaagttagacttcccaaaatttgatggttcagactctcaggagtggaggatgaagtgtgagcactattttgatgttaacaatactttcccggggttatgggtgaggatagcaaccatttacttcctaggacgagcagcatcttggttgag

SEQ ID NO: 9301 - DNA, 916 bp, Oryza sativa
ggccgaaatgtaggcccaacatgtacaccgggccgaacacagcgagttgccgtctcacccgcatgcttcctgggccaaaaggtgatctggtaatcttcactttgcaggtgtcttcaaatgctgtcccaaaaaagcggaaatcctaatcggcgatcgatcgcctgggacgggggtagcgatcaattcccctcccccctccctccctctactggtttccttttttggcaccgcattactttcctattttagtaaatttatgtacctaaagtttatacacctcaagtttacacatctaaagtttagagacccaaagtttgcacatataaagttagagaccaaaagtttatatatccgattcaaatttgaatttgaattcaatattttttatatatagtatttctgtacatctaaagtttatagacctaaagtttatagatccaaagtttataagttaaaagtttacatacccgattcaaatttgaatttgaattatatctgattcaaatttgaatttgaattcaaatattttctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttatatacatctaaagtttatacatctaaaatttatagacccaaagtttataagtcaaaagtttacatacccgattcaaattttttgtatatagtatttctatacataaatttttgtaactctttgtttttttaaaaaaaaattgtgtggtatactgtagtaggaagagaagaaggggagaagaaaggggggagaggagggaggaatgtatcgagtatagggggagggg

SEQ ID NO: 9302 - DNA, 6066 bp, Oryza sativa
aaatgctttatctacttaaattatgagctactactaatattaacatgggactgtaatgtaaaataataaaactaatttattttttaccaaaagagaaagggtgtaccgaccagggcagcattggcccacgtttgtctctacaagcccaatgatatagcgaggaggatgacatttgaaccttttttggctttagttgtctattttaaatcataaaaataaagaataaaaacgacatcatcataaagtaaaagtagaagacatcaacatcaggaggcgaatgtaaaaaagatactagtttcggtgtaacttacatacatttattttgcatacttttctgctctttcagttctctctctatctctgtcttttgtcctctccaaataaacaggacctaaagcgacatgagccgtgcaataagcaaaaggagtagattacacatcacgccaccccggatttcccttcgaaaccaaccaaaacctcaccaaattaacttgataaaccggcagaaaaaaatgagaggaataggcatcggctggtcaagtaatgtttaatttgagccaccaaaaggtgcacttcctctctcagcaagagtcccgtgctgtctgatggctcgagaacctaagatcgtgaacctacgtactgcaaagagatgatatgattcgggaccaagttaatatcggttcacattttcatgcactcgggaatagattatcttttgccaccaaaaggtacttagatgacataaaggtaggcacactgattaagcaaaagttccggatcacattacattattgattgcctacgaactttttaagatgaagttattcatgcacagactgtgcatgaataactgtgcagcacagtcctctctcttcactgctcactgccccttaggcaggtaacactcctagtgacagcgagcgcgaaatgtgaatcgcttaaatagcctggaataatcaatggtgcgcccattgttattgctcaattagtcattaggcatatcaccaaccttttcttggatcaaattaagttagagttggttatctttgtctgggttttcttcagtcgttcagtgccgttctagtacaattatcaatcttgtgacgcacggtctgctgcttgattgagatccacatcagggagggctaacttttcctgaatcgctgatcagaagaaaatgaccttttccgcaactaccgccgaccacgggctctgatgatctttcgggtgtcctgtctgaagaaggtgcgcctaacaccctcgagacgacgatcatcgtgttgattatacttcttgaattaaactttgttcggtgacctgtttttgtagccccggtgtttattaataggccttggttactgcggttgttattcagtatattcacgcgcttctaattttactcctctaagcgaactgaaagttggttgattgataacccaagatgaactacaggcctatagaattcagccgtcatgattatgcttgctcatccgcttcttgctttaccacccagcaatggctaatgtcatcattagacgagagctctattagaattatgatcactcgtctgcacggtagagctcacccacgcttgcttgcttgcactgtatatgtggtcacgccccatgtaataatcctagtcacagagtgatatcgtaccatcacgcagacaagaacgtaacagttggcatatgctgctacaaaccaaaaattgcatcggcatctcttgggaagaaaacaagtaccagcactatataatcatcatcatgccagtaccgcatatttaggagcaacttgtatataaaaccagcaggaagcatacatgcagcgcagtagtgcacggtacggagtgctcgtttactcctaccaaccaggcaaccggagccggcagtcacggccttgaagacaaaggggacggggacatccccacggcctgggctaggtgcgcgcggtggcagcagaaaccaatgctgcacccggctcacctacctaccgagtaccgacctggcgattccccgtcccactcgccatcggccgcgtcacagtccaaagtccaaacccgtcgcgcggggcgctcacgccatgcatgcatcagcccaccccgcggctccgcgcgcgcgcggggtggcacgcgatttctcgatggccaccgcgagcaaatcgcggaaaaggtggcgaggcgacgcgccccgggttgggttgggtggggtgggttggtggtgcggtgcaacgggcggcagaggtggggacggacgggcgcccgggtccagccttcactggcgagcggtgaatggggtggggtggacaccgagccggttaataattttcgcgccatccgcccgaccacggtggacgcgagcaggaggggtgatgccgttgtggtggtggatgagatcggagcaccggcacggcgcgggaagcgacggcagcgaggcgaggagagcggtgcaagcaacacgggcagcggctccgaggatggggggcggccccgccatgtggcgtccgggaggggtctccacatcagttggctctgctctctgccctgcctcggtctgcaggttacagcgagaggcccaccgggagaggacccacggctcctcgcgctttttccctccttctggagccaaaaaaccccaaaagggaggcacatccctagctccccaagggccacagaccttaacacggcgtacatgttatattagggggcaaaacatgcataccagccctcggttatcctattctgcccgtggaaaaaaaaaacaaaaatggttatgtatattagctcctcggtttgccctattccgcttgtagagaaaaaagagagagagaaggtaaggcgacttaaattggtgtggcagataatattatcacgtcatgaactattggtaaagacacatattagctccttggttatctatttcgctcgcagagacaaggaaaggttcatccaaaacttgccgaaacaagaagttattgtcaagttagattggtgtgaccgggcaatattgtcatgccatgaatcccactctttatatattctgatcatagaaaaaaggagggttcatccaaaacttattgaaatgacaagttataatggtgtggcagaacaatattatcacgccatcagtagtcagagatgcatatcagcccattgatttgcctattctatgagtagaaaaaaaaggaagatacatccaaaacttactaaatgacaagttagaatggcatggcaagacaatattaccacaccatgagccgttggtgtgataacattatctgccacgttaaaatttttgtcatgccatcactttttactggtgtgacaatattgtcattgcacactagtttaagttgcgtggaaaaatgttcaaatttcataagcttttagggctttatttttaaattttaaaagattaaaaaacaatcttaaaaaatcaaggattcacattaatttgccacagccagttcagtttttgcaggagaaagttatttttccccgttctaaacagacctaaattgcaccctagtaagaagtaagaatttctaagtaccatgttgaacataaagaagtactagtactatagtactactacaatggttaagttcattatagcatgtgtttcaaaactccgaaatccaaatacattagtcgtcaacaattcgatttgagcaacttgtgtccttttaaacacaagcaacggttgtcataggttctgatctcttccacggttggacctaagatctaccgcttgatatagacgcagtttataattcaagattccattatgacctatacgtgtcaacgagacatcgactctcctctgttttttttttttttttttttttttttgagaacacgagacatcgactggactgtttgtatttggaaagaagaaaatctcgaagccgtaaaatgtaatatcagagttactggagggtctgagcgcaatcaacggaaagtttttgtgcgcatatgcttttctcttctctctctctctctttcttctgacttcttttgtgcttcttccaagcttccttccagtcctcgctctcgtcctccctccgtcactcgcagcgcagaccaaggaaggcttctcgcctctcgccttcgcctcgcttcgcttccaagtcccaatgccgacgcaacagcttacctcacgcggcgcgccacgcgcttgagaggggccgccaaccgcatggcggcgccgggcctggacgaggtcatggcgttcctcaccgaccacgggttcgcgggcgccgcctccgcgctccgcgacgacgtcctcgcccgcgccgcgtccgccgccggggacgccggctccgattccgatgccgcattagatccccagctcccgcccctccggttgccggcgtccacgtccggaggcggtggggcgccggcggcgccgcctgcaagccctggctccagctctgactcggcgtcgtcctctgccttcgtcagcatgcgctcctcgccctcaggtagttaggggatcagggcacaaggctgaatttttttttttcatcatctctcagcgttaaacccatatcttctcgttttccgaggtcgtcagttatgtcgcgcgaaatctcgatctgtgcgccgatgtttttggcggctatggttggctttgggtccaattcgaacctgctggatcaaagccagcatatctctgtgcatatgttcatggaggaaaattgtgatcttttgatctagtagggtgctggttaaaccccttcccctgggttttgtacaccaatgatactgcttgtcgttaaattctgatttctcagtatagttgagtgttctaatttgcggatttgtgggtgtttaagtcacgattttggtcctaaatttgatatattttgtttgtgagattagggatgctgaatccatatggagtctggtcgccgcggcactcggacacgtcgtcatcggagatggagtttggcacagcgcgtcagtacgacgccaccgacttctttttccaagaaggttggctttacgacgaccatctcttccatagcaagtcggagctggacgacgacaatggagaagacaaagaggaggacaagtttgttcttggtgtccacgatggctcagggaggatagagatgggagtgcttagtgccggtgatgaccaccgtcatgaacatgttggcaatgacggctgtgagggatgtgctgaggtgtacacatgttcatcaccgctctgcggatgctgtggtgagggactgaagaacggggggctagaggtggtgaaggattctagctccactgtctatgggaggtaccagatcattgatgaccagacagagatacttgatgagtgtggcatggatgggtttcagttgaagcaccctgcggatgttgtgcttgagtgtcatttgccaagagattctggggaaggagatgagcgatcggagctgagtgtagtggagaaggagcttcaaatgctcagttcatttggtactagggttgatgcagatgcttttacaagtaagtacttctgaaatcttaaactttctgcttgatttcacccttcaatattagtactccactaaatacagtatttgtactaattttcaacattaaccctctttgctccgatgaagatattatgaatttatttattgaagtgggagaacagggttgaattacagcattaaagagtttggatactgttaggcaccgtttggatgccagaattgaattgtgtagttatcccaaaaaaaaaaagaattgaattgtgtttgtggaaatggtggtccaattcaaatttcaactataattggtgttgggatccaattcaacttgaattgtgtatgagtggtgcagacaatgctgaatgagagatgttttgttactgttgtaaactgaaatttgctgttaaatatgcacagagctaaaaaaaaatggtgcattttagtggtaacctcttccagaaacattactgctgttatacgattatgcttcacatgggttttctctgtatattagaagaattgaaaattttcttctgctcttcaatataatatgtaacttggttttggtaacactacaga

SEQ ID NO: 9303 - DNA, 655 bp, Oryza sativa
aacaggttcacaatcacttcttgtttctcccttctcttcttccatttttggttgctaaatgatacttccaagttaattcttatgctcatatagcatgtcttcactgcaggaccggctttgaagtaagcaaagatttccccattgtcataaattcagttatagcaggaagatattatgtcactgaataccttggctcagctgcattcagtaaagttgtgcaagcacatgatcttcagacaggaactgatgtttgccttaaaataattaaaaatgataaggatttctttgatcagagtctggatgagatcaagcttctgaagtttgtgaacaaatacgatccattagatgagtatcatgtgttgcgtctctatgactatttttatcatcaggtatatcacttaagaaataaagttgactaagatactccctttgcattgatgttatgctgcatactttttggctattcggaagctaaggaagtttgaaagggatatattgttggtctttggcaactttgaaaaggatctatgatggctaaaagcaatatagcttcttattttcagttgatttcttaaattgcttgcatgcttgtttaattgtagaaaaatcatagaatttattagtactttattttttgcggttgcaaaatcataga

SEQ ID NO: 9304 - DNA, 11488 bp, Oryza sativa
attggagaaaggcgtcccggcattactctagaggaagattcaacagccttagcatgaagcttataaaggatgggtccgtaaaactggtcaatgagtgaaggcctaagggtgataattttatgcgtgtagtttaggcctttgggctcgctaagcagaaaccctttctccttttcttctcatgattattttgcgtggaaatttagataggtggaacctcccgattggcttacctgtgtaattagctcatctgacaagcacgcgccgaatgatataccaaatgctgtgcgcctgcttagccctcgtggccttgttcctatggggtacctgatgccaagtgttgtacaatgttttgccgtgttcaaatgcaatttgttcatttggggtgctatctagcctgtcgcaaaattcaatgtgctcgtggaggcatcgagtgcgtgctatcgactgaacgaaagttacgaggcagtgttcatctagtacaccaggtactaatatcgaattctgttctatctgcccccaagttgttctgacccgcgatgctttcgtaatcaagaagtctgagatcgatgccgctcgaattcaaccacgcgccggaatttttcccgtggtaatgctacatcatcagaaatgcatcactgctggagagcaccaccgggcgcatcaaccgtggagcataattaagataaggttaatgctgccaaattcagggaacaagattaaaccaggacgaacacggctctattattttaataggcaccctctaaaccccacggtcaaacctagcaacaggtgatgacgcatcgatcccaaattcccaattcgatctcttgctgctccatccgccggaataaaaacgcaaaatcctcgtgcgcgggtggcccttcctttccaccagggcataacgtgtcttcgttttcgcttctcccaaacaaaagcgaaatcaaatcaactgcctgcattgccttgtggcgctggttccgccgcctaattgcacagtcgcaccgcatcccatgccaagtatcgtggaatgcccgcgcagcacatacgccgtcgtcagaaaagcggccgcgaagccgtcaattcggtcgctgtaggctgtagcagtggcacggtcagcccccatcacgacgaacccacagtcccacacgcgggccactgtcacagtcactccactgcactccactccgccgagcagcgcgggccgatgtcacggtcgaatcatcagcgggaaagcgggagcccgcgacgtgcacgtagcacgaccggggcctcggccgtggcccaacaacgcaagcgcggaagcgggtggcgccgagaccgacacgcgaggagaggaggccgagagatcgacagccgtccatgcggcgggccgtcaaatctgtccgttgcacgcagctaggagtactagcatactatacctgtcggcagatatcgcgctcgtgcgcatttccgttcccacccgcggctggctgcgccgcaatcgcgccgtgccgccgcacaccctgctgcccctcggtgtgctctgcaccacccgtgaagccaaaaaggccaaagccaaagccaaagccacggggcgcagcgaatatctaatacacgtttcggcgtttcgctcgatcggtactagtaccggggggaatattatatctgattacgtttcggcgcgtttcgctctggtcgagctgcggcggaggcggacgtctgacggcctccggatgtgacgtgataaaacgaaggcgtactccgtggtggaaagccgtggtggaggttaacccgtgggcatgcatgccgacaacgagcggtttcgattggacaccatgtggcggcacggccgggccggcctgatcctcccctgtgcgatgtgcaagcggccgggcggtgtttttgcccgggcgggtgtctatccgaatactacatttacgtattgattgatgggggacacgcagtcgaaacgtggtaggccaggacgacggtcgctggctacgcccctttaaatcatatgattattgagaaaacgtaggatgattttgatgagaatatagatgtaaaatagaagattgtagaacgcagaaaaacacaagaataaccgtttgattgaaccgttgaaaaaacacaagaattgaataagagatagatgcaggaattggttgaagttcttgctaaatttcctctaaaatttctataggacagtctattccatatgaatattaaaggattggatatggttcaatcctttgttttaaatggcttcataggaaattttcctatatgattaaaatcctctaaaatttctatatttttcctccaaatcaaatgggccctacaatttgtagtaaaatttaatacaaaaaattcaaaatttatataactagttagatacagtaaaaccgttcactaccgaagaaaaaaaattgtaatcgagacattattttattatttctaagaaaaagggaaagagaaattttgaaacaacaagattaccgatagtgtgagccgcatctaaccctcatttcccaagcgcagctcaccagcgaggcgatgcacaatctatgaggaagaagatccattcaccttcactccacaatggctcaatcgatgctttttattaaactcgtgtacttgaatccaccctcttgcactgtcgattgtgctcagtaccatcgaaaccgccgttgtcacctcctatagctaggcttagcactttggatgcggatccaggggagatagtgtggctaggtccaattcaaaccagactcaaacggggtagatgcaactggcaccagaggcaatattactttatttagagtgaaatgtaatttggactatattttatcgtccaattttcactttggatcacccttgaatcaatcttttcactttggattggataactttgtaattttgtttttggtttggaccactccaaacaacttcaacattcatcagcatcctcaatcaaatcggttttgatacactagtaaacttcctgtcaatatgcaggccatatcttcaccagaataaagggtatgtgtgaatagtaaagagagttagatgatccaaactgaaaaaaataacaaagttatccggtctaaagtaaaaagattggtttaaggttgatccaaagcgaaactttgacaataaaaggtgacacaaactgtagtttactctcctttttaaattctcccccctttttacccaaaacgatacaataatatcttcattttcttcaatcaatcacatattttttttaagtgtccttcaatattgacacgttcttgcggtattctccagccaattacacatatttttaatatcaagtagcaaccttaccaaaaaaaaacaaagtaagcgagaccagcttaggcggcgttcgacttgctcaataggtttggctgacctggacacgcaaaaggaggcgatcattatctagtgattaattaaatattagcttaaaagatagatttatttattttataaagaaacttatgtataaaaaaaatttatacgaaatacatcgttcgacagttcggatcggaatcgtgcttaccgcaaatacaaagtagcacaatccttaagttagtagcctttggtctgagtgtccaatggatatcaccacgagattgatttccgaccgtaggattgccaagatctattcgatggtatgccactatgcaacaatctttcttcgtaggaacacaatttagcggcggagccagggcccggctagctagcctcggcaggtgcccgggctccgcaggatgtagccgtactatgaagtagttctaatggatgtgagatcagtggatcagcacatttactagcaaaatgactagctataagtacatataatgtctagtactccctccgtcccataatataatggattttgggtggatgtggaatggaggaagtattcaacattaacaattaacgagtttcatttcatcgatataatttcgcacatttgttatcttcttcataaattagaattcgatctatgctaaatcgtgcacgtgtttgtatgaatttaattgtagtttttctctattattagatttgctcaggttagaaaaatttagggataattgcaaatatgccactgatttcaacccctaactcggaaaagccattataaatacccaaactgcaaattagccaccaaagttagttcccgttactttcgtttgccatcgccacctgaattggtacaattaaaaggccaaaaataattcataaaactaacttaaaagataagaagcatgacaagaccatcttgcccctaaccggaaaagatcctcgctggctcgccgccctctcacttgcaggcatgtgggcgaatggggatggacaatcgatgggagggcgcgctgacgggcggcgtgtcggcggacgacgggaggacatgtggccaggcggacagcggacggcgaccagcgtgcatgtcggcggtggttggagtccttgcgacgacgggcaacggggtagggaaaatctcaccttttttgggtaatcttgccggaggtgcgaggaagtcgacggcagccgccgcaatagcagcagcagcacgttgcaacggaagcagcaacgctcgcggctgcagcacgagcacgcggcagcagcagctcactacaggcctgcagcgagagcagcagctgcaacaactccctacgatagcagcagcaagccagcaaggtggtagggctgcagcaagagcagcaacaatggcgggcgcccagagacggcagcagcagggaggggcatccttgtcctattttttgtgagaacccatcttttaacggtgttattcccagccgtgaatctaatggcaagtatcatgggttccaatcgttttttatggcaagcatgcaattacgttttttataatggcaaattcacaataccgattcaaatcagtggcaaatatgcaattggcccaaaaatttatagatctgccactaaacacaacaatacactcgtacgtaccaaaagtacgacaagcattcttctccagctgctgcctgcctcacacattgcctgccgctgcttttctgtttcacgctttatcccccaaaccttttgtccttctcatcatcgttcattaagagcccacacctcattgcggccatgcatcatgcatgcatatgaagttgccccatgcagtgaccaccatataatataagtcggcacttggcacttgcagttggctgtccaaattaagctccctaccacacatgtacacatcaccatcagcgacggaaagctacaccacatcaattaattaatgtaactttcacttgtcccatgcggggatgtgatatagacgacgaccgacaaagaacacgacacgagccgaactagctaatcatcattttaacagattggaggtagcaaatgggcttagattaagggcgccgcatgcatatcctcagcaagtgctcctccggctataaaatatctaacgtttagaacaatatttatctaaaaattaacaatatttctcaaataccctagtttattcaaaacaaagaaaacaatatatagatttatcatgtagttattaaatttattaattaaactcattcaaatataaattaattgtcaaaactgattattatcttaagagtcatatttgtgatgggagggagtaggactaaaacgtactactgctgtgtaacaatgacaatgtttactggcatgaccatgcatcaatgggcaatcaatcacacacactgacactgtgacacacaagtgaatcagacacctggagtatgttctttgcacagaaacgtttactcttttcttcagagtaaatgtacgtcatttgactttcgtcttcagagtgtgactgatcacaatttcttttattaaaacaagtttaccaaatctgataaacagtagtatatggtgtaataaaatcacattatttgtcaagacatatctatgtatgccgtgtttatgttttcaaattaattgttttaatttttaaatttttagtgattagagttttaaaagtttgaagggagaaaagtcagaacatttatttatcaccaagagagtaatatctctatcgaggacgtatattatttctagcaagttttaaaatcctaattaaaactagaaaaatacttatttcataaaaccacccttattaggaaaccatgtacgtgatgtcccaatatagggcatgtgcgacgactagcccgattttaaagtgttctagtagattatagatgaaactgtgaattgatgaaaaatatcgaggacacgaacaaatgaattaaatattaaaacttggacaagttaattttaacatttttttctaagaaatatcggtgaagaaagtcttcgcatacattgtactcccaccattttatagtgtaaagtgttttgttttttttttcagaattatttttttatctttgaccatatttatataaaaaagcaacatatacattatctgattagttttaaatatactattaaagatgtcttgatagtgtatttatttgatattatatgttaattatcttttaaaaagtttaacttctgataaaactaaaacaccttacgatatgcgatatggaaaggatggagtataatttaggaatatgaaaaatgttcccacaataatccataatccgttagttcaaaagaaatgaagaaatgcccctaaattaatgagatagtttaaggagtactctgcattcatagccatgggcagacccaagcatggtccgagactaaaggagcattgagtctatgtaaatttccaccatactagcacaaatacaatctaaacaatgatggtgacctagacaatggtccgcgcgccccatccacaacaattgttctacaatgaccttgtcttgttgcaatattttgatctttctacaacaaaaggacgaataataccttatgctaaaagcgaatcaagatgaactactttcaaaatatcaggcgtgcatgcattccctaattgaaaacacacacacacatgtgtacaatccacatgcgtttggtagcccctcttcccaacccatcttcctcgttttccgcgcgcacgctttttaaactgctaaacggtccattttttacaaaaagtttctatacgaaagttgctttaaaaaaattaaattaatctatttttgaaaaaaagcaaatacttaattaatcaccctctaatcgctactccgttttctgtgcgggcacttagtgttgggaaccagggttccgaacacacagttctgaactccacgactgagataacatgtcgagctccctcattctgttgatacagtgtgtgacttacccctcaatcctttatcatccatcaattcgcacacctccttagtcctaactatttagggtcaaatcttgccacaaaccagccaacacttgcattactactgatctttcatatccaagtccttatcttcccaaatcacatggataatatctaataaaagggtaaacagtacaaactttccgaaatttactcataactatagtaaattagttgatatttttttttcaaattgggtccccctattgccagatgcatgccacacatgagcttcacagttgagtatatatttttcacaggtaaatatggtgatttggatacatcgagagtgagcataatgcaacttttcttaaaatttattccccttatttttttagtatatgttacaaaacttaagatatttttttataaaattatcatgaaaacaacaaagataaattatattatcataatactacacatcttgcttcaaatatatcagaaaactctagatatacttgaagtgagtgtatgaccacaaatatagtaccaattttatggaactacatgattaaatgttaagaaatctacacattgctaccaacaaataaatgattctacaaattgtcttagacgaatgcaagttctacaaaatattaccatacaagtgttgttatcccttttggcactacctttaggttttcatccatagatctacgttatgtctccccaaaagatctttttgcccttttaaaggcctccattaagataattatgtagaatctccatatgaaaatatgcacatatttttgctattcaattatttatgatattcttaagggtaatttgggaatttattattatggaatttaccaaattctaggggtaaaacgatcctcttagacgacctaacaaagatctatggatggtagttgcaaaaagaaaagaatgcttgtacaatggtattttattgaacttgtgttcattgatggcagttttaagaactggtcgcttatcaatgtcaaaatttagaatttgcctgaaatgttccattagaaaagaagcactaggaaactactcttaaatacttataatggctttgtggaagtctccacggttaatttgatgtccactccctccgtcctcaaatgtaagtattttttaaaagtattttaaaaataaagaaaataattaaattaaatagtagaagattgtgattagtcgagaaattaaacatgagatggtttgattggttgagatggggggaggtttagagtgtcagtgccatggataagacctacataacatacctgtattaggctcgacagaacctaccgtatatgaagtcttatacggaatcaagccacatatacggaaagtgtttcagataaggaaagagaagcaaactcctacttgagcaagacaaggactatttggatcgtatccatatttggttccctagatctacttggacaagggacatctgagagtataaatacaagactccttaggaggagagcggatatataggctaggacagatcaagacaggccaacaacatatgcgagggaaagcctagacaaacccactatggagccacagataccgacaagaggaacctagcgctgcctccaaatatcgccgagttcatattcgtggaagctgactacgctagccgtcgattacatgtgagagctccatgccgctaaaccgacaaagactatattaggttgtcccaaatattgtgctcatgcgatattgatatataaaggcaacatcggattcggtcaacaggagtaaggctattacctgttagttaaagggttaaagggtccgaatctgcataaaaatcgccgtctctcatctctttacctcaatctcgcgtataccattatatcaactattcctatactctacaaataacataggcgggtatagtccgtcaacaatgagatatgtatattttaggataatttgaactctagaaatacgtatattttgggatagatggagtacactatttagggtttatttttcaatggaatatttacgcttaaatatgtagattgtgatatattagtagttttatgatattgtcacttaatgtgtagttttatcgaagttgttaattttactccatgcattttttgtgttaccattctctctttatttagaaacacaaaatattttccaattcctgccggccgccggccaccggccacaagcatagattactacatggttttatccatatatatagactttgaaaatgttgtttgtgctgaataattgtgcgacacgactctttaaaaccaaaaacgcgtacatatattcaacgcagtcctgtgcatcgtgcacatattcatcaggaaactaattaattgctacaccgtttgacttcacttcttaaactaataaaaagatggcggcagaaatgtttgcctcgcacgacactatgggtgtgtttagataaaaaaaaattggctaaaaatatcacatcaaatatttagacacatgcatagagcattaaatgtggacgaaaaaaaccaattgcacagtttgcatgtaaattgtgagacaaatcttttgagctaattacgctatgatttaacaatgtgatgctatagtaaaaatttcttaataacggattaattaggcttaataaatttatctcgcagtttacagatggaatctgtaatttgttttgttattagtctacgtttaatactttaaacgtgtgcatgtatacttaaaaaatttttggctaaaaactaaacacggcctatgatttgagctgggaattttttttttaaggaactatagtaagctactgagtttccgtgcctaactttgatcatccgtcttatttgaaacttttaaaaaaatttaaaaacataagtcacgtataaagtactattcatgttttatcatctcataataacaaaaatattaattaaaaaaatttaaataagacgaacaattaaagttgggtatagaaacttatggttgcatttaaaatgggatggagggagtagctgaaaaatgataggagcacgtatatcaaatcaatcgcttcatgatgccccgacctgtaaaacaacatctgaccactacacagctcccgtggacggtggaccttcccactaaccccaattcactcatgttgtagtatccgtatgtgctcgccacatccgatccatcgattcgtggaattctcgagcgccggagagagacggctcttcttcgtggtagtgccagtacgtctcacagcccagtccagcttcgctgtctccccactgttcagcgtcaaagcacacacacaaaagatcccgatcgatttatctcaccaaaaaacacgttttgttttaattcagtagctacacgtactactagcttttgtatggcccagcatggtatcctgcccacggccaaaccccagatcgatcgaccatctgaatgacgaattgttattgtcctctggaagagacaaaattaagctaagcaacaacatcaacgaccttccaaatagaattaattcacttgaccctttttgtatatctcctctctctcttggtctccccgaccttatctggctctatatatacccccatctctgcaacaaagtctccaactccaacaaggcaaggaggaagagctgaggcatactccgaacccagccagagagctagctcagtgagcagtacacagtacactccccgggttatctctcccagcacgtatgtttatgtttaattcatttcctccatttatactctgtgcgcgctgcaaacgtagtacgtgtatgttctagctatagctcttgtcttgtgcgtgcgtgctgctcgtgttctcgtacgtgcgcccgcgtggttcaatagcgcctaattgatgggtgaacactggtatagtacgtacactagcgtggggcgtgacggcgtgtgccgatgtgcgcgcgcgtccatgcttggacgagtcgtcgtactctgccattaatcccgcccggccatctcgtgctagatctccgcgttcccgatcgatttcacgttcccgtgtttttgaggcgcggagcgcaccggagcgcgcgcgtcgtgcatgcatgtgcatgtgtacgcgcggcggccggcagggccggccgccttcttcgtagtaagcacacgtttgcttatcttgtgttctctttactgttgcataggccagggctgcaggaat

SEQ ID NO: 9305 - DNA, 1239 bp, Oryza sativa
ggcgccagcattccggtggtcgacctcggcaacggcggcgacgacgagggcggccagctcgcggaggccgtggcggcggcgtgccggggctggggcttcttccaggtggtaaaccacggggtgcggccggagctgatgcgcgcggcgcgggaggcgtggcacggcttcttccgcctgccgctccaggagaagcagaagtacgccaactcgccgcggacgtacgaggggtacggcagccggcttggcgtcgagaagggcgccatcctcgactggggagactactacttcctcgtcctctcgccggacgccgccaagagcccggccaaatactggccggccaatcccggcatctgcaagtaagcactagcttagatcacctcgatctctttgcaagtactgtacctgcatattcgccttttttccttcgagagatatttctcatttagctttgcccatgtgcatgcatgttttacctgcagaggttcttgtgcgttcttggtacgtcgaatttctttttcaaaagggtgggagtactgatcaaatcgtgcatatatatttgactgttacactgaatttataaatttccataatgtgcatctcagaattatttaaattagtgtacggcctgccgtaatttaaattgtttggtaaggcgagaacgttcattttgctccatatatatatgttctgtgtatacgttcattatacactgattctaacaaaatttagggcacatttattttttgctaataaatcttaccagatcaaccctatcaactttttataccggtgtggtcgtgatgatatatatatatatatatataggagcttgtttggccaaaattccgtcacttttttttcgacaaaccaaacatacctttagtttcattagggtttagatattattcatttatttatctattagaacattaataatggcatctttgattagtgatgtactaataataagtactactccacacgccaaaattaattagaagcatggcattcattaattaaaaatatgacaaaattgaacagttcacacgctaaaaaactaacggtacagtacatatttaatttactatcgtactgcatacataaatcaacatccattcggtcagcttttacctgagaacagtgtactgattgtcatgaacagagtaacttaactgcctggagcatccgttgatttccttttcgttctatgattgttgtacctttttctctacttgcact

SEQ ID NO: 9306 - DNA, 7666 bp, Oryza sativa
attcctgcagccctttagaagccttggtatatttgcatcatttaaggatcattcattgtgacctgaagcctgaaaacatccttatcaagagctacagcagatgtgaaattaaggttatcgatcttggaagtagttgcttcttgacagacaacttatgtctctatgtacaatcacggtcatatcgagctcctgaggtcattctggggcttccttatgatcagaggattgatatttggtctcttggttgcatccttgcggaactctacactggtgaggtaagaagcttctgtaccttgctaatccttctttttggacacgtgctgaccttttagctgtgttaaacccatagtggcctgttgtcatacagcacatagaattttatggagatttcaacacactgcattaatagtgaagtgctgtgttggcatgtttgataccttctttcttgtctaaatgctatgcaacatatagctccaaacagaaaatagagatcaaacttctgtgccagaattatttttttttgaacgaatgcctgagtaaattttggggcacaaggactggctttaataaataaagacaaataagaacgttttacatggaaacgaataatgtgcttcaagttgttttgttgttatccatatggaaacaaagttgttttaaaatttaaaaatgctaatcgtctaattataattcctaactggtacacataacaggtactatttcctaatgaaccagtgcccataatgcttgctcaaatgattgggataattggcccaattgacatggaaatgcttgccctgggagaggagacgcaaaagtatttcactgatgattacgaccttttcaccaagaatgaggtacactattcttagtgctagtggaagtagcctttcctgtgaccactcgaatttcatcatgtccatctctctctgtggactgtgcgagttataacacattgaacactgaactcattttgttgtttacctcatttctattcaggaaacagatcaattcgagtatttgatcccagaaaagtcttctctgcagcacacttacaatgccctgattcagagtttgttgattttctatcctatttgctgcaaataaaccccaggagaagaccaacggcaagtgaagcgctacaacatcaatggctttcatttgcatactaatgactaatgagaaaccaacaggtcatttcgtttgttttaagtgctttgttcaactgctcctaagctggatccctgcaatcttctaaagatggattgattttctgatgtttccccatgagtccatgacatgaaacattttacactttccttgagttttagaaggatttacctttgtgcttgctgaactagcatgcggcacaattttcttgtttcgtttcttcagggcaattcttggagtggaagccctgctctcagtgttaagattcgtgagtgtatgtaaatatgaggaaattttcctgtgtacatgtacagttgaaacaggctcttgtaagccatctgattcatctttcataacatagtgaaaatatgaaataatcatcctgcatttcttcagttgtcgccatacttctgtgaaaatttcccttctaatctcaatcccgtggagatatgttttgttaaatgcacaggaaagtacagaaggaattttattgtccatgagaaatttttagtctcatgagagagtttttagtatctttgagtaacccggaagagccgaaggtaccaccattgcagatttgcaggcccatgaagttgcacaacgcggcccagcaagggcagtgtaccgtgtacgtccagcccaacaactcctatccatccgatcttgaaccaacgtctcggatcagatctggtcgcgacacttcgctctgtcaccggcacgcaaaaatctccctcccttctatccattatccccgtgccccaccactggcgccgctcaccggtcacgaccaatgccgccgaccgccgccgtcgccgtcgccgtggccgcggccaccgcgctcccttctccctcctcctcctcctcccaccgccgcctccccgccaccgcaaaatccgtctgggtaaaccccagcctcccgagctcccagcccttccatcgccggaaacccgccgagccccagcaccagcgccaggaccacgtgcccgacctccccgcgctcctcgcggccctctccgccgcgcgcacggcctccgacctggccgccgcggtctccccgcaccgccccgtctccccgcgcctcctcggcacgctcctctcccgcctccccgacgcgcgccgcggcgtcgcgctcctcgacctcctcgcgccagacctccccgcctccgcgctcctcatcccgtacaacctcctgctccgctccgcgtgccgcgccgggatgctccgcctcgcctccggcctcctcctggagatgcgggacagaggggtcgcccccgacgcgttctcgtactccacgctcctcgcggcgccacccgcgcgggccacctcgaccacgcgctcaccttcctgccgctcatggaggacgacgccgtagcgcccgacctcgtgctcttctccaacctcatccacctcgccctccgcgggggcgacgcgcccaaggcgctcgcgctcttctcccgccttcggggcgccgccgggatcaagcccgacctcaaggcctacaacgccgccatcgccgcgtactgcaagtccgacctgctccggacgccaaccggctcctcctccacgacatgccctccgacggcgtcgcgcccgacgcggagtcgtactcccccatcctcgccgcgctggcgcgccgcgggcggcacctcgcggccgtgtcgctcttcacgcacatgcgcgccgtggctcgcgtcaagcccgacctgtccgtgttcaacatcgtgctcaacgcgtacgggcagctcgacctcgcgcgggaggcggaccggctgttctggtccatgcgccgtgctggtgtcgccccgagcgtggtcacctacaacaccatgctccgcgtgtacggcgacgccgggctgttcggggaggcggtccacctgttcggcctcatgcgtagcgccgcctccgatggcagcgaccgcggtggcagcgtcatcaagccgaacgtggtgacgtacaacaccatgatcgccatctacggcaagtcgctggaggacgagaaagccgggagcctggtgcaggacatgcaggccaatggcatccagcccaatgccatcacctactcaaccatcctgtccatatgggtgaaggccgggaagctcgaccgtgccgggaagctgttcgagaagctccgggaagccggcacggagatcgacccggtgctttaccagacgatggtcgtggcctacgagcgtgccgggcttgtttcacaatccaagcgcctgttgcatgacctcaaagactcagaggacgtccccaaggagacagccatcaaaatcttggcgaatgccggccgagtggaggaggccgcatggctgttccgccgtgcagccgacgccggcgacgtcagggacacatcggtgtaccgaatgatgattgacttgttcgcaaagagccggaggcaccggagtgtgatcgaggtgttcgacgaaatgaggaaggcggggtctttgccggactcggagacgatcgccatcacgatgaatgctcatggtaagctgaaggagttcgacaaggcggcggcgctgtaccgggcgatgagggaggaaggatgcgtcttctcagacagggtgcacttccagatggtcagcctgctcggcgcccagaaggacttcgacgcgctggaggcactgctcggtgagcttagcgatgacccgagcatcgacaagagggagctttaccttgtggctgccggcgtgtacgagagagcatgcaagtttgatgagtcgtcacagattatcagccagataagaagccccaacgccattggtgtccagaagttcagatgagaacctccagtttctctgacgacaaattcaggtgtattgccagacagcaatacacaccatagtgtcattgacaattcaaggttgtaacttgtaagtgcgcgtggccactgtggaagttctttttcaattaaattttagacaccaaagtgttatcactgatcggtgctgtttgttgggcttaggcctttgtaaatataaacatcagataactacatttatataaatacatgttttttggttggagtgaagtgatggtacagtgccaagaacatttctgatgctgaaccctttgctgaacggaacaagcaggatgctggcagcataccaattagactaactgaactatcaacaatgaaattttacaacagaaggtgatatacaactggtgtttaaatgccccactacacaaataccaatctaacattctgctagattacaattccttttgtcttcagacatggcaattctgtacgaaccttgacttgatttttatcaggatccaggaaacctaaacgaatatataaataataatgtacaggtgctatcccctgagaacggacttatggcgtggcaggcgtttcagccttcatcaaaacaatttcatgtagcggctgcaaaatttacactgcctgatcagtttgggggatgccatgtttttggaaccattcaggcatatgaaatctttcgtatagtgctggtctaacatctctctggatagagagatgcttcagaagtggaaatataacttccatgagctgaaaacgtttaaacaagtcagaattagtaagtagtggaaactcaaacatggctaaagactggtggcagttatcagctacctgattatcattatgttgtccagctgaaaatggaacacagggtattccattcaaaggttgcaatatgaaactgaatgggttgttgtcaacaatgacaactctgcagaaatcttttgacacgcaagaaagatctttgacatgttctctgtattccctgaaattgtgcatcccatggatatcagaaagcgcattggccaaacaccaaataggtcctatgcgacatttccagcaagaaaaaaagccacttaacacatagccctcaactaatttggcacacatctcagcaagcatagtaatgaatgcagcagcactatgataatatggtaaaacaccatgtgtatccataggaaagttaacagtaacttacgtagtaacagttgatggacgatatagacggagtttgaatctattatggacatctattctgtcaactaaaggtcttgcataacctgagaacaaacatgggcatgtgaggtggcgctaattgggttcaaatgaatgaagaaaaatagtagcaagcacataccttccaaacctgctgtaaagagaataagatctgcaaattcactagttttctgcaagaactcgtgcaaaccaggacgttcaaaaacggtgacatgattcactttgtttctcccttcaacatcctttacagttcacacaagcaaaagatcctttagcagtagtgattaaaatcattacatacaataagagccaaaagcacaagttctgtaccttctcagtggatatgcactccatgtcaaagcaatgtaatccagcttcaacagcttgggtgcgtacaatagctggaagactggatgattcatatgcagaaactaaagtttcatccaaatcaagcacaacctgaatagataacccaaatattttcagaaatggtgaatgaataacttataattatcatttcatttttcgttttatgtaaaactgttatcatttcatcttttgttttatgtaaaactgaaagctcaacataaaaccatccaagttcttcacccactaaaacaaaatatgctaacaggaaaccctgctatgagcaaattagccaatgttaatcccacatgataattcatatataatcaccatatgtataatctcataattctgattcaattacagtcataatgtatcatcaccaaatgcattatcccacaacactgctcaaatatctactcatctacacatcgatttcaacggacgttctaaattaccatccacagctctgctaaagactgcagcaatgtattgtcccggttaagtaccaacaccagcaccgttgcaattttggaatattaaatcatcatttcatgaattatccaagcagtataattcagagagacggattaacgccattgttggctgctaaacgaggacttgattggggattgcaggacaacggattgcccatgctcgtaagccaagaaaacaaaatcatcgcaattcaaatccccacaaaaaaggtcagctttacaacccacacaataattagcccccaaaacaaatcgaattgcctgaattaagccggaataacacccagctaacctcaaatcaatcactctacgcatctaccaaatcctaaatctcccacgaagaccgggacatcaaaaatcagatcaagaggctcctcccacatctactgtttcatccaaatgatgcccatatcatccctaaactagccatttccccccttaccaaactaccgaggaaccccatagcgtcaacgaatccactcaaaaccgaatcttcgtaccgtgaggcgctgcagggattccggcgggggcgtcggcgcaggggccgtgtcggccgggatctcggagcggagcggcatgaaggccaccgacggcgactgctcggagtcggccggcccggagaggagcgggtagcggaacccgacgaaggagaggagctgggcgcaggatggggtgccccggaggatctggagcaggacctggaggaggaacccgatccaccccaccaccgcctgccacgcctgcgccgccaccttccccgctgctgctgctgcgccgccgccgccgccgtcggcgagtacacctccgccgccgccatgatcgccgcccgcggcgagctgtctccccgcaacgtggggcggttgggaggcggggaggcgaaggcgatggcggtgggaaggccgaagagccacccgaagaaggaagaagggggggaggaggacgtggtggtcgactggtcgtggtcgtgtgtttgaggggaaggccgcgggtgccccgagtccgtattcgtctacgtgtgcgtgtgtgtgttggcgcttcgtttgcccgtgtccgtgtggacttagcggagttacaggagtagatttagcgggcccagttgtcagtgagaggctcggctcgtctggcgagctgccgggagtgtgattatacttacgtgcacacgaagttttctcctaaatttgtctagaaagaacatgcaaaccgctcacactcacacccatgtgatgcggacacccacaccctatctctatatgccctctggaagactaatatgatatatctcgcctaccaggctacctctatatgccctctggaagactaatctgatatatctcgcctaccaggctacctttaaaaaataattagacataaatacaaacgtctgtgtcaagtttagtacgaatttactattagactaatttctcacaaagaatttaatcataggtcctgtttagttcacatcaaacttctcccaaactcccaattttccatcacatccaaaactttcctactcacataaactcccaacttttttcccaaaataacaactttccctgaacttctcctcaatttcagaaactaaacacagccataatcgtaataagtt

SEQ ID NO: 9307 - DNA, 14255 bp, Oryza sativa
ggaaaattataaatggaacagttataacctacatttgcgcatataattagaaaaatataaatggaacatgtgcatgctatctaaaatagcggtcatattgctttcagaaaaatgtcccagaaatattgcttcgagaaaactaaaccaatacatttatgtagtactagcaaaatggttggttagacataatgagttctgtaacttacgaaaatgcaatcaaatatttttcttagctagtgtacacagagtatttcctcgcctcacaaaaaaaaatcatttcctcctaaagatgccatgccttgcattgcaccaaaggcatgctttgctattatttctttcttgttgattatacctaagcaaagcagggcccctttgatcttttttagctataggggcaacggaaaaacaagtgggacatgctccatgaatatcgtttggtaaaagacacctaaccaaagcaggacaaggagagtacaataaaaggggccttatcttgttcagttgaaaaataattaccatcacgtgttgattaaagtttttttaaagaaaaaagcctgagaaatggcctctctaggactgaatattgtcacttgctgtcatttagggcttgtttagttcacgaaataaaattttttaggtgtcacataggatattttaccggatgtcggaaggggtttttagacacaaataaaaaactaatttcataactcacctagaaaccgcgagatgaatcttttgagcctaattaatccgtcattagcacatgtgggttactgtagcatttatggctaatcatggactaattaggctcaaaagattcgtctcgtgatttcccccataactgtgcaattagtttttcttttaatctatatttaatacttcatgtatatgtccaaagattcgatgtgatgtttttagaaaaacttttggggatctaaacggggcttagcttaaagttactgtggccatggtgtgtagtaggagtactagttgttttcagatgaaacatgctgctgattagagcatgcattctctgaaatctgtatagtcagcgagtcaggtactcaggttactatacagatgatacagttctgaagttttcacccatgaagttttgaacggcagaagtttcttgagggtaaaaaaaacgagttaaggcttgcatgtgtttttttttttttgaaaccaggcttgcatgtgttttatgagttctgaatgtcttcactatggtccctcaactcattagtttttgtcctgttcattgttcacatatgcttgtcatctttcatccctctttattgcagtggtcaataactgaacttgccatcaatgaataaacccaatgttaccttacctacgacaaaaaatgaaattctgtgacaccgaaaatactcatcatggagaggttgttggtagctctgaagctgtccaggtgaacgaattgaatggattaatttaattttagtgcggagactctcccaaatttctaatagcacaaactgattcattcgttttagtaaattctttgctgagaaagcgtcttctgcttggctacgcttaccggccactcgtagctagctgtctggctgctttgtaattggaacatatcaatactgttttgatgtcacaccatggatgagtccaaaattttatcaggatgtgcttctatgctgttcattggttgcaccatcgtctgtttcgtgctggaacacgaatatgcggagcgttgcgagcaacttaggatttaactaatagtttattgattttctttaagatttacttgatgttttaagatatttaacctatatttgaagataagtttagagctcaagcccttggtattataggcctacctccgcctttgattgcaacattggattataccataaacttagaataaaaatgaaaatgaccattagcttttcaggcttatctatactacttcatccgttttatattacaagtcgtttaacttttttagtgttaagtttgatcaaatttatagaaaaatttagcaacatctaacatatcaatttagtttcattgaatctaatattgaatatattttgatagtatatttgttttgtgtcgaatatagtactatatttttctataaacttgatcaaatttaaataagtttgactagaaaaaagtcaaataacttattagagtagacaaattatatttagcaccatattcatgcccaggaattatactactccatccgtcccataatataaaatattttgactttttatttacactgtttgatcactcgtcttattaaaaaaatttgtgcaaatataaaaaatgaaaagttgtgcttaaagtactttgaataataaagtaagtcacaaataaaataaataataatttcaatttttttttgaataagatgaatggtcaaacagtgtaagaaaaaaaatcaaaatcccttatattatgggatgggagaatactaacaagctggagcactgcacaaattactgttttcatggggtcctggcagtagaattttgcttgtttttgtcattttcgttgttattagctcgtactgcctctaattatagacatgctaaaagcatgaaaagatgctctacttgtttaagtttaacttggttgtcttttcagattccttggatctgaaagtaggcaacagagaggtgaagaaaaggggtgacaaactgaggtggcttgctatggcagatcaggaccaactagtcctaatccccaagagaggcagtggttttgagcaccttttcaacgcagatgtagattaaagattttgccaccagctctttggtagcattattttcttcaagtagggaattaatcaaactaatgtgagcggagagagtagggcagtcttcggctgagttcatttcagcaacataaaacaacaattttatcgttcttcgttggcacattttatgaatttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccctatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgagccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgctggctccggctagggacgagtgcctagaggctctcattattccgacgggacggggcgaggcgtgcgaaaggccgcctgttgccacctaacccgcgatctgaccggtctgtgaccggtcacacactatgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccccagccctcggggccgaaacgggagcggcccaacccctcggggagacagagggaggggcggccacatcaccctcgggcccgacccccccgagggggtcaggccacgtgggtgaccgcagctgccccaaacctctagtcaagatacccccggtcccatgtcaccgacagtagcccccggcgttatgccagggcgatcgccctcctcgaggaaagcgctcgggcgtgacgccactccttaggcctggtgacaggcggggccggtctctacaggcgggcaggaatccagtggtgcgcgcatcggcaagggaaaaccgaccgacaataatgagcggctttcttcaagaccgctacattacttgagcagcgcgcgaatcgggacgagccggttcgtttcgcctggagatgtgatgatggtgcatcggtcggcgcgcacgatatgtcccatctcgactgccacggccgcacatccgcctcgtgcaccgcaaacgggcgagcgggattagtggaggagtgggcgtgagaaacgagggggcgagatagtgggcccgggaagcgaggagccgggcatagcgttggcaagggtataaagacgccgaggaagagactcgtttccttcctctcgccattattccccttgccttcgccgcttgcgctctaacttctcgtttcctgtgccctaccctcgccacactcactcgctctcaagcccctcctccgctggcgtcatggcacggggctccgcaccgctcgacggtagcatgctgccgccttctcgcatcgtgagcgagaggcaggccgggctgccgcgccgattcatgccggaatctgccaccggccgggaggtggtcgcgctgggtgagggacgcccggcgccacactacccggggcggtccgtattcttcctttcctttgcaatggcagggctggtcccgccattctcttctttcttcatggatgttctggagctttatgatctccagatggcgcacctcacccccaacgcggtaatgacgttggccatcttcgcgcacctgtgcgagatgttcatcggggtgcgcccatctctccggctgttccgatggttcttcaccgtacagccggtgtcgccaccgtcggtagtcggtggctgctacttccagccgcgggggccggtgctgaaccgctacattccctgcgtccttcgcaagaagtgggacgactggaagagcgactggttctacacccctctcgccgacgaagcgcgcctccgacttccgaaccagcccccggcgcaggcctccagctggcgggcgccggtagatctgggagacggctacgacgccgttcttgaccgcctggctggtctgcgatcccaggggctcacggggaccatggtgtacggcgattaccttcatcgccggatcgcgccactccagcggcgcgcccggggcgcctgggagtacaccgggtccgaggactacatgaggacccaccagggggtcaaatgggactgggtccctgaagacttcaagatggtgatccaacgggtgctgaatctcagctccgtggaggcatccctcatcccccaaggtgtcctccccctctgcagcgatccagagcgcgccaacatcctgaccatcatgcaggcggtcggggcgtcaggggagcgggctcctcgaggccacgatggcgcgggcgggagccgcaggggggaacaatctaccccgagagggggtcgtgcttctgggccccgtgacgggggcccggggggcagccgccctgccgacgcccgggggaagaggaaacaggaggataccccctccccatctcctccccgagggggcggggcggtgcgtgccagcagcaggcgcccggagggtgctgtgccgacgtcgcagcccgaggaggagcgaaaaaagaagcggctccgcaagatgggggggaccgaaccatgccggggaaacctcatctccccccccaaggtggtcgtttagccgacctcctcgcaggttcgtccccgcgcccactgcggccgtattcattctcccatctcccaaggcaagttttcactcacccgtttttcgtcttctggtttttcttctgcctcagcgagatcccgtcgcgcccttcccgccattccaagtccggccggtctgaggtcgaggagacggcgaccgcggaggcccggaggcgggaagctgaccggcgagaagccgcagaccgcctccgggaagccgaagaagctgcccaggaggccgtccgggctcgccaggctgaggaagccgcttgggaggaggccagactccgccgggccgaggagtccgtccgggagacggaggcggcgcgcacacgccgggcggcctgccaagcccccgacccgactccgcccgaggcgacaacgacttccgaggccacccacgacgaggccgcgggcgcgccgctcgggcccgacccctctggcgacgttcgggacgagcccgcgtcgggggacgcccccgagttcggcacgtcgatcggcgggccgagccgcgcggcgcccacaccgaggcggctctcccctctgccttccgctgccccactgagcgcagagcccctcctgcaggccttggccgctgcgaacaccatggtgttggacgggttaagcgcccagatggaagtcctgcaggcagagcgggcggaggtcgatgcggcgtgggcgcgcgtcgaagagggacggcgctcggtggaagccatggtggaggcgggccgcaaggcacaccgccggcacgcctccgagctcgaggcccgtcgtagggacctggcggagatcgccagggaggtggaggaggagcgggagactgccctcatcgccaccgccgtgttcaacgcggcgcaggacgacctctgcctccaatacgggagccgggcggcggagctagagaagaagctcgacgcgtcccggcagcgcgaagaggcccttgaggctcgcgccacggtgctggaggagcgcgcccgcgccctggacacgaaggagagggaactggcgggtcgcgaggccgccgtcgccatccgggaggcaacgctggcggcgcacgaggccgcctgcgccgaagaggagtccgcactccgcctccgtgaggacgagctcactgagtgggagcgagctctcgaggaggccgaggccgcggcgcagcggcgggaggagcaggcgcgcctcaatctggaaggcgcccgcgcagagagggccgcactggatcagcgggctgctgaattcgaggcgcgggtgaaggagctggacgcgagagcgcgcagcggcggggcggccgcgggcgacggcgacctagccgcccgcctcgcagccgccgaacacaccatcgccgagctgcagggcgcgctggactcgtccgccggggaggtcgaagccctccgcttggcgggcgaggtagggcccggcatgcttcgggacgccgtctcccgtctagaccgtgccgggcggcaggcgggcctctggggcgggcggaccgcgaaatacgccgccaaccaggggggcctcgcccagcgcctctcagagatggccgggaccctccagcggctccccgaggagctcgaggagacgatcaagtcatcctcgagggacctcgcagggggggcggtggagctcgtactggcaagctaccaggctagggaccctgacttctccccgtgggcagcgctggacgagttccctcttggaaccgaggatggcgcgcgcgcgcaggtccgggacgccgccgaccacatcgtccacagcttcgagggtacggcccctcggctcgcgttcgccctcgactccgacgaggagggcggtgacggtggtgcggacgtcagcgacgatgaggccggcgacccgggcgcgtcggcgtgagcccccaggcccccgccaatcttaaatagctttttctttcttcttctgaggccttcgggcccccttcttgtataaactaatttaatctgcaatcaaataaagaggaaatttttgtgtcaatttcatttgttgtgtgtatgagacgaggatggtctgtgccacggtccttctgtgtctctgtgtcttagcttaaacaagggctcgtgcctaggtcctagcctcaaatggcgcgggtcggggctagtgcctggggagatccacgtgtcgagactggccaggccgggaatgtggtgaccgagggttatggatgacccgattgtgggcctttgccgattcccccccggagttcaccacgccccggggcacggctcggttctgggccccttttggcgattttagccggcccgggccaccgagggcaggatcgagcacgagcgtgctaattcaagccaagattcttcgaaaggaaacaatggcacagacacagtccttaggaaatcgaaaatgcttttattgaaatacggaagagaaaaaaatataagtttatgcatgtggtagcccccggccaaccctgcacgcctgggggggcgcggggttggcccgagcccgagacctgacacccgacccccactaggggtagaagcgacgaaggtgttcgatgttccacggattaggcagctctgtgccgtcgcccgtggccagccgaacggagcccggccgggggacgccgatcactcgatacggaccctcccatattggtgagagcttgctcagtccagcacgcgtttggacacggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgatcttgatcagcctcgcagtacatggtggcccgaggggacctcagggtgagctcggatgggagaaccgcctccgcgccgtagacgaggaagaaaggcgtttccccggttgctcggcttggcgtggttcggtttgcccagagcaccgctggcaactcctcgatccacgagtcgccgtgcttcttgaggatgttgaaggttttggttttgaggcccttgaggatttctgcgttggcgcgctccacttggccattgcttctggggtgggcgggagaggcgaagcagagcttgatgcccatatcttcgcagtagtcaccgaagagttcactagtgaactgggtgccgttatccgtaatgatacgattaggcaccccaaaccgagcagtgatgcccctgatgaatttaagcgcggagtgcttatcgatcttgatgactgggtaagcctcgggccacttaatgaacttgtcgacagcgacatacagatactcgaacccgcccggggcccgcctaaacggacccaggatatcgagcccccagacagcaaacggccatgaaagaggtatggtctgcagggcctgggccggctgatgggtttgcttggcgtggaactggcacgccctgcaccgccggaccaggtcaaccgcatcgttgagagccgtcggccaatagaaaccctggcgaaaggccttgccaaccaaggtgcgtgaggcggagtgggctccgcactcgccttcatggatatcggcaagaagctcgacgccttgtttccgaggaatgcacttcaggaggactctgttagccgtgcaccgatagagggtcccttccaccagcacgtagcgcttggagatgcgctggacgcgttcactcccttcgcggtcctcgggtagagtcttatctgtgaggtatgcctggatctcagcgatccaagcaaccaatctaagggagctgggagcgctcccctcgggtcccgaggcctggactccgacgggcctcaggggccgttcaggcgcgtccgtctcccctagggggtcgggccgcgccgacggctgggcaagcctttcttcaaaggcgcccggtggggtctgggcttgcgaggaagcgagcctcgagagttcgtcggcgaccgcgttatcccgtctaggcacgtgccgaagctctatcccatcaaaatggcgctccatacgccgcacttggcgcacgtaagcgtccatctgcgggtcagagcaccggtactccttacagacctagttaacgaccagctgggagtcgcctaacaccaggaggcggcggatccccagtccagctgccaccctgagtcccgcaaggagtccctcgtactccgccatattattgatcgcccgaaagtcgaggcgaaccagatatctgaggacgtctccgtttggcgaggtcaacgtgacccccgcaccggcgccctgaagagatagggagccgtcgaactgcatcacccagtaggcggtgtgaggcagctacgaggggcccgagctggcctcggggacggagatgggctcaggggccggggtccactctgccacaaagtcggcgagggcctgactcttgatcgcgtggcgtggttcaaagtgcaaatcgaactcagagagttcgattgcccatttcaccacccatccagtaccctctcggttatgcaagatttggccgaaggggtaagacgtaaccaccgtgacccgatgcgcctgaaaataatggcgcaacttcctcgaagccatcagaatagcgtaaagcatcttctgggcctgagggtatcgggtcttagcgtcccggagggcctcgctaacgaagcagacgggccgctgcacctttcggcggggccgatcttcttcgctaggggccacatctccagggcgctcttcgtccgagaggccgcgcggggcgcactcggcttctgtgccgacgacctcggggtcggagggcgacaggcgcggccttcccgcagtggccccggggccatcctgggggtcgggggtgcctggcaccgtcggacaagcgggcggagggccaactccggccgtcgggggcctcgggccgccgttcgactcgggggcctctcctccctgctctctcccgggtcgagtcgacacagggtggggatgcgcggagtgagggttgtcctcgtcgcgctccaagaccaacgccgcgctgaccacctgcggggttgccgctaggtaaagtagcagcggctcatctggctccggggcgaccaggactgggggagaactgaggtacgccttcaactgagtgaaggcccgctcagcctcctccgtccagataaacggcccggagcgtttgaggagcttaaataggggtagcgccttctctcccagcctcgatatgaaccgacttagggcggccatgcagccggtgacgcattgcacatccctaagcttgctggggggcgcatccgctctatagctcgtatcttctcggggttggcctcgatgcctcgggcagagaccaagaacccgagaagcttgcccgcaggcacaccgaacacgcacttgtcggggttcagttttatgcgggcggagcggagactttcgaaagtttccgctagatccgagagtaaggtctcttggttgcgcgtcttcacaaccaagtcatcaacataggcctcaacattacgtcctatttggctacccaaagaaattcgagtagtacgctgaaaagtaggacctgcattctttaacccgaaaggcattgtcgtataacaataagttcctatgggggtaatgaaagcagttttttcctcatcctccctagcgatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcaccagccactccggatggataacctctcggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgccgtccagaagaccaccgattcgtgtggtcttggacgggccgtcgcccagggcaaccttcttgaccgggacctcgtcgcacgtgatcatccgctgcctcggggcggctgggatggaggtgctgagcctctcgttgccaccctcgggcttggacgcggcggcgaggtggtccgcgcgctgctccatacaagcaagcgcgactttgaggtcgccatggacagagatggggccaccggggcccggcatcttcatctggaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccgggaggtcgatatgacctagcggccaagtgtgccccggcgtcacaccgataatcggctgggacggccgaagcaccatccccggggccttgatggtgtcaaaggctgcgggggaaaggatgttgagggctgcacccccgtctatgaggacacgccccaactttacgttgcaaacggtgggggaaaccaccatcgcgatctgtcctccccgggcaacgcacggcgggtggtcggtctggtcgaaggtgagggcaacctccgaccaccgcgtcgcctcatgggtaggggccgcggccagaagctctcgcttcatggccttgaggctccgacgagaagcgtgagcgcacgctcccccatcgacggtggcgatggtggccccaggctcctggaaccctaggtcatcgtcgccatcgtcgatgtcctcagcgggggccttttgcttggcctcacttcgccggttgccggagggagccgccggggccttgccctcacggcgctcctgcctcctctcctcctcccacttcctcgtccgctcagccaaacttttgaccgcgcggcagtccgcgaggtcgtggagggaggtgttgtgcacggtgcaccacttgccggtcgggcgctccctgctgggagcgccagcctccttctttttgttgctcgcaggcctcccctttcgggtggcccgcgaagcgccctcgacggcgaggacgtgaccctcgtcgtcggaatgggccgacctctttttcctcctcctgtcccgccgctctgaccgagcagcggatccgggggcggccgaagctgccacaccggaaccggtggagttccaggtccaggcctcctccttgcgagccacacggtccgcgagctgaaaaagctccgcggtggtctggggctccttggaggcgatcttttcgagcatgcggttgtgccgcacgccccgcctgaacgcgtagattaccgcgtgtgcagggatgcatggtatggtgttgcggacttgacagaaccgctgaatgtacgagcgaagagactcatcgtcccttcgctgtaccgcatgcaagtccgcttcttcacctgggcgtggatatgtgccttggaagttcatggtgaactgctggcacaaatcctcccaagagtggaccgtcgcgggcggcaagttcattagccaaccccgcgcctgtcccttcaggtccatggggaagaaattcgccatgaccctgtcgtcacccccggcggcctcgatcccggtcgtgtagacctggagaaactcggcggggttgacacttccgtcatatttttcggtgatagtgggccggaaccttgggggccaacggacgttccgaaggctcgccacaaaggctcgacagccgacaccaccaaccgggggcacggggggctggcccccgcgcccaaaccgaagtggcgctccggacgaggaagcgccttccgttgcgtgggcagcacgacgaccattgcgccggcgctcgatactgaggcgggcatccggccccctacgcacatcttcttgggtcggaggcgttgacgaggaaatggcagacgaacggcgggtaacggccgccgctcgccgcgccctccgcctcgacgacacggagccggcggtagcagcgccagaggccttggtggcggaggaccgcccaccggcgcctaggcgctgctgcgccgtcatgaccaagtcggccacgtcatccagccaacgtcgggct

SEQ ID NO: 9308 - DNA, 1620 bp, Oryza sativa
ggcgtggggcgctcgtccaacccgcaataaacgcggttaggtgagcgccgctgtgctcacctaacccacacacgtggcgccaaacccgcagggggtcggggcgccctagccctcagggccgaaacgggagcggcccaacccctcggggagacagagggaggggcggccacatcaccctcgggcccgacccccccgagggggtcaggccacgtgggtgaccgcggctgccccaaacctctagtcaagatacccccggtcccatgtcaccgacaataatagttaatatgtaattaatcacgcggtagtgattcattctatgtttcgaacaacgaacaacttcaactgaaatgctccgacaaacacaaccttcgtatgaattgatacacgtatattaatatataattttattgcgaataaccagagttccctaaatacatgtggcttcatatttaaaacaaattttcgagaaactattggagtttcagcctaaaagggaaacctgtccaaatacttgtgcatcagattgtgcatcagatgattctatattgcttaacaaactgtacaacagaaaataaactaatcctaacttttcaaaaaaaaagagaaataaattaatcctaaccgagcctttttttctgcagtcagtatagtcacggactcaattttccgtcagtagccttctttgcaatccaatgaatacattccgttagcatcgcgccggcgccccactatgcagtaccaaaacagctccctgatgggtatacacctgtagcgatgttctgtacgttgaatcgtgcgttattcgccatccccattcaccaatcgccacctgaacgtacgtgaatcgcaccgtccgaaatcaaagcccgtttcttctgacacagatctgtgggagcgcggatatataaaagtgtcagcgataggtggggtgcagctgtgatgtgagggctgggttagttactaactttttcttcaaattttcaaattttatatcacatcaaaatttttctacacacataaatttttaatattttcaaccacatcatttcaatttcaattaaactttcaaatttaacgtgaactatacacacactgagctttcagatctgcgttttagagcaggtacaatagcaggctataagccagctgcaaacatattttaagtagataaatgaggagaaagaagggcggtgggctacagatttatagccagctgcagtacggactctaagacgcagtgtctgtatgacaggtggaaccatatattaatagtgtagtatgtaaatattgtatgaataagctattagattagctatagataaattgaagctagtagttggccatactgttgaacttgctcttacgggggccttccgcacacgaagattggatgcggacaacagcacgagcatgctgtttcaggaatccatccgttccacagttcccagccgcgtcgctggcgtctccctcgcgtgcccacgttcgctcgcggatagggggcgcgtacgtgcgcctcgaacgacgtgtggacgcgatggaagatgcgttctgtaccggacacatgcacgcacgcggcccgtgccacacaaaaaccgtctcgggctttggggctgcaggaat

SEQ ID NO: 9309 - DNA, 5915 bp, Oryza sativa
cggtgatgcggtggccggtaggtgggacgggatgatgcaggcgcactgggcctgggtcaaccgtgaagccttctccactccactgatccactccatcgccaattcgccgtatcaactcaccaactggggaaaacgccgaagtcgaggaggggaggccgcccggtccgcgcgcgatggccatggagggggtgagggtggtgacgctgcgggcggtggaggccacgcccgagtccttcgcgccgttcggccaggtcgtcgccgcctacggcggcaagcgcttcggtcccaacgatgcccagctcgacctcagccgcggcgtcccaaggtctctcaacccacacgctgcctagctagcatcgatccatcgatcccgtctgcatctctggttcctgcacctgatttaggcgaaaggttcccacttcctctgatctttttttttctctcctctacttggcaggttctacatcatgaggttggagaagcggccgctcaagttctggacgatcacccaccacgcgagcgtgacccagtgcctcggctccatcggcggcgaagattggtacctcggcgtggccaagccctcgatcgtggaggatggggcacacgagcagggcggcgatgggaggaagcccgtgcagtcgcgtgctggccactactaccttcctcccgatccagctgaagtctgcgtcttcagggtttccggcgctaagtttctgaagctgcacatcgggacctggcatgcggggccgcagttcaaggcggatgcggtggatttctacaacctggagctcagcaacaccaatgtgagttctaagctgttgaattgaacttcgacttattagctattggttcttgcgttcagtaatactggaaaaaaatggcttctcaactttaaaaggtaggaatgtttttgtttgttccattttgctatgcacgggcgcggtgcgtttacgcatggccatacagttgtgtttgtttatatatgtcttagagcctgatacaattttaggaataaaacttattcaacttttaatttcaccaatccttatcactgacagaagtgtgtgatcttgcttgcaatactcagtactacaatgtttggatagtccagcactatgaaaacattcttttgagtaaatttcacaaaactacaatttagcaactttagtaaggtatttcgcagaacagcaacaacagaattttatcagaaagctataactttatccccataagttgtatgattgtatgtaggaattgagaagcatgagtacttcatatgtgtatgacacgccacccaaacttggcacacaaataagagaaattttacactacttgagaaagtaccttgaggtacctaaatttttgataccttgagatatacctagagttaccaaattttactatagaaaatatggtatctctaagtaccttctcaaggatggtaaaattaccccacaaataaagttgcagttttatgataaaatcatatactgttgtcacagttctctgtaatggctagctaaagttgtagaaaattgatagttttgataacaacagttgtagttttctgaaatttactctattcttttagaatagttttctatggtgctgtgggaaatactatagttgtgcctccttaatagatatttcatgaaacagtgcatgaaaatttcatctttgtgcactgtttacatcaaattcttaagcccttactcatcttttaggcattttggagagtttatcaggttcaatctggttgcatctgtgtatacagttcattgaagcagtgtgctctgtggttgcatttgtcttttagactaaagcagtttattcaatgaccgatttggcaatttctattgtcttcctagttaataaacttggttctgcttattgctgacttatatgcatgttttcgtaattgtattcttgccaataaatctagggtgccagtgtggtaataatcttctctaaatgaattattgtcagttagagttggaaacttatctggtagtctctgattgctggtgtgtccagaaccgaaatccacagagtcttgtttctgtgtcacaagaatggaccaactgaacctgccggttctaaattttgcgatggactccagatatctgatgcttgtctaatctaaaatgagttagtaattatctgctagttggaggccaatgacaggacccatattcctacttttgttagggtgcagaaataacaaggacattctttcgaaaacaactcaatatgttgtagcactaaagaaagtccaacaatctagttggtctgccaagtttggtggtcgtccctctttccataacttctgataagtgtctttcttttttagaggaacttttgtatacatgtcaattagtagcatatatttatcatcatctttttgggatgtgcagttatgttactacaacatgtcattgctaccatcagacttatgttcaatttttatttgacaaactgccatttctatctcgaagttaaacttttccttttcccccttgtgaacctttgaaaagggcagggagttcctgcaattcacctcgaagttaaactgagcatatggtgtttgtttcagtcataatacttttgcttatttcttttcagattgtcgaccacactacgcacgatttcaagaaagacgacggggtaacttttgtgattgaggactgagacacatttcacaacctaaggctgggtaatgaatatgctagactgtttgcatgtcttgtctgtttcctgagtttttaatgaacaatcgatatgcaaatgtgatgtacaatatgcacatatgagctgcttgttcaagtcattgtaaaaaacaaattaagaaaaaagaggcaaggggagtctctagtgggtacacccaaaagggcaaaaagccgtccagtatgaaatgatgttgctcttttctgaaaacaatatgaatgatttgagtcaataagtgatgtatttccagagagagaactatcagacaatggactttctggtatcgtggctgtcatactatgtttgtgcttgtggtgccgcgaaaaatcttactactcgagtattattgacataccaaaatctcgttatcaaggaagtgacattggacgcgcaattctgaacgcggagagatcggcagggggcgccagggggatcgacggtgacgagacggaacctcgacaacgacgcgccctgccgatccgggcagcgtttggactttttttttaaaagccccgatttggatcgatcgcggctaacgattcggccacctgtccgctgggtcgatccgtagtaggcgcttggccggccatgacgcacggcggcgccggcggcccggcctctcgccccatacccacggcggccgcacgccgcacagtcgcggtcatacgggcgaacgcggtggaagatccaggccgaggacgatggcgcgacgtcggcccccaggctcaaaaaaatataggaaaattattcgcggctttggcctccaaattcctctcgcaagcgccacgtttccccgacgtccacgtccattatccggcctggtcagagagaaaaccgggcacccatgctgattagccgctgcttagcaattgattatggattaattaacaggataatactggagtactagctctagctgctgctagtagtaatcagctgctcataaaaagcaatcgttggagaagcaaaagcgcacggcacgagggacgcccaatcctccgtgtccgttggctcaactcgaccaaacaaccgcctttttttttagtctccactctctccacttccccccctccattgccgccccgtttctctctctgatcggcaaaaaagtggatgctccggctgctcgaccgccatggtgaggtctctcgacagctacccctccatcaaagatgtcacctacaggttcgattctgcttcccctggtcgaaaaattggttcttggatcaaaaataactgccaaattcggttcttttcgtcagttatgctgattttatctttagtatgattcaccgagtatgtggtgtagtttccctaatttggatttagagggaatccaatttctgaagtgctgttgtctacttggcggcagctgcggatactgcgggtacgcgctgaacctgagctcgtcgacgcggaacacggcgaacatcgggtccaagtacgggaagcagatcaagaagggggtcgtctccttcttcgcggtggacgagagccggttcacgcaggccgacgaggtcacctgcgtgccctacttccactcgcggcgctcctgggggctcttccggcggaggtcgcggctgctgtgccggaagtgcggcggccgcatcggcagcgcctacgaggaggacgaacccgccgccgcggcgctgcccgcgtgcgacggcccggacgacctgcgcaccacgagctccgggagcagcggcagcgcgtcgagccagaagaactacgtgatcaagatcaacgcgctgcagccctcgtcggacgattctgatgctgttgcctttaccctatgacgattctgctgtagcctgtcatctcttccggcccggttgaatttgctgctgcagtcttggaattcgcattgggagtgcaaaaagggtgatattgcagtcaaggaagggatcgccatggcagtgagcttttggaagggtttgataccatcatgatcttgagtcacctttgctgtctgtagtagactagtagtgcttttcttttcttctgtgaattggtgggagtatacactggttgttaatttttggatctgttaatattggaaaatgacaaagtttgctgtatgtggcttggccctattgagtttgtaccatctcatgaggttcataggggttgcaattttgagtcatcttgctttactggtatgtcttaagtttctctacacggattcttcattagtcttctaagaaagcatgggttgttgcattgtgtcagttactgaatataaattctctgttaaactttaaattatagtcttttggttttccagaaataggcatgtatcttcagttttgttaagctgataaggtgaaaccataattctgatttctgtttatcagtgtaattttcctctggtgccagctcgtcaagaaatgggacttgggagcacagaatgaactcatgtaagcagggctccaggtgagctcatgttcatacaaagtttttagatataagtaacaacttcatacaaagcagtaactcagttgtatagcatggtaaagagcgttgtaataaccaagaaatatctgttctaatccacaaaatttgatatgcaaatagcaagatgaaggatcattttctgagaaagatgtaaaattgtaaattttactgctcaaagaatcactatcagtatcatatacaaaggagctctttagctggagcagtacaattgtcaggtttccctactagctagtaagaaacatacatacatttagtagagatagttgatatcatgttgtaataatcaaatcaaattaaaaaataatgtaaaaacactttagcactttatatgattgtcgtagtttactctatcattctgcttcaagtggctattgagttggcatgggtgtattctgcaagaagtgtctgaataatataagtgcttctcgaggccggtgtagtggtacctcatggcctgcgcctgctatagtgacgagagttaatcctttatacacttgactccaacctccaacctgcaagaggaatatatcatgtattcaaatgattcattctgacccagaatttgcttagaactgcaaatagtttttagtatactgacctttccgtggtcataccaagggtaccaattgaccatagttggaagcttaagagcatctattgagtaccttgttgcagtaacaggaactacagcatctgtatccccactgtgaaaagga

SEQ ID NO: 9310 - DNA, 1132 bp, Oryza sativa
ccgacagaaaacatggtcatgcaaaaattgtcgatctcattgaaaagatcatgtgtaccatgtatataaaacaaatagatgcagcagttgaggtttctaagttagaagccccctaacatctagttcctcctatatagtcccgtgtgcatccttgaaactgctatatgtgaaggaattggaccatatagacatatatagtcatatagacctcccagagcatgtttgactcagatgggtacttgtgctattgtgggatatcagaggggcctatatcatggcctactaaatgaaggatgcacagatcagtgactttgaaaatccacaaatttgtggctgaatatctgaaaacacttacagcttcgataagcatctgcacttccgattctgccagatgagaaccaaattttgctatcccgctctttaattcttcataagatacaatgccatcgttatcagtgtccatagccttgaacatctcctttatgtcctcaacttcctcagcagataaatgatcggcaatgacctagtcagatacccaacataagtttttgtcactcaacagtagattgacatggtagatacttggtggaaagcatcggaacaagatggaaaggttaagagagcaagatacagacccttagtgctcttcttttgaatctattcattctagaaaattgtttgagccttgacttcacaatatctccaagaggaacatttggagctttcttagcattttgaagccatggatgttctgtggtaaaaaagaaaggatatcaagattccccaagaaaaaaaggaaaataacaaaagttaacaagttatttatactaattaatgtaagtagtgacctttttaatgctctagatcctaattcacaaacgaaaataccatgtcgttaaaagacaatatatggtatatgttgcctatattagacaatgattaatttatgtatggctagtgatcccaagaaatggagaactagtaatatcgaatcagattccatcacaatgctataatgctggaaagaacagaaaatataatcaagtttgaatgatcattgaatttgatattttatggtatgatgcacgcaagtagaatatcaggtgtctatttttttgtagtgctatgtaaa

SEQ ID NO: 9311 - DNA, 4388 bp, Oryza sativa
cgtatgtagcagctaagaagaatccaataatcactgaagataaaaaaaaacataaaatgaggtatataggcaatgagcttgccctgtgcagcagtgcggactgccttggctgctaggtgctttaggtgttagcctcagtgagcttgctgcattttgttctaagagacttttttttttaatcttgtgccactcttcacaactctattctttcttttccataaaaaaatcacgcttctatcttttgccactattccattagtgtgcatttctctatttctatccctgtctgatcaacaaaggttggccatcaagctttccccccgaaagacaattatggcattgcatatgttccaaatgaaaagaaaaaaatactaaatgaacaatgtagagaaaggtacaatgttaatttagatggcacaattcttaatagcaatccaaacatatgtgcaaaacaggcggtaaattttagactaaggattaagtacttgaataagttacatcacagcatttaagagttatgacaaatacaactacttgtgtaaatttggcatgtttcccgctatggcatgcaaaaaattgcggttcaatgccaaagtcatactgaaaaagcttaattaatcataaaatactgaacatgaaaaggggaagatgaactaatataaagggaatacttaaagatgagaagcacctaaaagggaatccaatctaatcaagttaaaaacatgaaatagagtattgtgctaaaggcagggatgtgtcttacttaatacatcccatgttccaactggtaaaaacatgtgataagtttatatgtaaattaagtgccataatcaccactgctgtagtaaggttagtgcatttactgctaagacatagcagtttcagttctatagcgttctcccaaagtacagcacgctgaactcaacataatgtattgacacaatgaatgtacaaataacatgtctggtgcaacaaaactaaatttagccatgactatgcatcagcatttgtttcttctggattctataaatagtaagtccatacaacagacaccttagatcctaaacctagtgtaccaaatactgaacccacaatacagtcttcaggaaaccaaactactgagactgatgcaatcatagaaatggccaatattgaactagtgttctgcaaattatcagcattgaactactaaggagtgcaccaattccagcaaaatagcatcccatagcaaggggaacaaccaacattgaactacggtttggtgaaaaagacactaactccatccaaataccatagtaaaggcgctgtcatatacagtattcgattgaccacccaaaaatcctgccttcaactagaagtacaaaaactggtgatagctttttcctctatggaagaaatgcaaaatctttgcagattacacagcagaacaactgcatttagctacggcggtatccactaccaagtattccacccaaaacagaccattaggctagagatctcacgaggctgtacggaaattcagaagtgcgagtggataattgttcgaaattgggaacggatctcgattctgcagggcttaccgggcttgaagaagatggagaggccgaaatcgatggccttgagcggcgagttctccttcttgttggcgaagaggaagttctcgggcttgaggtcccggtggataacgccgtggcggtggcagagctggacgacctccacgatggtgcgggtgacattggcggcggcgcgctccgtgtagtggccccgcgcgacgatgcggtcgaagagctccccgccttcgcagagctccatgacgaggtgcacggcgccctcgtcctcgcacgcctcccgcagcgacacgatgctggcgctcttggggaggtggcgcatgatggcgacctcccggcgcacgtcctccacgtcgaccgccgtcctcagcttccgcttggagatggacttgcaggcgagcagctccttggtgtcccgatccatgcacaggtacgtcaccccgaactccccccgcccgagctcccggtccagcgcgtacttgtcgtcgatccctccgatcagctcgcacccttcctccccgagcacggggagccgcttctgccccgctcctcctcctcctccgccgccgccgcccccgccgccgcctccccccacgccgccgttccgcgcctggtggggcttcttcttcccggccgatgcggggaagtgagacgacttgacgtcctcccgcgccgcggcggccggcgagcggcagcagttccccatgctcgcgcgagatcaaggggagggagggctagggtttgtgctgcattgggcgccgcggtgggggattgggagatgggaggagaaggaattggtgaagtgaggtagaagagagagaggagatgagtagaggagcggtaaaactgtgacgagtttggtaatggtaacggtaaagggacgggagggaggcgctggggacgcgtagccggcggtagcttttagccttgggccgacgaggacgagggtgggggaacattcccacgtggcgccgtggcgtgtgcgagatttgtcgctgaccggtggggcccttacggtttttttgggtgggttctccggtgcgtttttgggctttcgcggcggtgcggtgagccggtgtggggaaggacggctaggggggggtttgactgcgctggtcgccgctccggttgtctaacggcgtgtgcgcgagagaaaaaggacggaaagggcgtccgccgtggcgccgtcttatctctaatctctcacagtctgcccggtttttttgctggattattttggtcaagtatctaaaaataagttctctcacaaaacattactacattttttctactgtatttttaagattattattattccaggctatttgttaatttattttattatataatcgtgctaataattgggttaataatctatgttcttatttgttgcttacttcttattataagccataatggcacattaatagttaaaaaataattataattaaaattttgtatatgtgtttttatcgacttaaaagttaatataaaaattacattttaaataatattaaatcaactttaaaatcaagttttagaattcaaatattaatattggcatataaatcataagccaaataatgaggctctaatcttaaacggttaagaacatcaagccatattagcagtgtgatttaacaagaaaatcactgcggcacatacgcttttcctctatgcatcttctgttttgtttcttttttgctagagacttgcctgagctccgaaaaccgatgtgtttaggattcaaccttctgaactgtccctgtcactgtttcagagaccgtcaaagatcgtgttaacgaagctgtgtagtatagtattgttgctgtctttgcagcgcctagctgcggaacaatatgccgtgattttgcgtgcgtgatgtttgtgtgtcactgtgcgattatgtctataccactcaataagtgtagtttacgctatcgttcctgtagctcgagacgttgaaatgcgaaaatgtcaacaatacgtgggccgttgcaactaccgttagaagcctctcgttaaaatttcaacgttctcttgccaaccttcaacgccatcaatggatcaaaagccaaagcctaacctacacttacacagctgtgagatggacttgttacacgtttctagcttctagccggcaataaactagtagacggtatttggatcggtaacaacggaggtcttcttcccttccatttttgaaacccttgcaaaaagcgttccagcttttaaccaatatgagcaaattcaagtgtgtgtatctgtggccggacagcgaatgcttccgaaacactcagggacaaagcggagctagctacggctgtcatcttggcttaattagccatgcttccgacggcaaggggcgacaacgactgctcgacaaaaaagcaaacctccccgtttgcttcgacattaaccatgcaacagtgagcagaatacgacctgtgaggcagccaaagcatgaaaaatgaaaaatcaccggtgaacgaagtaacgagactgtttctacgtgtggccatgtttgcccgcatgcgtcacagggttatcctcgccttcttttttttctcctcgcgggatgagccgcgggagatgagagatcgccgtcgtgcacagcgaattcgaaagcagaacatgcagctatagcaaagcgcgcggttactgtatctcatcgtgagcagtatagtatgaaacggaggggctcagcggtcacatcgggagtggattctaatccctcgaaaggatatcccctcgtataccttttttttttttaaattcgatgcaaaaagttatgaaaaaatttgaaaaaattgccaatgg

SEQ ID NO: 9312 - DNA, 15455 bp, Oryza sativa
  unsure (1)..(15455): unsure at all n locations
attgacaatgtagagtataatgatacctactagtctaccaaaattcaagttcaaattcgatctacacatcgaaaaaaaaagacaaatttagatataaacagtacgctactactcatatgctgaatttatcttttttatatctcggcgtgtgagttgagtttggacttaagattttgtggagttgtatatatgtgttgtatgaatattgtcaaatttttccaaaattttttataaccgtttaaatagcttttaaataaatgagggaactcccttgaaggattagaataatttccccggtcacatctgcagtgggggcgagagagattggagaagcctttgctgcgtgcagcgtgcgcaggaagcagcggtcccagtcgtccgtcccaagcaggtgacacccaaaaaccaacgactgctgacctcgctaccggaaaacggatctcggcgacagcaaagtcccccgcgccgtaccaaacctttgcctgaaaaagcaccgagctgatgctgtgctgccgctggccagggctccacctcccgccctcctttttcttcggatgccatcatctaccctgcgcccgtacaacacaacacaacaccacccttcttctccatcttctgcatgactgcatgaccgatcggcgaacctgcagcagccacaagatcggttggtttggttcatccatgcagcaacagtagcagcatgtagctgtcaatatatcttgctccgtatctcgtgttgcttctccaggagactggacgattatcgcgggtaggtgaagtagtatctagctagtctcgcgttaagaagaacgagctgaattcggtggcactcggctgtccgtctatcaggacgatcgagccggtcacatgttgaggcctaataaaagcggtgcgaagcactgtttactgccgggcggagcgcgtaaacgcccggcgatctcgcattcacacaccaacgagagccgtcgacgtcgagcggttgcagcggaattaaattcgcctgcccgaatgattggttgatcggagccgctgccactgcaggctaacgcgcacaattctgatggggcgtacttgcgcgggtgttggaacaatagatcgcgtggtggtactacttggtaaagagaacagctgtagttggtgtcctttagcatggtcgtgtagagcaacagtgcatctggcggcgccggcgacaatgatacggtgagattgcaggtaaggatggcaattattaccgattgaacatttaaggctccattcttttctacactgctggagcaagggtttttacccacggttcgtaaaacccttacagttccgattatataaccggactatgaattcggtagttccggtttaaataatcaagactaaagatgtatctttccggtcagtaacatcaaccgggactaaaaatggcccgaggatagtgccaggtcattggtccctattcgtctcttttttttcattgttatttgaatattgatttcacaccaatctcaccaaaatcataaattccaaatcgagttgctcctacataggggtgaaaacggtacggaaactttccggattccggacctattttcaaaaacggaatctgtcggtcagaatttttcagaaacagaaacgaattcgaaaatattttctcggaaacggaatcgaaaatgataagggcagtttccgttggaactcggaatcggtcggaaactttccagaaattttctcggaatttttggaaaatttctcggaatttctagaagttttgtgactgaaataccctggattctttttttaagcaataaatagtgaatactatggtgtttggctgctattttttaaaaaaatatttgttatggaaatctaaaattatataagaatatttttttcctgcattgggatttatcaacaacattactctcttaaacatagataatgtattccttaggttgtgttttgtgatgtactattgatacataacaattggacttatatgattgtgttttatgatgaattgttgaccattgagacttgaaaattggatttatcatttggaggggttttttattccgataaattttcgttaccgtatgcgcgccgattcgttttcgctccgttttcggtttcgataatattcgattccgttttcgtatccgggattttcgatccgattccgaaaataatatgaaaacaataaagatggtttctgtctgtttccgtactgttttctcccctactcctacatccccaaatcaaagtaacaacatcacaaatcataatattcacatcacaaattgtcaaaaaaatcacaaattctaaaaaaatacatcacagatcaaatataacacagatccaataaatcacaaattcttaaaaaaaagaaaaaaaaagaaaaaaaagtaagaaatctagccgccgtccgccgcctcctactgcgggctcccgccgctgcctcggctgccgcttctaccgtcgcctccccaggccggtggccgccaccgcccccgtccggttgccgccgaccgcgccccgctgccggcctcgctggccgctgctcgctggccccgccaccgtgcgtaggtcgccgccgcgccccgctcgctcctcgccggcgccgtttattcctagagaaagagaggataagactgtgatagagaggaggaggaataggaatataaggagaggataagagtgtgagagagagggggaggaataggagataaatttttttgaagattagtgcaagagattttttatttttaagtcccggttagtaacaccgaccgggattaaagatctacataaactttagtcccggttggaaacaacaatcgggactaaagttatgatctttactccttaaagatctctggggacctgacagcctctgacacgaggtgaactggaactatctttagtcccggttggtgttatcaatcgggagtaaagatcacatagtcctcttgcacttataaacgggactaaaaatgcttttggacaatcgaccaaagatggtttctccagtagtgctattaggatataaattttatttagattttcgttaacgcatttttaaattgctaaacgatatattttgtatgggaactttctataaagtgatttaaaatatcatataaatttatttttatagtttaaaataattaaaactcaattaattatgtgctaattattttttagttttacgtatccgtatttaatcttcaatgaactcaaacagtcaaacgggaccttaaatagtgagtgtaaacatgttaagattaggcatgtcaaaacctataccgaataggtaaatggacatgaataatcatgctcgctttgcctctttgcccgccaaaactaaccggcatgtgaggtatactagacactactgtttttgtatgtactacagttagtgtctaattagtatgttacacaatgataatgtcgtttttatattaaaaccatgtttgttttacctaaagatgcattgtatttgctggttaattcctaagtagttttattaagagtaaaccgtactttggacaaggtttcttacataagttgcataatggattggatcttatcgtgtgctttcactttgggtcaggtttccttttttttttcctcattggaccaggttcatcttttggttgccaccagcccaccaagctggaggactacaattgtgtctctttccgacaacccaagacatatgtacttttctatggttttgcccatgaacatatccgtgaaacatgtagcacccgtggataatgggtatgagccaaatgattatggatatgtttagatccactgataaaatttttcaccctgtcatatcatatgtttcgatatatgtatggtgtattaaatataaacgaaaaaaaataactaattacacacattacgtgtaaattacgagacaaatcttttaaatctaattgttccatgatttgacaatgtggtgctacagtaaacatttgctaatgacggattaattaggcttaataaattcgtctcgcagtttataggcggattctctaatttgtttttgttattagactatatttaatactttaaatgtgtgtccgtatatcccatgtgacacggtaaaaattttcaccactaaaactaaacgcagcctatatttatttttctatcgtttttcccatgaccatatccgtaggacatatagcaccgtggataatgggtatgagcaaatgtttataaccgttctacatagtaggtggtatatccgtggacataaatttggctgtgtttagtttcttttaaagttgaaagtttaggttaaaattggtacaatgtgactgaaaagttatatatgtatgacagattgatgtgataaaaaaagttagaagtttgaattagatctaaacacagcctttatctcgttggtacaatgtagtactacaatggtacactgcatgtttctttcaaaaaagacagtacagagggagaaattcgagacggtttgggtgtttgactatttgggctggtccatcgctccgtccggcaaggtggccctgaacggtgggcccatcatgtgtcagcccactggcatcgacggcctgccagtgccggcctgccgggctgttcgctcccggcgcgtcgaaattccttgcgtgacgtgtcccccccttccggttttcttcaatctgtggtcacgccctctggaagccgagagcccgagaaggcggagaccccgggagcagaggggagagcagcgcagccgccatggaccgcgtgcagctcgtgctcctcggcctccccatcctcctcttctgctccgacctcgtcacgctcttcgggccggagcagctgcccaccccgcagcccgacctgccgccccaccccagccccgacgcggcctccgacgccgtccagcccgacgacatcgccgccgatgccgccgcttccgcgcagattgctgtaagtccgagcttcgctgctcgatccagtgccaattttgatcttcgatctagtttgaactagacgagtcatgtgcttttccctctctgttgactcttgtgttgtaggagccgcaggtggatgggcctgcctccggcaccaccgtcgagttgaagttctgcgcctcctgctcttataggtaaaaccatgtactactcatggcttctgtcatctgtggagttgttagctggtttggtagaatcgatagtgtcgaataatggccagtgaatcacagatcaaacccgacaggtttcgtcagatttccttgtagccctagatcgcaggggttcagaactatgtatcaatagttaagaccgcgttgaccatactgatatctagagtacaagtttctattgtacggccggcctatagcttttctgttactgtaaggccccaaaatgagatccattctgaatttagatttgagttcagtgtgcaacacacgagcacctaacttatctgagctgataccatgagctcaaactccaagtgtcatcatgatgggaatggctggttgactgtaattataacacctaagtaacctgtgcagaagccagaaataggtggagtcataccttgttctagtaccgtacttcctaatactggtcgtcttctagttcttttaagaccataataaggactgatggtagttgtcttctaacattttcatatatgatctgcttcctgtgaagcatcgctgaaacttcttactgtttgccaatggtattgcacaatgggaaaaaaaagcacacacattttatttttcaaaataatatcgaattcttctgttttcatcttcttaattcaaagatacaccagcattttctgtattcactaaccaacagtcctttaatttattttttacacaaggcttgcgccatgagttgagtttgagtgccttcatatgtttttggttatttttttgaagtgaatagcttgtgatgagaagaataccacttacatagttccactaactacttctctcttttatgcatttctagtgtctgttgggtaagaatgcagattctcagtccattcatttatattcttttagtttgtgaatgagcatgttttgctccaaacatcttggttcatcctctcaggaatgctctaactcttctctctgacctagttcacacccacttatgctcgtgggttattatagagtctggaatgctatatttctgtggacttcgctgtgttttttgctccttttttatgcccatggcatgctaggagagatgaactgagagaaagaagagttcatgctgaacatatctttgtttgactttaaatgaataaacttgtgttgatgtgatgaccatttatttcaacatgtaatggagcagaaccttctttcacatgctctagtgaaaatgccttttgttttctcttctatgaattggtttgtgagttagacagataactttaagtcgaattctgcaggggaaatgcagtcaccgtgaagaagatgctggaaacctcatttcctggtattcatgtcgttttagaaaattaccctccaccattcccaaaacgcgcactcagcaaagctgtaccttttcttcaagttggagcaatggcaactttaatggccggtgatcagattttccctaggtttggaatggttccacctccatggtactactcgctccgtgctaatagatttggaacaatggcaacaatctggctgtttggcaatttcgcccagtcatttctacaaagttctggtgcctttgaagtttactgcaatggacaattggtatgtttgttatgcatacatccttttttttgctgcagtggttcagtagtacttttgcttgtgttatgtaatgttagaatcccccccccccccaaaaaaaaaaaacagccataagatcttttttatgcaaaccagtacagcaactgttgtttactatggttataacccatggttgtttagtgccaaaatttctagttattatggtttgcttcaatgggattttctttatttatataatctctctcgaaagaaactggcattttggagccctcagtcatagctgaactgcaatgatgctagactctgtagctgaatctttgactcaaaatgatctgttgtgtggcacaatatcagttagtggtgaaaccttgaagccagagtaaagttgctgtagaagagagctatatcttgcatttatatgtgcaagttgactgtccatttatctgtctattggagttctaatcccaagaccccctagttgccatcaatttttttcagacccttgcattgctgtgtgtagtgatacacttgaatgattagattgggttcatactaaattagtaataatcagtagactagctgtttcaaaacaaagagtagcttgcatgtttcctaaaactggtttgcaattgtacttattccctttaattaaatgaactgtgcaatctttgtcctgatcacttaataatgttcaccaggcgctaggtgctagttgggtggtagaccagctcctagcaactaattggcaatttggtgggctaggtggctggcttttagaacacagttactaaactttgtttagtgtgtttgaggtgttctgtttttttttttgcaagattaatttcttacgcaatccatctgttaacttttgctttgtgtgtatgaagttctcctggtttttcttttgcgaagcttaattcattatgcgctccatgtctccatttgtacccgatacactaactcaattcaatttctttcttcaggttttctcaaaattatccgaacagagatttcccagcgagtttgagctacgggagctcattggcaacaggttaccagattctcaattcgggaaaaatctggaaaaggtttggtcatagatgttgatgtcaagagagcccacttcatttacctgctatttaattgatagaaccgcttgaaagtttacgcctaattgtcaatcacatgctatttgtcttcttcttttgtgaaggcaggtacttttctttttgttgtaaataatgttttaccctcgcaaagaaagtgaaggagttctgtggctatgttagtttgttagaactgtcatatttactcaaagaggatgtgaaccataacgccccttctcgagtattcctaattaattatcagaaataattactctgactttggattggaagtgcattttttccggatatgttctgttgccctggttaaagcgtcatttgctgtcgcaaactactagatgatgccctgtgctttctgcgggatatatgatagatattggagaaatgatgaaatgatttggtttgaaatattataaaaatgatttgagaatgatgattgagcattgtactcctatatgtttagttttaaaatgaaattaattgaaggtataattactatgcttgcatgttgaactttgtgtgcttaatgggttgatgtgatatgtttgtatgtaggttttaggagtgctaataaatactatgcttgcatgcttgagttttaggtgtttagtggacattttctttatagaaagaagagattcatttgaaactctatgactgaattgcaatgattcagctatagctagctcttttttttttttgaaagtacaaacaaataaagattcagacatatggtggtgttattaatctcaatcctattggaaatgatattgatcctgatatttgcaacaaaaaaaaaactgattctaagatagtcctcgtggcctctcctcgaattcatcagattcctgattctaagatgagccccttgatcgccggagagcgacctcggcagcgtcggtcagatcccctccccgcctgcgggcgtagaaaggtatgggtccgttgccggcgtccgggaggagtaccagggatcaaactctggccagtggcctgctcctgggctcctggcgctccctctcagctgcaggcgtttcatcattctcagcaaccgagatgagatgaggttatctcatggtctagtggcacttgcagatgtttacagaagtaccagagttcaggccatcatatgagttctcaaaaaaaaagggggccatcatatgcagttaaactattctctccatttcgtattacatgatgttttgatttttttaaaaaaataattctttttaagtttgaccattcgtaggaaaacgtgccaatattttttaacacaaaacaaacatactatagatctaatgttagacttaataaaattaattgtattgtagatgttacaaaattttcgtataaacttgattaaacttaaagatgttttacttagaaaaaaaaatcaaaatgtattatagtatgaaacggaggaaattaaaggcaagcaggctggctgtcgttccccgtggatgatgcaggacagtaatcttggggcttgtttggttctttgctatgtactccctccgtccaataaaaagacaaactctggtttccgtgcccaacgtttgaccgtccgtcttatttgaaaaaattatgaaaaaaattaaaaagacaagtcacgcataaaatattaatcatgttttatcatctaacaacaatgaaaatacgaattataaaacaatttcatataagatggacaattaaagttggacacggaaattcagggtttgccttttttttaaaggacggagggagtgtaaccttgccaaaaaaattttggcaaaaactggctaggtttttgtttagtttgctaccaaagttgtatttaggtatttaactaagccaaataatttggcaatggcaatttgacattttctttggtttggctgagttagagcaagttttatgaaagggatagctgccaccttcaattttatctttatcatctctatataaattaagaagtagtctgtacagtatgttatctctaaacataaatctcaataaatatatttattgaagtttgtattggggttgtatcttacacgagggatggcttaattctttctttcatctcttctctcttccacaacagtaaataaatctacatggtatgtagagataaagtgcttacaaacttatagtatttgctcttagaccgtaaaccaaacaaacccaagaagcctgataaaaaaagccagtgcacaactagcaacagcaattcaggtcggtaatggttgcaagtaaagcgttgcattgaagacgaagttgcaatggttggtcttcaaagatgtactataagtactgtcacagtgcgtacaaacctttcagagctactgctagtaagttgtggcattaattaagccacatttaatcatcgaactgcaacatgttagttcgcaggaagtggtcagcgacagctttgtatgtggcttgcgtcggatggacagagtcccagaacatgaactgggccggcgtcgtgcaggtcggcatcagatcggtgcacaggggccccatctccagcagcccagtgccgcagcaccccttgccagtttcggcgaaacctgggttaacagaagttccgaaagcaacatcaaatgctgtcaattctgtaaaaaacaacgccgaaatttttcgatcggtttcggcttcagattttcagaagttagctctttactcaccatacttctggggatgatcgaccatgtccgtgagaggggtgtagatgtcagcgtacacggctttcgctccgggcgaagttgactggaacttggtgagcattttgcggagcttggcgttgtacttctccgcctccgcgttctgctccgcgatgcagccctgtggcctcggcggctgcctcagcgccgccagcgtcatctgcaccgggaggcatccgaccggcggcaatccggcgaccaggagtctccgggcgcccaggttgtacaggctctgcacattgtttgaccatatggttaaatcttggaaaggtcaaattcaggttttacagcgaggttgggggactcgacacgtttgaaggttgcaatggtgcagcatgcatgggcagatccactgtgttgatggataggattcgatcttgcttgttgaaacttgaaacagagtgcctaactaccctaactgcaattgcttcttgccattgtttgcagagcaagagagatcaaggactacatttgcacctgatctcgtgccagaaatgcaagtgcaatcagtatccttactttccaggaacaaagcacactacgcacaagtgcaatcacagttagttataaactgcgcgagaacttctcacgaaaatggcattagcacaaaagtgcaatcacagttagttataaactgagaacttctcacgaaaatggcattacggtgacgtcgatatagatactaatttaactaatctccgaatctcaaaggtttcgcatgcaacttgcagcattgtagctgtcactagaaatggaccgagttaacctgaagaaacgaatggaattcgcgaagaaattaacctgaatgtacgatcggagcttgccgatgaggagggcgtgatactggtccagcgtgtnnnnnnnnnnnnnnnnnnnnnnnnnnatgatcatgtcgttcgtcccggccgacacgaggaacagcgacttgttcaccacctcaccggccttgccggcgcccatcctcccgacgagctcgctaaagtccgcgatctgcgaggccatcgtcgcgacgccggcgttcgtcgccgtcctgtcgtcgagtcccgagccgccggacgcgaagctgacccccgtggcggcgtcggcgtcgctgaggacttcggagccggagtggtacgccggcaggaggcccttgacgccgagcgcctccacgaggaagtcgctcatgatcttgccgtcgcagaacctccccgtcggcgcgccgccggggaagtcctggccgtagggcgggtggtcggcgcgcaccgcggtgacgaggcggttgttgttgcccgcgtcgagcgtggagtccccgaaggcgaagacggccggtatgcgtcgcgcgctcccaccccgtgacacggcggcagcggccgcgtcgacggcgacgacgacgatgccgtggatggcggccagggagaagaggagggcggcgagcgttggcttgagcgccatgtgggcaacgtacgcatgcacgttccagctaagatggtgtacacgcacagtgcagttggtcgctcgtgtttatatatgctagtagcatcaactgctatcagcattggccgcttgtatttacgagcagcctgtcaactaactctttgtcattcttgcattgttcatcagccccagtcagataatggcacaagaggcgatgtgattggttttaaatgaccatgcatccatttaagcatgcatagaattcaggaaaagagataatctaatcagtaccattgagttttatttggttactagggtttgaaaaaaaaaagagataatccattccataacattgacaaaggatgaattctacaatataccaccgacaaaactgagttttataatatagcgttgaacaactagttttcttacttacataccattgccgctagtcaacggttagtttaattccgttaagagaaagaaaatgtccattttacctctagggtaccgtgcgtacgatcatggatttcattggtcacgatccactaattcttctcattgatgaaaaatagaaatcacttgtctttctatcatccaagattatttaattaggcatggcattgtgcaaaatctcaattttatcctaggggtaaaattgccatctttctcctttaatggtgtatgactaacggttgactaacgctgatggcatataaggaagaaaataagttgttccaaggtatattgtaaaaccgagctttgttagtgatatattgtagaacccgagctttgttgatggcatagaatggattgaataaaaaaatgatgaagagcatgcctatttggttccctcattttgtagtgttggataaaacacatactaacatactaactctagaaacaaggtagcaaaagacgcataaaggctcctatatactttctccgtcccataaaaaatcatctctatattaaagttcaggattggagggagttggaagtaaccagatgtgatctatcctgactccctgagtatgacaacgtttgttaaactgtgatcaggtataaatgggtgaaaagcgatcttaaaatcttaatagactcattacaccggtaatcatctataaatgggtcaaccagcctagcaaaaacccaactactgtatactacaactgtatgaaaacagtgttcattaaaccggtgatcagctataaatgggcacatggtcttctttaccgcttccattatttccgtcagcaaaaaagaaaaacaatagtttgccactactgaggttgctcataattctccttaattcaaacatgattagcgcttaattctcataaaaaattggtaactactcatgcgtcataaattttgtctcataacaaaaaacaaaaatatgaccctttcggagctatttttttcgtgtcatcatgcccgtttagaatgtaaaagttttcctggtttttatatacgaaatgaaattgttcacatgaaattcctcctatgtttcaaatagacactagattctttcttaaaaatattttttttccaaaatacccacactcagaaatagaaaatttgaggatttgccactgtcaatcatgcgtgagtcttggactctcttccctgtcaaacacatgtgattgacaaatcctaaattacgagtggcaaaatcctcgttttatccatccgtttgtccattactgcggtggtcgaagtcgttagttggaggttggaacttgtgggagtttgggagcttcagagttcagaaatcggtatggtcagtctcatcagtgcccatctcctctcgctaccctcatccgcgccgcgctctcgcccgcaatcgaggccgcccctctcgccgcccgccgccgccgccgccgcctcctgctccttcgacctgccccggccccgccgcctcgtcgccgacgggagccggaggaaggggacgatggctgcggcgatcccgcccgaggcaagcggcctggcccacgacctcgggtccgcggccgtcaccgcaggcgtcgccctcgccctcctccgcttcttcgaggagctcgccaagcgcggggtcttcgagcaggtcagccaccgccgcctcttcgcttcgccctttcccccgttggcgcgtcactggaggcttctagtagctaaatatctccaactaagatgcatgctcccttagtagccattactatttgaatttcgatgcaacagtaaggaggtcgctactgaattacacgctcactgactcatactactgagattcccatgggtgggtgacgagacagacacgcagatttggattcgtttctcgtatttttgccaaggttgcatgtacgaacaattatatttgtgtgatcatcttcacggtgctctgcgcttctcccaagcagtacaacttgtttgttaaaatattcagcgcaattagtcccagcctccaagctgtacaggagtcccatactgctaagtattaattgtgctcatctgaggtgtctgtttagtagttttactttgagataggatttttaggtggggattagtgataaatgggtaagcatttccatattcttccgaaatagaccctttcagtacaagtctagttagtgcctgttagattcaagaaagatataatggaaaaggtccatggagatgcatgtgaaatatgtcaatttgatggtctaccgttatgttctaagaattccaagttaagaacgaggagcgagggttgcgaagcaaatcctgatatttttgttcaagatattaaagcatatatttagtgcgagaagtaggcttatgagtcttgtatttcattccggtctctgtcccgtgctgttctttctttgattctaaataacttttatttctcttaatggaaaaaatgcgcccctgggtattcccgaattttatgcagtttttattcaaaagtataatgttaccttttctagtttctgttaacaagattgatctttctatcccatttccaacactcgtttagaaaaaaaaaatcaagcatgatatttaagccataaaacccctcagtgtctcactctgcacattgcaactcttaaagttttactttgcagcgcattcatgtgagataatccaccaactgttgttaaatatatttcagaaatagtgaaaaatgaagtataagttcccaccaacaaaaactcagattcacaaaatcttggggtaaatgcacagcacagccttcttaccagtaatttcagatggatgtctgatggctggcattagctcattgacaccagatgaaattcagctaggttctcaacataacatagacatataaactgaaccatgcaattagctgacaaattaacagtagtttttcttattgagatttgcttcaatacgatgatgctttctattgataaattccatttgtttgcctgcagaaactcaatagaaaacttgtgcatataactatcggtatgg

SEQ ID NO: 9313 - DNA, 11317 bp, Oryza sativa
cttccccccccccccccccccccactacactttcaggaatagcagacatagtggggagacgtcttggccaagaaaagcttccatacaaccccaacaagtcatatgcaggcagcatagcaatggcactagctggtttcatggcttcaattgggtaattatttgagaggcttttactgaagttttctgttgcatatgtgtttttaagtcattcattcgcatattgttcaggtatatgcattacttccagtcattcggtttcattgaagaaagctggtccttggcttttggcttccttgttgtttctgtaactgcagcacttgtagagtcccatcccatcagcacacatttggatgacaacttgactgttcctttaacatcattcctagttggtagccttgttttctgatgtttacctttgaaggaaaattactgggagatcttctgacatgtaaggaatatttcaataaggaactttggttccaatggtatgaacaaaattgcccactggtacttttaccaactagcattatgtacttccttgtgaaaaagaaaacattatatactttgtacagatttagctagatatttgaagtatgtcaaaaaaacaacctgctttttatttcttccatttgctccctaggttgatgtgcgaataagcattctaaaatgatccccattgaattactggcttatcccaaacgcttaagtgatgcactggatctgttcaactagcatcgattttcagtatccaggacggtaggttcatgtccctccttgtaaggctttttttctattgcaggttatgaaacagtgtaactttacggttcccttattccgataacctatagaagtttctctcaagttggtaagttgataattcggctatgctacagcggaggtagacaagcctcccagcatttcagtaatcctggcaagcattgagcatacctaatcgattactctgaactccttgttgggattcaccttcatatttgtgttggatcctgcaagcaaatcattaaccctaaaccatctagcctatatttatgcttcggccttcgccacagcatgcattcgtgtgcactatacaactcgcatgatccaagttgtggttacaaatatgacaggatgacatgactgtgacttagaatgtcccgttgagatccaatccccagctgttaccccatcacagtcaaccttacacggtcactttacgataaaagagatggttctccatttcgaggacctttggagggggaatatactgaagagcgatcccatgggaccaatctccagtattcagatgcaaactgtacctccgttgtacagatcatttttcagataagaaaagcaggatgccatggaaatttatatctgaatagcatggttttcttagctacagcgtacatgacatgattcagccacatgattaatcaaacaattgcctgcttttatttttgctagggaaaaaaatgcctacattgacctatgtatacaagagagttcttatcaatggtgacggtctctctttttttttttatctttatttcgtagtggaattggattctcgaaactatgtcttatgtcttaaatatgtagttttgtgatactttatattaatgtgtactccatccatctctaaaacaataaccttttagctatggccactgtccaagttcatagctgaaaatacacttttttagagacgaaacaggtagtttcgtaataaatttggtgttaaatttatagttatgttatacactgtcttgaatttataaatttacaatagtttaatcaaatggtttttctgtttcacttgcgatagctttttttggctcctatctttcattttttcatccacaggatcttgcatcaagatttgttacactcacaccgaaaaatttatagttacatgtttgtttttttatttgtttatttcatttaatacgggccctattcattggttaaaaattctataatatttgaagctataaatctgacgaaagattaataggttagtcccatcatttgaatgtacctttgtaaaatgtacatactcaataccgaagactaattttgatgcatctaaacaacttggaattggacacagtaccgataaatagatgaatttcccaactaaagctggcgactttactgttatgtatcttaaatcgaagcccctaacacattccaaaattggagattctcagctgaaaggctatctagcgggcatccgcatggctgcccccacaagcatacatgctggagtggaccactcacatgtactgtcagcatatcctacgttctctcctgtatcctcccgtgcatcggacctcggttgacaagcagttcgtttgcacaaaaaatcgcaaagaagtttaagaaatcaatgaaagacttaacaagaggttaaggaagaacaaactgtatgtatccctccatagtctaaccatgggccagagttgccctggttgacccggaaaccggctacggctccccacatttcgtccccacctcgcatcggttcaagcgcgcgtcatcacgactcgcgagagctcgtctcaaaccaataattaaactcacaaatcgccatctcggcgcggctattaaacgcccatcacaacgtagctagccggccacttcgcgttccatcgctcgctcgctctctcgctttgcttcgagctgagaatgcacctaaggatggcgtcgccgccgcagcccgggccgtacatgccggacctgccggcggtgccggcgtggctgaacaagggcgacaccgcgtggcagctggtggcggcgacgttcgtcggcatccagtcgatgcctgggctggtggtgatctacggcagcatcgtgaagaagaagtgggccgtcaactccgccttcatggcgctgtacgcctacgcgtccacgcttatcgtgtgggtgctcgtcggcttccgcatggcgttcggcgaccggctgctcccgttctgggccaaggccgggccggcgctgacgcaggacttcctggtgcaacgcgcggtgttcccggcgacggcgcactacggcagcgacggcacgctcgagacgccgcgcaccgagccgttctacgcggaggcggcgctggtgctgttcgagttcgagttcgcggccatcacgctggtgctgctcgccgggtcgctcctggggcggatgaacatcaaggcgtggatggcgttcaccccgctctggctcctcttctcctacaccgtcggcgcgttcagcctctggggcggcggcttcctctaccagtggggcgtcatcgactactccggcggatacgtcatccacctctcctccggcgtcgccggcttcaccgccgcctactgggtaaacacacgtgcaaccgtgcattgcatgcatcgtgttcgactgtttgttgcactattcacacgcctccatgttacaacgtgactctgacaggtgggcccgaggctgaagagcgacagggagcggttctcgccgaacaacatcctgctcatgatcgccggcggcgggctgctgtggttgggctgggccgggttcaacggcggcgcgccgtacgcccccaacgtcaccgccacggtcgccgtgctcaacaccaacgtcagcgccgcgacgagcctcctcacctggacctgcctcgacgtcatcttcttcggcaagccctccgtcatcggcgccgtgcagggtatgatgacggggctcgtctgcatcacgcccggcgccggtaacaaatctttcgtccgatcaaaaccacagcacacacacagttcatgggtccaaatcctcacgtacgttttgcatggacgcagggctggtgcacacgtggtcagcgatgctgatgggcatgttcgccggcagcgtcccgtggttcacgatgatgatcctgcacaagaaatccaccttcctcatgaaggtcgacgacaccctcgccgtcttccacacccacgccgtcgccggcatcctgggcggcgtcctcacgggcctcctcgccacgccggagctctgcgctctcgattgcccgatcccgaacatgcgcggcgtcttctacggcagcggcatcggccagctcgggaagcagctcggcggcgcgctgttcgtcaccgtctggaacctcatcgtcaccagcgccattctcctctgcatcggcctcttcatcccgctccgcatgtccgacgaccagctcatgatcggcgacgacgcggcgcacggggaggaggcctacgctctgtggggggacggtgagaagttcgacgtgacgcggccggagacgacgaggacgggaggtgcaggcggcgcgggcagggaggacaccatggagcagaggctgaccaacatgggagccaggggtgtcaccattcagttgtagaagacgggaagggtgtgcttgctcgttccagtgattctgatgatgtatggcactgatgtatgttactttcaacgtttagtgttaattcggtgatgtaatgctggtgtagtttctgttattgttaactgaattagttcatcgaaaacatgagaattatctggttaacaaaaagtttatgaggtgaacttacgtactcccttcctttcagattacttgccattccagcattaagatttttattaaaatagattgcatgtcataaacttagattgaagtatatctagatttataaacttggtttaatataatgtatcatatttaagttcatggtacaaatgacgtagcttgggcactgacaaagataaggattttacatttaggactatcttttacaatatgctttcaagtcgatcctcaaactcaaatatttttctgcatgacttatgtaacgccccgtaataattagataagaaaagaaaaataaaagcaagcagggagctaaccgtggaattttttttatttatactttttttattaaaatatttacaaaaataatttgttgtttcgaaaatttacaaatctaatcgcctgccgccctttgggagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattggatggagataaactttatataaagttgtagatcttgatgagatctataactttgtagtttatcacttttccatttaaaatcatttggagtatcgaataagcattattagtttttaagcaattaaaaccggtgggaagggtttgatcacaaataaaaattttgtatttaggtcccttgccgccctttgagagggcgatttttaaaaatcgcccttcttaagggcggcaggcaattagatttgtaaattttcgaaacaaaaaattatttttgtaaatattttaataaaaaaatgtataaataaaaaaaattcgctaaccgtgcatgcagcaacagctctgctgttcttgggcctagcccatggcgactagctgcagcagtagtagtacagcgagggaaaaagtacaccgaaggtccctcaacttgttatcgagataaaaaacgtcctccaaccataaaaccagatatgcgggatccctcaactatacaaatccggtcatccaaggtctcttggtggttttcaacctggttttgtccgacgtggcggctgagtcagcgtgggacccacatgggccccacatgtcagctggccacatcatcaccctctctcctcctctccctttctcctctctctctcactcttctcgtttggtgctctgggtagaccggcgccgccggccgacagggtgatgcgggagaggaggtccggcggccggcgacgtcgcggcggtggcggcgacggcgacgacgacgcgggagcaggggagcaaggcggcggcggcggtgacggcgtgggagcaggggagctctcgccgtcgtcgccgagggcccaaccacgatcttgtagcagcgtcggtgtggcgacgaaggggaacccgccgaggagtgctaggaccacgtcggcgcctggctcgctcagactgccggaactcgcccagcgggtcgtcggactgcttcaccaccgccacgctgccgtcgagccccacaccgacgccatcgtcgccgtcacggcagtctcctggtttgtccgtggcatcgccgttgctgccgttcttctccttcctgtcctcctgtgatggcaacggcgatgacgacggcggcgagtgcttcttgtcgtggttctggtggtggctcttccggccccacgacgcgacgctctgctccagctcgctgagctcgcgcagaaggccggagaagctctccggcccgtagtcgccgccgtcatcgtcgaactccaccacggagcgctcccacaggaaggacgacaacgcggacgttatggtaagagtgtcggtcgtcgtcgaccccgacgggttcatcccagcgctcctgcgccgcgtcgccgttgtcgacggcgtccccaccaccggcgccgagacggacacgctcttcgcgtccttgcagccgcagccgagcgtgaacctcacgccggcgtggcgcttcttggccgaaacaccaggactcatcataccctatgatctcgtcactcactagctaagctgcatgtgcaaactgtgcgtgcgttgcaagctcaaaagagacttccggtttctctcgtgggctcgcgcgctgcaagcatataaagcaacggagatggcatcattgccatttgccatggcaagcgtgcacaagtgcgtggtccacgtcgccgccgccaccgccgacttctcctcccactgcctcaccgccgccgccgcggtgagttcttcctcgtcgtttcgctgctccctccgcggccactccgccgcggtcttccgcctgtaaaattaaaggtgtttttggttattattctgtgacgaacaattggacattggagattattggttttgttatttggaatttattcacgaagtggttttggagatgattggatttacaggtgaatcgcaggatcgttatttcatgtgaccggtcagaccgggcagtgtgtgccggtcagactggtgtgtaatgcgcggtcagactggcgcagcccgcggtctgactggccgacactgtgtcggtttcggtttcgggttgtttatttggatatccgagtttatttcatgattatggcttctagatggatactatacgtatgtaatactattgtttgctgctaatgagtcaagttggagatagcttggtatcggaatatggtttctttgtttgtttcatgtgtaggtgactcgatgtcttgggagagtatttgcggtgatggaccgggagtcggcttggggataagacgacgtccgtgatggtcagagatcatgcgggatacttaggctagagttgatgcacgtggttgatggagattttatatggcatacgatggaggtgttgtgtgcgtatgggatgcggagtcgaatttggaaggagtccaaatttggtacgattggttatgtaaagtttctttcttgtactagagggtttcctaaggtgtttaggactcttagtatgagtttggttcgtggctttaggctgcctacctcatgtataaatagagggggagcgtgaggcttcccggtatcgctttagagagcaattgagttgagtttagagttagggtttcgagtttagtcgaaatttttgtaaggagtgctgttggtgcactttgtaaacacagagagaatcaataaagtcgtcatctactttaagagttcttcaatttgtgtttcaccgggtttcggcggtctaaccggcgatctaccggcggtcagaccggcggcaagcggcggtcagaccggcgggtgcacggcggtcagaccggaggtgacgacaggcgcggcaagcagcttcagcggtcagaccggttgatctataccggtcagaccgacgacatccgagcggtcagactggcaaggcaacttcggtcagaccgatctccgtcgattttgagggtaacttttatttccgctaaaagttttcggtttttgggtataccaaccattcaccccccctctggttggcttagttcttgtgattcgatcctacaccgccgcccgctccgcgcgcgaccaggcgcacgtcaccgcccgcctcgccgtcctcggccactgccaccacgccgccatcgcgcgcctcctcggcgtctccgcgtcgcccaacggctcgctcttcctcgcctacgagctcctcctcgacgcgtcgccgctcttcgcgctccaccgcaacccgaacaacccgtccttcaccctgctcgcgtcgtggcagtctcgcctcaaggttgccgccgacgtcaccgacgtgctccactacgtccacctccaggccgacaccgtccacctccacaaccgcctccggtgcgtggccaaggacgcggcagcgcgcgccggagatgtcgtgggtcgccgacaagttccacatccccaccaacaactccatctccatctccatcgctccatcaatttgggtttccgccaccttgggcagagtgaagaggacggggcgagcacggcggcctcagcccaaagcgaagagggcgggggagaccggaggccgccgccgccgccgccgcctttctcccctgctcccgccgccgctgccgccttgctcccctgcccagagagccacagagacaagagtgagtgagagagagaggaggaagggagagaagagggggagagggatgaggctgacgtggccagctgacatgtggggcccatgtgggtcccatgctgactcagccgccacgtcagacaaaaccgggttgaaaaccacctagggacctcggatgaccggttttgtatagttgagggaccccgcatatctggttttgtggtcggaggacgttttttatctcgatgacaagttggggaccttcggtgcactttttcctacagcgagcagcagtagctggccttgggccatatagccgcaagcaacagcagcaagcagtgtttagcagcagcagcaagctaaccggcaagcaagaggagccaatattaagggcttgttcactttgctaccattttcaaccttattaagttttggcattgctaaattttagtaagattgtcaaaattttggtaaggttgtcaaattttggcaagatttcgtatgtactaaactaaaatttggcaacaaactaaatgtagtcactttttttttaactttgccaaaaagttaagtttaaaaatggtagcaaagtgaacaagccttaatattaataccatctcgccaatttgaaagagagggagcagcttaaatactttctccgttccaaaatataagtacttttagacttcgacccggttttcgagatgctactttgaccaacaatatttacaaaattttaaaatgtttaaataaaaaattgcatattatgatagtttgtttaatgataaatctagtaacatcaaatttacattattaatcttttttatttctttgctattaatactcagaatttaaaaagtttgatttggtactattctaaaaatgtttatattttgggacggagggagtaggagactggcttgcccgaaaggccggaaccttcaacacagggtacgaattctttttgcatgaagcgttgacaaaaaagtagtgtatcgtagtatatgtgtggttcgactgaatgagttgggcctaataccattttcaggtcttgggtgtcacgcttgtcctaagaatttaattttttggatgccaaaatgcgcttgacgtaacaattttttggatgtcgaaatgcatattttttaatggtgacgatggagaggagaggaggacacatggagatggatgctaggggagtaggattagcggcaaaatggcagtgagatgatgatggtgtagttaatggtgatgatgcggttgacaatggcggcgggattggtggcgcctttagcctttgtccaatctctaagcgcacttagggataagcattcggtctaaccgagaaattcgattctgtttctcggtctttttaaaatttcggtcataaaaaacttaagaccgatcggtcaaaaaaaaaactgaggaccgagcacttcggttttcagttagttcggtttggtctcggtcatgaccgaataacccgagcagtctcaaaaaaatcacaaaagccaaataacaaatataaggttgacaaatcaaaagcaactcaatagatcaagatgcatatgcaaatgcagattcagaaagacaaatcaagctctagcctctatgtttgaatcccgtcaatctccaccaggtgcgccgaatcctacggccgcggtggtgaaggacgacgccggcgtggtggaggcggaggcggcgcgatggaggcggagggcgggcggaggtggaggcggcgccgacgcggtgggccgaggaaggacgaaggcggtgccggcgcggaccgcgcggtggagggcggaggcggaggcggaggcggcgccggcgcgatgctggaggctgcgccgacgcggtgggccgtgagcggatggaggtggcaccggcgcggtggaggcaggcggcggcgtggcatggtgctggagtctggaggctgtgagcgcgagtgtgaggagtccgggcgtgcggcgcctgtgagaaaattgcatatctaccatcccataagaatggcttcgctagaatactattatgaaaacgggcttcgctggaataccatcctcaaccagagtgtcttcgccaaaatgccatcccggacggaaatgcccatggctcttcttcctcctccatcccacgtgtgaagagctcgccggcggccatggctagctccctccctgccatccccgccgcacgggcggcgggcgcgggctctggcggagggctacgcggtggcggcaggcgcgggcgtgggctccggcggatcggagggctgcgcggtggcggctgacgcggtcgacggcggcggccgcgggctccggtggagggcggcgtggtggcggctggcgtggtcgacggcggcggccgcgggctccggcggagggcggcgcggtggcggcaggctcggtcgattgcggctggctacgcggtggcaacgaggaggcggtggcggccaggagctgcgccaccggccccacgcgcacgcgcgctggcgggatccgcacgtcgttgccggagtccttccgcgacgacctcatctg

SEQ ID NO: 9314 - DNA, 3336 bp, Oryza sativa
  unsure (1)..(3336): unsure at all n locations
tggttaattctggtcattgcctggtcggattttcttcacaacttttggttgttcggtttgtcacgacccgccggggtttacttttccggtgcgcgctcacgggtcaggacttacacgagtacttgcacccgtacattagcagtacatgtgacgtgtggactttgtggtgaaacgttcggggcacgcggtcgcgggagcacggagtcgtcagcgcccggggtagactagtcacttgcgtgtattgatcgagtgagacgtgttttggacatggacgatggtgaactagtactatggaaagaaacgattcgatgtagcttaggctcgagcctaatttcctcgtacctgcaaaagtacatatatagacgagttgctagaaagaaaaaaaaaaaaaacagtgctggctcagcttgcagaatccagattctagaacagtacgtggcacgaatctcgacggcgttaagtgttaaccacgtgacggcgattaataaatactttttttgtgacaggtggggccgaggctgaagagcgacagggagcggttctcgccgaacaacatcctcctcatgatcgccggcggcgggctgctgtggctgggctgggccgggttcaacggcggcgcgccgtacgccccaaacatcaccgcgtccatcgccgtgctcaacaccaacgtcagcgccgcggcgagcctcctcacctggacctgcctcgacgtcatcttcttcggcaagccctccgtcatcggcgccgtgcagggcatgatgaccggtctcgtctgcatcacccccggcgcaggtatcagctgcttcctgctagctttgatcaattctagaatccaactagattagcaatttagtactactacactgtgattagccagttgccattcacatagtttcattaatgaggtcgttgaattggccattcgttaattaattcagttggattaacgaactagttgtgtgatggcatgcaggtctggtgcacacgtgggcggccatactgatgggcatctgtggcggcagcttgccgtggttctccatgatgatcctccacaagagatcggcgctgctccagaaggtggacgacaccctcgccgtcttccacacccacgccgtcgcgggcctcctcggcggcttcctcacgggcctgttcgccttgccggacctcaccgccgtccacacccacatccctggcgcgcgcggcgcgttctacggcggcggcatcgcccaggtggggaagcagatcgccggcgcgctcttcgtcgtcgtgtggaacgtcgtggccaccaccgtcatcctgctcggcgtcggcctcgtcgtcccgctccgcatgcccgacgagcagctcaagatcggcgacgacgcggcgcacggggaggaggcctacgcgctatggggagacggcgagaggttcgacgtgacgcgccatgagggggcgaggggcggcgcgtggggcgccgcggtcgtggacgaggcgatggatcaccggctggccggaatgggagcgagaggagtcacgattcagctgtagtggtggtagagtgggcattttgtcgcaggctttgccgcactgcagctaaactggacgttgaccatacgataattctcatctcgtacaggtagatcttgcaactagcaagatggagtagcagatattactaaacacatatgcttcattattttatttctggagtaaatcaagattcgttttggggtagtggtagatatttgcaatctgatgcagtcagtatgcaatgtgtcctaccctgggagtcccaatagataaacaaacttttgccagcattgcacacaagcaaacctcacggtaccatggtttcagtggaatctactgtaaattggttttgcttagttagcttggacaggtctgagaatatctcaaaactgtagagtacgcgaccgcacgtggacgcctgatctgagtctgaagaactgcagaagcaagcctgaagacaggccagtgcaaactgaaatatgacagcctaacagatcaccgaagcaattcatcacttgcatcattcgataacattgcacaggcagtgttagcaataggcgtcaaacttcttgcatatacacaacaatcgtgtgcctgtgaaaggaatttagatacctgatctcacaagttaacgatacaatgagaaaacgcaatccgaggctagtcgaattgctcccagtcggtgtttatttgtgtggaagaaacccgtggtgggggtgcattcaagctgcccatgccattgtcgaacgtctcccactgcgttgtcactgaaacagatttgttttgatcgctgaagggattggcatttcttgccttcagcttatccaacgtctccacaagaccttggacacggcgtacctgcaatgcaagtcatcgttattgtgagggtatgtacagcatacaatgcctccagtgactattactttatgacaacaaaaagattttgcaacagggaccaaacccgtggtcagatggtcatagcagcaacaattattcagatatattaccgtcaagcaaccaaaccaactccataaaattcaaaagggcaaaataaggattctttaaactgaagaaacaaatgaattttgactttattaatatgttacaatacatataagatgttctaccgattaagcttggctcaacaatgtttttgaagcaccctgcgcatgctgaccatttcactggtcttgttcttcaatataatagggcaacaaaaaagtgaggaagctacaaatagcatttcactcttgaccaacaaaggtcctaatctggcaaaattctctcgaaaccaacactaataaatggttataaacctcaggtctatcccatatcagaccaggcatttattaagtataagctccagcaggttttgcattagaagctggattcaaaccacacagccaagttaaaatagttttgtgctatactggttacaagcctaaggctaaatggaccgtcttaatgtggaactgctcaagccacacaactagttcattacccataaccaagaaaataatcattggagtacgggggaaggtcaaagtcaaacaaagaaactagaattagtcctggaaggagttgggagacacccttgtgatgcaaatgaagactataattgattcagcatagcagaaaatagctaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9315 - DNA, 4996 bp, Oryza sativa
atatatatgttctgtgtatacgttcattatacactgattctaacaaaatttagggcacatttattttttgctaataaatcttaccagatcaaccctatcaactttttataccggtgtggtcgtgatgatatatatatatatatatataggagcttgtttggccaaaattccgtcacttttttttcgacaaaccaaacatacctttagtttcattagggtttagatattattcatttatttatctattagaacattaataatggcatctttgattagtgatgtactaataataagtactactccacacgccaaaattaattagaagcatggcattcattaattaaaaatatgacaaaattgaacagttcacacgctaaaaaactaacggtacagtacatatttaatttactatcgtactgcatacataaatcaacatccattcggtcagcttttacctgagaacagtgtactgattgtcatgaacagagtaacttaactgcctggagcatccgttgatttccttttcgttctatgattgttgtacctttttctctacttgcactgtagtagaagatgcagtacttgctatttatataggtgtgtcttgactgtgtttggcatgggtagacgtaatacatacatataggtagagtaggccgatctaaaacttattagcagcatgaaaattgttgtaaaaaagggacaggggtacgttcatctgactcaccttaatttctcagttcatgaaatccaacacgtgcatgcaacgaaaagtaggtgaagggtgctttcatgcaaaagttccatccagctagcaagagtgtgatgcatactagtccaaagcatgcaagacacaagaatgcatccactgtacatatgtaaaatgtcctagtcctcactcttgaccggcccagtctcacttcaccgctaaaacaaaatttcccagcttactagggcgggcactgtaaaatttctagtactatagtcactttccattttgtgtggtttagagatagttcaattaatagggtgacgactttcttttattttctccacaacatatattatcagctaaacgttcacaatcacaattattattttatacatttcttctcaacatatccactaccaccttttctttcttccttgtagtttatggatatgttcaatatcgctaatttgcagcccactgatacagtaaaaatataaagaagatctatattgatggcagctgcagctgctatggttgtacaaccacaatatagaaccgtcgcacaaccattatgtagatgttgcctcatatttttttattatcttctcaacttactacctccgttcataaatataatggataatatttttttaaagaaaaaacacataaacgagtaacgaaagaacaaactatagtataaaatgtgatatgaataaataaactagtgcaaaagttcataggggaaaaataaactaagtagctatatatgtcttaggatgataaaacttttatatttatggacaaactaaaagattatattatattggtagtcgtgtctactgagtacgtagtacgtgccatattaggtttagcgcattataagtatgccaactgaaattaacctaagcagcttattaatcaactaattattactgcgtgcagggaggtgtccgaggagtacgggagagaggtgatcaagctgtgcgagcggctgatgaggttgctgtcagcgagcctggggctggacgagacgcggttccaggaggcgttcggtggggcggactgcggcgcgggcctgcgcgccaactactacccgcggtgcccgcagccggacctcacgctgggcctctccgcccactccgatcccggcatcctcaccgtcctcctcgccgacgaccacgttcgcggcctccaggtacgccgccgtgacggccactgggtcaccgtgcagcccctccccgacgccttcatcgtcaacgtcggcgaccagattgaggtacacatatatgtaggacttatataattaattaatcaaagagcaataatcactatcgtggcttttccatgacctgggattaagaattactcatgattaattagttaagttcgagtcaaatgatgatcaggaataaattagagttgactagctagtggcggccggctagctcgatcgatctatgcggcgatctttcgcgcaggttacgcggcatgagagcacacatgcatggacggtgatgagccccaaccatgcagaaaatgcgcggattgtgatcgatcgctagctccataaatgcatacgagttttctgtgcgtcggtttgaagcttactactctctacctcggacagacatgtgcatgttacggcgaatcataccacgaaccgcccaagtacccaactgcactcaatgcatggccaacgaatccatatacgagtatatatcaatattccatgatgcatgtgcattgatatatgagcataagcatgaatatggtcgtatgtatctggctagctagctagctacgtacaaaatacacacatatatacagcttgcgttgctatagtactctagctagctagctagttgcatcaataatgtttcaagctgttcttctattttaatttctcaggaactaatatcttcttgtactgtgcatggatggaattcatggacggacgacgtacagatcttgagcaactcgatgtacaagagcgtggagcaccgcgtgatcgtgaacgccgaggaggagcgcatctcgctcgcactcttctacaacccgagaggcgacgtcccggtggcgccggcgccggagctggtgacgccggagcggccgtcgctctactaccgtccgatgaccttcgacgagtacagggtgtacgtcaggaagaatggccccaagggcaaggcacagcttgaggctctcaagggccagtcaatcacccaaaacaacgaataataaataattagtaattaattaactaattaagctacaccgatcgatccaacagcgacggcatgctaatccatggatcgaactagcaagctagctagctagcagtcagcattaattatcccatgtatgatctgaatcggaataacacatgcatgagtgtgtgtacatggcctacttaatttacgcaacatatatagttataggccttaattataataagcacatatatattgcacgcatgcgtgctcactatctgaagtatatatgcattatatgtaattcagggacgcgatgctaattagtaattaagtgcatgtaatcttctaccatatatattcaagcaagaaatttagtttgatgtttacgtatatttaccaatggatggatggagaactaaactactgctccctccgtcccataaaaattgcttttctagctctaaggctttatcccacaaaaattgtatttctagccatgtggggtccaaccaattgattcatctatataagtttccttccatcccacataatttggactgctaatgcttgtaattttattaagtatactaattatatgggttaattctctcaaacttcattttaatcatttgtatatatggaatgtatgcatgcagtgggttcattaaataaggttattgtggtcattttctaatcctactattttatcctaaattagctagaaatgtaatttttatgggacagaggtagtagtaaaatatcatcatgcatatataaaaaagaaaatggatgcatggtgttcagaatgtgttgagctttacatatctgaagcactcctttgagatatctcagaatatatgccatgcgcacttctttaatttggaaacgcacgtatcatgtgtctgtcaaatcttgtctaaaaacggatgaagcatctggatggattcggaacattggccattgcatctgcgcatacaattcaactgctgcgagggctatagctagctagcttgctagatgcatgttcctaacctcctacatagcttttgctagctatactgtagcaagtctttcggttgtcgatcggtaggtagccaaccatatgcaatgagccgaacaggagtacatatctacacatggagtatatatatagcacctacaacagtggattgtgattgatatggcatttttggtcaatattaaattaatccataataagatcctactagtgggctccacaatacggatagcaccctttaaaaattcttgtattgtactccccgtcctagaatataacaaaactaacagtgaatgtaatacatcctacaactacgatctagatagagacattcaaatttgtagtactaaagatatgtcatatcacatacaagttatatttattttgagaaggagggagcataagacaagtaaatgtcctatgtagttagggtgtgcgggccatcccgtcattcggcatttaatgaatgaagacttttgggtcctcagttacgctgggaaatggaaaccctaccctgactgggttaggcaaaccgtctccggcagttagcctctcatcatcacaacgtgacagggggtgtcagacggcacgccgcctgacatggagccagtgcgcaagcgcactaccccggctacatcggtcattcgactggtcacagatcagtcaagtgcaccacgtgccgcatttaatgcagcatggtgcgcttgctcaaaccgtcttaaatgcggttaggtgggcactgggagcgcccgtctaacgcggcaccgtgttgagggggtcagggtagcccggcccccgggcacatagagggcggccgctaccccgcctcttgcccgacccccctcggggggagggccatgtggctatgtggggcagcctcctccctatggccctgattcccccgggcccatatcaccaatcgacatctatgagaatcatttcttttctgccaaaaacatatcttctacttgcatgtgtcttaagcacttgcttatgaaaaatggttttgataggtattttgttagaggcaagccatacacctgtatgtgaaaaaaa

SEQ ID NO: 9316 - DNA, 692 bp, Oryza sativa
tgactgatgtgcgcagtgcgcttgcctgcatatatatccagatgatcgtgcagatcagtaagtggaaactaggccttttgggttcaccaaaaggtaagacggataacgatacatgcatggtttttaattatgtatcgaaacaaatatatttaacgataaattaaccgttacatgagatggtgcccggctctaatatatgtttaaaataagcgcatatatccgatcctaaatttaaacgagtatgacaaattttataaatttttaggtatgaacattatcttgtttacctagtttaaactgaattgaatattttagatattgattttagatatgtaccatcaaacataataattagctagttaggcacgtaataatgattatgaaataaagttgaacttaagttgttttgttattaggtatagatatgaatcaaatttttacaactaggtatatatatactcataagttgaaaaaaattagaagtttttgagtcaaatcgtatatttgcctcatatatgtgtcctatatatatactacctccgtcacaaaatgtaagcatttttagtacattttaagatgaaggtagtatctttgttacctgcatgctatatatttgttccagtgtaaatgtgttcttcagttgctgaaggaaatacatctccatcgttctccgatccagggctgcaggaatt

SEQ ID NO: 9317 - DNA, 645 bp, Oryza sativa
caaattagccaccaaagttagttcccgttactttcgtttgccatcgccacctgaattggtacaattaaaaggccaaaaataattcataaaactaacttaaaagataagaagcatgacaagaccatcttgcccctaaccggaaaagatcctcgctggctcgccgccctctcacttgcaggcatgtgggcgaatggggatggacaatcgatgggagggcgcgctgacgggcggcgtgtcggcggacgacgggaggacatgtggccaggcggacagcggacggcgaccagcgtgcatgtcggcggtggttggagtccttgcgacgacgggcaacggggtagggaaaatctcaccttttttgggtaatcttgccggaggtgcgaggaagtcgacggcagccgccgcaatagcagcagcagcacgttgcaacggaagcagcaacgctcgcggctgcagcacgagcacgcggcagcagcagctcactacaggcctgcagcgagagcagcagctgcaacaactccctacgatagcagcagcaagccagcaaggtggtagggctgcagcaagagcagcaacaatggcgggcgcccagagacggcagcagcagggaggggcatccttgtcctattttttgtgagaacccatctt

SEQ ID NO: 9318 - DNA, 2024 bp, Oryza sativa
ggccgtgaagcaaatgagtaaggcggttgtcgggacttctagaaagtaaaaaaaacaaaccccatattcaatttttaaaatctcaatgacaataaaaaggagaagcagcgggcgaggtgtataagagtataattgcagagccgccgacggttgacgggacttctagaaaataaaaatgaatttcaacgatagttatgttcgatttttagaatcacaatgacaataaagagttagcggcggacgggctgtagaggggcatagtggcatcgtttgatgggacttctaaaaattataaaaaataaaactacaagtccatttttttaaggtttggaacttctaaaaagtaaaaaaaaaacaatgataatcatgttcgattttaaaaatctcaatgacaataaagaagggaggcagcgggcgagccgtagaggagtataatggcaaagccgctgatggtttggtgggacttctagaaaataaaaaatgaacccaaacgataattgtgttcgatttttaaaatttcaatgacaacaaagagaagagacagtggacgggccgtagaggagtataatggcaacgtttgacgggacatctagaaattattaaaagaaacccaacgtgataataaactctaaaaactacaaaatccaatttttaaaggttccaaaaaaatgaatagaaattgtggtagatcaagcaagcaaataaagaaggagatgacataaggggtagtaactggtgtgacttttaaaaactacgtaattagaaacacgagaatgataaggtttggtctttcaaagtcttaggacaatgagatagctaaatagctatttaataaattttaagtaaaatcatactaaaaaaatatatgattttgtttgggtgctagacgcgcaattgcgcgggccacccagcttgttctactaatatttggctttatattggtattaaaccaaacatagagtagctaactttgtcctaccaaaaaaattggtagcgccaaaatttacctagattataggccctggatgcacatctcttcacgcctcgctcgtcgttcgtattccgcttcgttcttcctcttgggaatagccgaacatacaggcaagtcatattagcattggcaaaagtttacaaaagtgcaacttagacacaaacagcacgcatggcagcccgtttgccacgataatgatttcatgcatgccacatgcattgcctgcctgcgcctacgtccagatcttacaaattctggacagggagaaatttgggtggtagtgagtgttccagaaactgtagtcgttagcaccaaaacaacggtaaagatccagaaccaagaataatgaaggcaagccaatcctactttttctcaaaaccagataaatccgtttccctccagcaaatggaggcaactgaaaagaggtcaaaacaggcggttgcccctggttaagtccgtctccattacgagaagacacaacaacagcaaacggcaaaggataggatgaactcttcgtatttttatattccattcttaaaaaacaattctgtaacactccagtaaaaagcataactttggggtaacattttacagtgtaaaggaaaaacagcatgcattacgtataccacatatttatccacgtcgggacaactcactgagcaagctatctaagcttggcagaaaatcagaagctcctatgtactgcaaatgtgcgcaattacttgactggaacaaactaactttaatttgcgcgtcaaaccacttggtagttataagtaaccaatcgattcctctgagaaaactttggtgggctaccttccctcagcggacggatggcggtcacctgaaacaagaatttgcaacgcaagaacataaattcaactagaaaaacaccaaatatagaaagttggactgactaagccaaagaggaacggcatgctatgttcctgactgttttctccgggctaacagtgtcataatgcaatcagttcaaaaaaacattcgaaagcccataaataaatttcagcattag

SEQ ID NO: 9319 - DNA, 1139 bp, Oryza sativa
tgcatgtggtatccccttgagatataaaaggaggaccttgcccacttaagagaaaaaagagagaagaggggggggggaaaaacaccggagctcggagaggagagaaagaggaagagggtctttagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcaccttgcgcccctggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggtgctcgagggggtcgaaagatccgcgacttcgccgcccacgagcgatggagaaggacggcgagacggggagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccgttacccgccgttcgtctgccatttcctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggtttgggcgcgggggccagccccccgtgcccccggttggtggtgtcggctgtcgagcctttgtggcgagccttcg

SEQ ID NO: 9320 - DNA, 972 bp, Oryza sativa
atagacaaacttgtataatatttcattaatttgttaattatacaattaattatattatttgatttcgtagagaactcgtaccgttacataataggaatagttaattctatcgataatataagtacatggacaactcatatctcctctctctaagcagcactccaaatctcgcatggcatctctccaaggttgatgtcatgccaatattatgtttttaacaccggcaaaagctttgccgttctacattaatagagaggattattttttttaacgttaaaagtatttaaatggcatgggggaagatctcgtgcccgcgaaaaagatctttgttagatctcccggtgtgggtatctctcgaagctttgctgctctcactttccttgccgcctcttctttagttttagctattatggtggcagtggttgacgccatgtgtcgaaaaatctgtgtgttgtgctcacgcaaaagttcctatacaatgagaatgagaagggatttgagtgacatcttcggcgtccgtggcatagagagaatttgttgccaccactcctctatacggtgtcacaggtttcctattgttgttaggtgaaactgcatctattgacatatcgtcatccatatcctctgtaaatatttgtatttcgctagtaggtttattgttgtccccggtgctatccgactgagagtgggcacatttacgggtttggcatcctcttcttttaagcatatccaccgtccaaacttggtatagtcttgttttacaagccaaatggagaacttgcatttaggatagcgcaacacttacagatcatctagttgaaggtagtttaggctgcacctaggaattaaagattgtatatatgttgacttggtcatgtattctctatttaattaatgtgaatttctagacgatatatcttttgtgaatccagtagctgcatgggtttgccgaattatgtggtagagccagac

SEQ ID NO: 9321 - DNA, 659 bp, Oryza sativa
tgtatgacacagtgggatataataaccaaccttcaaatcactaaatgtatttgatgcagaaaacccaacagatatcgggaagaatgttgatggatcagctgcagggacagtgaactccaaagaaccacttcaaatgaaaaaataaagttagcatggacaccgtggagggaaaactgtgcgatactagaaaagaggataatgttgagaaaacatatacttcttgtacctgcggtttgattgatcaacaagaataatggaccactccaacactgaatttcttgagtcatacctggatgtaaagacaagaaatgaataaatgaatgaaagtaatgaagctatgcagctaaagatcagcttggcaggtgatcagaaaaacttccataaaaaaatcattttcaaacaaaaacatgagccacatcacaaattattctaaagctctaattatactataatgcaatgtataacacgagaaagcaaagccaggctagatatttatttgcatttactatttgttaacataaacaccaagacttttgtcaacgtgcagttaatgtccaatactccaaatagttctttggcagcaaaaagtatttgttaacgagctccacctttcactagtaacctaaactttaaatgctcaatgaaaacttttgcacgat

SEQ ID NO: 9322 - DNA, 7202 bp, Oryza sativa
aatgatctaagtagtggaactagatctgtgcaacaaagtcaagagggtgatctaagttatcaaaagtcaatgagaaaaaaagaacacttacgtagcgtcctcccaagccaagtttgagagaggctgtattattgcagggctttgtatacaggctgtaaggatcgatattgccttcttctgaactggctaggttcaggttctttagacattcaggagaagggtgctcagaggactcaagcaagcatgtcttcttcaggttgtgataagtgttgtcagagatgaggccatgagtccaccaatactcaaaggtaccaagatagtcgtggtagtcatcagtaaccgcattacccacctaatttttcagaaaccaaaaaaattcagaacatacacatactcaaactagaacaggcagaacatggatttcagagatctaccatgaatcctttgagattaattattggattctgaatgcccttgttctgttcatagatgagctgggctaactggggaacgtaatgccctgaaagcaccaaggaaatacatccctgtaagtctttcatccaccaaatagcaagaacagaaaataaaataaaaacttatctcatgcaaacttacctgcatagctctccccagcaatgtagaactccctgtacttgtattgtgggaatctctccaaccagttcaccagaaatgcataagcatccgatgctacaagattaaaaaacaagtgacaagtaatcagtaactgaatcatggtaaatcagggcttagtggatagctcacagaaacaaatggcctcgaatttgtttacctgtcttagcatctcctgcgacgtacagatccaacgtcttgttcgagtacgagaaccccacgccggccggcgactccaagaacagcaaattcgccgctgcaatcaccaacagaaattaaaaacgaaattaatcaacagccagagccactcccagcactgccattgttagcagcatcacttgctgtaacaatggagctcaagaacaacaattgcaaaagctacgcacccttgttccaagaattggggttcaggtacagcgtcttcccgtcgggcctgatccggaacgggccgacctcctccgacgcgccgtacccgaccgacgagcaccccggcccgccgttgagccacaggacgagcggcgcgatgggcccggccgccggcaccgcctccaccagccagtagaagagcgcgcggccgtgcgcctggttgaccgtcacgtagccggagtactgcgagaacctcaccttcgccggctgcccggggagctcccggatccggtcgctctcctggtcgcccgacgccgcggccgccactgacactgacactagcagcagcaccagagccgcggccttgtgagccattacgagctccaaaatctccaatggccggaccacgggacacctgagcgtgccaagcaagaagccttgcacttgctcaagtacgcaacactgctgctgctactgaacaagatgagctataagaaatccagagctactagccaccaaaggaggccaggttgcttgcatggatttcagtgaggcggggtcgtgagctttgatccttacgccaccaccttcctgcactctcattgaccaaggacagctcaagaacccttggcaaccgctaaagaaatggaggcggcgggaggacggcggttgagctcattcgctctgaccagcggcgcgcgggacagagaggtagtgtgcggagattttctcttgctttccccgcgccggggatgattgattggcgcgagtacagctcagggacggaggaaaagggcggatcagatcgcgtactattggcacgccgaaccggatggattgcgagattaggtaagcggctgcgtgcgctacagatcgggcactcactggctcactgctagtgtgctagctcgctctagcgctgtagcgcagcgacgcggcggggcaagtgggggtgtcggcaactcggcattagtatagtggcagtggcggtggtggtggtggcggcggcgctggcggcgagcgagggcgcgcgtgtgaaacggaggtagaagaagctgaaacgagcacatgggatgggactgggagggaaacccccgcgcgcgcggcagcggcagcggcagcgaataacaaaattcgcggaggatgacgcgcgcgccttccttgccgcggcagcggcgtccgctcgtgcgcgcgtgcgcgatggaaagcggaaggcagaaacggagcacgcggcgcaacgtgattgagatcgtgagggtgatttgagatggtgaggcgtttgctaactttgaggcgctcaagacgggatttgcttacgagagacacggtgataatgacgagtcgtacgaaagaacgagcagtctcccagaagaacagtcaccaaactgacagcccgcatcattgcgtcacacgaagaaagcgagatttgtttccgtgagccccacatcagataggagtactagtagtactactctgttatcgatgctccattttaaaaattctccattttgaggaactcgtattacatgagcgcatgcaggcggtatctaggtttggcgtttggccccatgttgaggtgtcgagtgccgacgagctgacagcgtcgaggcaaaaacagtagaatagcatcgcagcatgttgcgacatcgagaaaggaacagtataatccctcctgcaggctgcaggaatcctaggtgattatcccataattccgggcgaagtggcaattccaatttcatgggtggaccgtggttctgaaacttcaccagaatcctagcatttgcggtcgaactccagaggaccacaagcacacaactacacattctcaatgctgcaaccagcaaccttggtagtaacaaatttgcagtaaagttcctgtcatgttctttgaaccggccagtggccacctagctgataaagtaaggcctgttttagttcctaactttttcttcaaactttcaactcttcagttacatcgtttaaatttcaatcaaacttctgattttggcgtgaactaaacacaccctaaaagaagaaatttctgccatttataactaactactgtaactgaactgactctcaaaattcagcaatgacaaagccagccgaccgcatatcgaaaggccagcaattttaacttgccaaatcggattcaggctcgatggcggagcggagtccctgccgaaccatcatctgcgcgtagaattcggcgtgttcctgttcaggcaagcaccaaagtagcaaaagaaaagttaactaaagctatagcaacatactactagtactagattactagtagcatgtgatgggagcgtgtgtgttgccgccattttcggttggtttcgaactaaaggaggcgggcgtgaagaggctgtggaatttatataccttcacggcgacaatgacgagcgcggcgcctttctgccgggacgcgtggaagagctgccgcgccgcctccgcggtcacggacggcaccacctgcggcaaggccttctccactgcacacaccgcacgcgtatcaacacaagtcacacagcgacgcagccacgcaggcacgcagcatgtttatgtggcattcacagcgttagcgatgcaggcgagattgttcagcttgcagacttgtaggttgcagcaatacaggttggccaggttgtttcgtgagaagagaaggatttgcgtaccaagcttctcggtgtggcgggcgtcgtctatgagcaaaactttgtagctgtcaccgcttccagagcccctcctgtccctcatccttccggtgtcccctcctgtgtatacagtcgtaaatgcgagttaagcaacactgcaaacgaatgacaaatctctctacaaaggacgcagaattgcaaaaagtacatcgttgcacataatcgataaatcaccttcttgtgtcacgggaagcgtgtcgagctgggactggtcgaaggccggccgctccagcagcgcgccgccgctgctggcgtgcggcacggccgccaccgccaccgccttcctccgccggtggctgactctttggtccacggagacgctccgggagaccggagcggcggatgcggtggtcgggaagatgagcgcgccgcacgcagctgctctgctactgatggccatggcagtggcaggcgttgtcatgtcggaatcggaagcagaggagatcgatgtatcgcgtttgatgcgcgcggcaagagttcgctccttgcgtgagggcaatggagggggagaggcgcacacgcacaattcgcaaccggtggaagatgtgagctttgttcttgtggcgatggtacatggcaggatttattcagggtttcagccaagaaagcgccaaaaagccattctgtcgtgtgcttgagagcatggtccatctgtgcgtactcggtagggcgaacgatctgtggctaagcatagctgacccggggaaattgggggctattttggattgaagccaaaacatgtccctaccaaaattttggtaacttaaatagtaaacgtgctagtttggattgaaggccaaacaattggtagtgtcgttgctcaatttggctatattctagaatcttcttcaccatgtatctatctatctatctatctattatattattaagacagctcgaaaaaaggcaccacgttcactgtggagactagaaattctcagattaatcgaagaaaaagaaaaaaaagagtccaaacagaaatacaatctgaaaaataactggaattcagaatttaaaaaaaggctatattgaaagaggagtccatctaaaaacccaatacgtgattaattaaaattcggaataataaataaataaattgttgaaattagaaaaaagaaaaaagaaagttcaagtaggaatacaaatttgaaattactaaaagaataatggtctagatttgttgtacacaagataatcatatcaatctaattatagatcatacaatccgtactaggagtccttgtccgtttagaaaaatcaattgcaaaactgtacagtatagagctatgattctaaaccaacatacattgccgcacatatatagggtggagataccagaccagcacgcttaggctgcagcagcagaaaaataatatagtgccctcatttcatacgagtaagaacccaatacgagattaattaaaattcaaaataaaaaataaaataaaatccgaaataagaaataaaaaaagaaaagaagagtttaacttggaatgcaatttaaaaataactgaaattcgtaataaaaaataaatattatttaaagaatacaccatctagaaaaatacgagattaattaaaattcgaaatgaaaaataaaataaaatccgaaataagaaataagaaaagagaagaagagttcaacttggaatgcaatttaaaaataacttaaattcataataaaaattaagactatttaaagaatacaccatcagaacactgtcagggttatggataccacatacctaatagtagttgactaaatctcggcaggatccaccacataccatgtactatacggaaacaacctgcggatataggaggagttccggataaggaaagacaaccagagttctacatggaaacgacaaggactactcggattgtatccatattggtttctttatttttacttggacaaggggacacctataggtataaatacaagcccccctaggaggagaggggagagaacatagacacggacaatcaacacacgaccacctcaatcaacacccaacacaatcgacatagaagcctacatacgccaagacacgccgccggatatcgacttcagggataagcacggctagtaccctgcggtgtctccggatactgtcaggagagacgaaagcgttatctctgatctcgccgggcacggattcgaggaggaaggctaccctgttgtcgactacgagtcagaacttcagaccgccatatcgacaacagttagataggctaccccaaacattgtactggtgtgattatggtgaataaaagcaacgaccggctccggccaacaggatgtagggttattacctgacaattcaggggcccgaacctgtataaaaatcctcgtctccgtctcttttacctcagtctcgcgtataccctagcaccgacgatcctcatatcatgcaaataccagaaccgcgacatcagacgtcgacaaacacataacgagattaattaaaattccgaataattaataaaataaattctgaaaatagaataaaacaactaggaatataatttataataaaatctatcggaacgaaaaatatggaaatttcaaaaaaaaaatcatctagaacacaacgatgataaatgataataaatatctgagaagcaacagggttgtaaaggagtagagtggtgacagttagggacatctaaaaactattaacaaaaccccaaatagaatcccaatgacaattaaaaggagtgacgacggacaggccgttaagcagcacggtcacgacggttgtgggatttctaaaaattaaaaaaataaacctcaatgataatcacgttcgattttaaaatctcaaatataataaagagtgggaggaagtgggcgagccgtagaggagtaaagtgacaaagccactgacggtttggtgggactttagaaagtaaaaaattgaactcatacgataattatgtttgattttaaaatcccaatgacaataaagagaggaagcagcggatgggccgtagagaagtataatggcagcttttaatgggacttctaaaaataaaaaaaaatgaaaccaatgagacaataaactcaaaaaaactataagatccaaaatttaaaggttagaaggagaatgaatagaagccgtggtagatcgagcaagcaaacaaagaaagggtgaaaaaaaagtaagggatagcaactgatgtgactttataaaagttataaaattagaaacatggggatgatatggtttggtctttcaaaatcttaagacaatgagatatgtattgaataaattataagtaaaattatattaaaaatagataattttgtatggtgttagccgcacaattacgcgggccacccagctagttatattattaaaggaatagaaaaaggagcctccacgttcgctctcatgacctagaaattctcacattaatcggagaaaaagaaaaagtagagtccatatagaaatacaa

SEQ ID NO: 9323 - DNA, 1470 bp, Oryza sativa
ttatgaccatattctcctgccttacctatctcagtaagtcactatcatcgatttctagttccatttgctctccacgcgtatcatattattgatacattgtcctatgtgcagccatcattggatcctcttcgtaatcaatatcgacgacagtaagatttgtgtatatgatagcttgaggaaagggacagacaattaccaaactattatgaatgcactaaatagggcatatgtgaagtaccgtaggtccaaaagaacgtatgggagatgtgcgatcgatgcaacatcattccggatctttgaaaatcaatatatttatagacaaccagcgcttaccaacctctgcgggatgtacgtcatgtggtacatgctatgttttgtagagtctgggcaccttcttccccgtaatgctgaggtatgacatgtttcagggacttacgtaataaattagactattctattgaagtacgaaagtaaatttctatgccttccacccttgtgttgcagaagttgggtcttgaaacaagcgaaatgctgccacacgtcttcacagctctcaccgactagttttgcgggcctgtccatactcatgtcatagatccaaatggcacttacaatgtcaacaagctcccacaacaaagtgcaatcctctgctcctacccctcaggaccaaaaagtgaagaaatcaactactaagaagagaaaaaccaggtaggtagatttgtgtgaaaaattgtagttacttagtgcttatgcatgaattatggatgtgacacgtcctagtacaatgaatctggacagaccgtgtgtccagattcattatactaggatttgttacatccacccaaaatcccttatgttatgggacagagggagtatgtacaaatgttttggatttggacttacaatatatatgtaaatgtttagagcatctgagatgttgtagagctctagcgatttagtcaagtttcctgggatgtgtaacacatctggtcgccaccttcgtgtggtttgatgagcacatctcaggctgaagttgactggcacgctgagtcccaacaatatctcatttgctctttactcgaggatatgaatgtgaattatatgcaaatgtctagaatttacacttataattttctggacttacgaattttagacttgtgaatttctgacctaaggatatatgtgcaaatgttcataatttagacttaggaatttttggacttaaaaattttaaactaggaatattttgagttaggatatatatgcaaatgtttaagatttaaagataggaacttttggacctacggatttttagacttggcaaattttaacttaggcttgtaggtttttatttgttgtgatgaatgtgaaagtgaatgaatgtgctgtatggatctggggctgtagggatggatttgggtttgtatggaattggggttgtatggatgaatttactgcaatatttttatt

SEQ ID NO: 9324 - DNA, 2982 bp, Oryza sativa
gcaagtattatcagtgctcctttgtgccggttgggaaaaccggcacctattatggttttcaaaccggcaccttttacccttcctgtagtagtgtcctaattatacagtcaattgaacaatgcagctagatggtgtctaagaaaagcagcgtgatgtatgttcacaagctttacagtcgaccaaaagcaatagatcaacctgggagtcacgagttcctgataaattgaaggaagccgacattaaatatacatcatgcgggacagatagaacataaaaggtgtagatagtttgtttcaaatttattagaatgcgagagaagcgatcttgtgcacctgatgtgcaatcaacaacaatgtcctatgctgatgtgacaaaagaataataatgtggtatcactttgcctaaagtgcaccatatagctaagctaatacacttatatatatatgctcaaattttaagttcctgtactagaacgcaaccactcgacactaagtgcaatttattccaaacgaaaacacatccatagagtaataaaactgtaacggcgaaagcaaaagtacgttgttggcggtcaccggtgcttccatcggaaccgggaagacaacgagtgaaccgcgctggcgccattccgtggcttcttgtcgccgccatgtcccacagccgcatagccatggccggcgtcccttggcattgttctccaccttcgacgacggcgacggtgagggccagtagtgatctttatatatgtcttcttcttcctccagtccgagccaagcttcaaaattcttcagaggggaggtcttgccaaattttattgtgaatttattttggtgatcatatacaaattggaggtgtctaaaaggttagcaacttcatcctccaatattttttttgttgtcatattacatttgaagctatgtttggtacacattattgtctctaaaactttgttggaagttgatgagagagaaaatttgtgtagggaagaagaatgtatagaaattttgtttatttacaatttataaaaagtttttataaaatagttgagaatgaaaatatattgaaaattaatctaaaataatagaaaacaaactaaattgaaaattaaaagaagtacaacacattaaatattagtttaaaaacttcaaaaataattacaaaaagaataatttgtgggattattttataattattgtatgtataatgatatgtcattattgtatgactgtttagtgggtttcactttcgttgaatatttttacggtttttttgcatttcatgtagatggatcggcaatggatgtacgcggactagcagtcgaaagagtttattgatgacgtgcattattttttgagagtggccgatgctaacaagcataagggttatatttgtcgtccatgcaataagtgcaagaaccagaaggagtattatgcacttaggattattcatttccacttgtttgagtcggggttcatgcctagctataattgttggacatcgcacggagagctaggggtttaaatggaagaagatgacgtgtaagacgagaacattcccgactgagtttagtacgctggatttgaaggaaatagaacgggcgatgtggatggggatgttgacgataacgacgctgtggatgatcttggttaaatgttgcaggacgccaaggaggactacgaaagtgaaaaggaggcccataaattggagcgtatgttagaggaccactgaacatcgttggaccaggttgtggataggggcacaaaagttggataccactctggaattctagcaatggaagacaaaaaatggtgttagtgacaagtcatttggtgatttattaaaactcgttaagaacattcttccggaggaaaacaaattgtccgagacaacgtacgaggctaaaaaaatagtctgccctctaggcgccgagcactttcaaaggtgaggttgacggtgagggtcggagaagctacgtggcgaggcattccggtgaacatcgtgtccatgatcagcaacactggaacgccatcgattctcgactcgtgggtgaatccatggctacccgcttttttggataatgatctatctaaggatttgtttgtcccatttcgtctgccgttcaacgactcgccggaggagacggtagtccctcgtcggagatggagagccttgggtttgtttcaaactcttttacatgataaagtttgaaatgttttatcaaatctaattttgaacgtgaaatatgctcgtgtcgtgttcgtgtaaggcagttataataacgtcataatagaaggatgtacatgcaaaatcatcatatgaaactgaaaatggaccctggcccacatgtcggtaacacaagcaggggcaaatcctaaagatacatcctatgtggggataaatttgtttttgtctccttttagaggttgccaatttagcgggactgcataaaaaggccatttattattgatagatctaactaattaaactaatgctggatgtatgtttcttcctggtttccagtataaagaagatgtctgccggcctctaaccagtgattctgattacactctggtacagttttgcaaattttgattgacataaaaatgtaaacagtttaggtttctgattctaattataggcgattctaattctagcagaaatggaaatgaaatccatttcaattaaaaactttttatttgaacagggcaccattgctttgtttgagaaatttgataattcgaccctttatattcgttgccaatttgctttaattgacgctggtggaaatgatatgtgggaccatatgagtgaatgagtaaatcaaccacgtttggcacacacacaatgacacaaactcgttcattactgattgatatagtttggcaaaattttacaaattctccatgctttttcaagtgacgcggcatgaagcaggcaggagatctgctgctgtttttcatagatgaagacaagcacacagaa

SEQ ID NO: 9325 - DNA, 793 bp, Oryza sativa
tgacagatgggggtagaacgaatagctctctcaagttatcacaacagccaattgataatgacgttagacatggcaggaactgatctgttgcacaacgagttggctcacctttcaccagcgtggtacggcctattagattaacacaaccaaaaatggccaacatcttcaaggacaccaagcataggaactcttcctccggccagtagatgagcacatcactggacttgatttccaaatacacaagttgtcgaaaccatttccaaatcccaattattggttctgatgggattgtggagaagaaaaagttgcagtgccttaactccatatttgagagagatgattcgtgaatttgatcaagctgcaatatagcttctttgtcaagcacgtccaattttaacttggacaattgggacatgtatctggatttaagcaatggcaatgacagctctgccttgttttcatttagctttaaaaccttcagctttggtgcttcgggtagactagacaactttggacagttactgatttcaacctcctcaagcagaggaaatgttggtttgttttcttgttttccttcagtttccacccaactctcaaacctttccaaatcaattaacttgacttcctttaatgctggaaatatttgtacttttccatctcttgcttcctcgcagcataagctttgcaatttatctagttttatcaaatagagaacttgaagaaacttgaaatgtatgaattgaggaaattcttcacacattgtacagccctctagatggagctccgtcaagtt

SEQ ID NO: 9326 - DNA, 11379 bp, Oryza sativa
tcaaatttggttgctgctgctttctacaggtgaagtacgattggtgcgtctggctggacgacttccagatacacgattggtgcataagtgactgagaatataatatattagttatctttctaaacatgatctccacttatcttgggtaatgtaaattggatcaagcagcttgaagatctcacgctctacaaaaatctgaccttaatgtacacagtaggtgatgctctacttgtggtttttcttgctcatatgaagtgtcttctgaagaaataaaccatgtctacactctgcagtctgtagtattagtattcatgtagttatctggtacaattttctgtttccctttttttctggctgtcttgtatgaccctgattcttttttttttttaggggaacgacggcagaaggactgccggaatatattagacgaaataaaagttatttacagacaagaaaacaacaaaaacacaaaaacgaaaaaaagcatcaaggaggttggaaagccaagagtctttgatcaatatcttgaagaattagggtggccaccctatcaaccgttgtgggatttttttggaagatacgcttattccgtcccaacagaatgagtttcacatcgtcagcagtatgaccttccctaccctcgcaacatcactggatacattggtgaacgtgaggctgtaatattgtttctgaatattgtttggtcaaaagaagccttgggtaattgcatttccattggatcattacctaaattggttaagtctcggtttgatttaaattattgagcttcatgggttgctacaatttagaccgagggagtacaattattgaacttatgtgttttatatttcaatttagtacagaatccgtctgacagctgccattttatcttcaataacacctctattgtcctcacatttatcctctatcccaaaaaataaaaatatttggagcaccagaaagtcacctgaagtgctctgctttgctcagcgtaattcatcttgcacctgcgatgctctgatttcctctgctccgctgaccagtggccagccatgaagctaaagctaattaacatgatgttccacaaatacattcacattaattggctgcatactgggcgagttgcattggtcgtgtctcctattactcggctcattttcatttatgtaaattagcttgagtgatcgtatgagaaatcatttgatgcaaaagttgtatagagattatgagaaggaaaaaaaaactgcattttcggtgttcgaccgaatggttgcgaggacaacgtgtagaatcataaagggcatttcccaccccaaaaactagccaataaggttatgggctcttccatttatatattaagtcatttgctctttcacaaccaatgtaggactatttaacacaactataccgtcttactctcgactgtcatcatctttctgtgtgacattcacaattgtacaaatagatgagttgcactggaggagggcgttcaaccgcttggctggtgagccccacagagactatagacgaggccttgcaattggtccccttccccctgcagctccgcgttgaatcaaatgtggtgggtaaggcccttttgtttcggcttataaaccaacttgtaagtcaaaaagtctaagcctaaacaaataagcggccttttcgtttggcttttctaaagctataagccactctaacactattaagccaaaagctaagttggagaagctattttggcttatgtgaggtagatgtatgactccactattaaacttaggacattaaatccaccggcttataaatcatataagccaataagttaacttaaaagtctaagccaataaatctaagcctaatcgaagagggcctaagtctcgttgtcacattagacttctaaagatttacaatagcaatcaaagaatttctaaatttgaccgataataggtaatctttaagatcatttggcccttagctgagtggtaaatgttcatttgccttacatatgcctttgaaacgcgatcaactgctactgaactgtcaggcagatgatcaattttcacggtataaaatcgtacattgtcatatcttttcaaggatgaaaaaaaaagctgaccatgttaatactctagaatccataaaaaattcaaataaaattataacaatccaagcagcccgaagttgctacattatttagaaagtacaacatgcaggatcatgttttgataagacaaaatgtcgacaacaacaataatgtgaagcacacatataatttatgcttcccactttgcacggacttaacgtggactccagtttcaaacttgacgacatgcaattgaagcaaacctgaaagaaatggagtgcacaaatttcttacagatcgagtgaaacaaaataagatagtaaaagtaacaaccacaactagcttgctacttagagagaattctatttacctctttcatgggttgccagaaagatcatggctggcaacaatatcaggtgtcagtagcatcgtcatcctctgaaccccagttataatcactctcttcgctattatcctcttggacctcttctgcatctgctccgaagatggcaagtctaggatggttgggatttgcacttgcttctctcttgattgcagccaccgcagactcggtatcagaacgtacagtcccctaacggtagattattacgttcacttctttcagacgcaagcggtacctggacctaggactcccgtgtcgctcgctcgggcggcccgggaggcgatagccccaaacccccgagaccccaccaccgaccacctcgccgacggcggcaccgcccccctttgccgctggcggcgcccccaccctcctctacctccttcccaccctcccgtctttctcctagcctccctcctcatttgttgttcttcaatgttctcattccgaatctgggttttcaagccgctgatgccccccttccctgattgtgctggtggtggaattagggaaggctgttgtggccatttttcccgttcaagggtttcgtctagatctgtcgggagtgggacttgcggtttgtggggtgctgtcggttgtgcaggttggcggcggtgggacctgccgggctagttagcggccgacgacctgggaccagttccaccgcgcatggctgttgggttgcgcggtgtgtgctagctggtagtgaggatggttttagggtgttgggtgaaaagctctgtccgactcatcgccggactgacggcgatgaacatcctcggacatcatgcccctccctagaggtgtcgtcgtaacacccttgttcctccttgctgggtgaaaaccctttccagtctcctgtttatgtgatggtggcgtcctttccgacgtcgtcaccttcttgaaggcatcatttttggagaaaccctgcaaccagtccccctgctttcccatccttctcccctattccatccactccttctccccttttcttctgttgtccgctttgtgccttttctgtcgtgccccatggttggagttaagcctgccacgaccaatttggcctgatctgttatctaggagtttgttggtgccgactcccttacctgaatcccctcaatattaacctgctccttgtttgatagtttgggtctatctcttcttgattgtgcttctccattggctgtgatggcctcagatctttgcatctctctgccagtgctgttgatgttcctcctacctgtgagatctccacctcttcattatctcttctgtctacctccttgctccgctatacccttttacctggttgtcttggccacattgtttagcagccctccccccttaggggcttctttcccccgaagggcgttggaggctgttgaacttgctagcactttgttaaatccatattgaagacgtcttgatgcggatggcccatgaccgtaatcttcagtggccctccctcctttggggcttcctttccctaaagggcgccggcaggcattgatgcaagcagcaacatgatgaagtcgtgtttttttatggctaatgcgggtggtcctggacaatcacagccttttgatcgccggaactcgagttgacatgcttgtggcagaaatggccccctggctctattgtcttatggtgtttcaaaatttgcgtgtgaagcggatgtggttgagatagggcctagcgtaagtgattttgatcttggcctggtgatcttgtaggtggaaaatgtcaaagcttctccttctgtctcttaatcttttgtattctcttctctatatctctcagtgctttctctcatgttatcctcaagggctcctgtgcttggaaactctcatgtatctcttctatataagatggttcgaagtaatatattcaggtggggaagctctcccccccggtgaattttcaaaaaacttctttcagacgcaggagattgttgatgccaaaatagaaaccatgggattttgccattaatacgtgaaatggaatctcaagcttctccagctttggcatagcccctttcccaaatgttaggtacgctccaccatcgtgatcgccgcaaacaaggagaaactccttgagacatgggaatcctgtgctttggactgtaagctgtttttttgggttaggttctagccatatttctagacagagtaaggctggcaggtctccaagtgtttccatatcttcctcctttatctcacgtaaattgatgttcaggtatgccattttggtgagactcggtttaatccactttggaagttgtgggagaaagtgattagtgctcatgcgaaacaatcggaggaaacaagggatagggaaccaacgttctaagagatcatcggaactgttatatataatatgcaacgattggagtttgtagctgcttagtttacaaagtgaggcgagtaacatctcttcttttgtcttgcacttgctgagtttatcagacaaacttattttgaggtccctcaaactggttagttcaccaagctcgggcactgtacttgctgagctattacttatattaatgcctgtcagcacctgtagattcctcatattcccaatcccatctggtagcttcaaggaatttccgaatagatgtagtaactttttcaacaggcataattcggtgggcagctcttctacgaatgtttcacttatgtccaatgtcagcaaattttggagctttgcaatttgtcttggtatgtgtgatatgtctgaaccacgaaggcttaagtacttgagttggaatagcttgtctgtattttccaaatcatactgctccaaattcatagagccttcaaactccaacactcgtatagcctcaaatcgggcaagctgtggcaaaagattcatgttcccaccaaagcaggttagagatcgaacatggcttaaatctttgtttactaacagacttgacaaatcattatcagtgtcctggatggataatcgacgaacgtagccatgcaaatttgttttccttgtttggccacgtaacaatgtaataaagttttcttctgtcgcctttgaagtgataagttcaagcattatatcatggacgcggcatgcacgggccttactgtcaaagcgaatgtccacaggttggaccaggcttctgttgaccagctcacaaaagtagctctctgcaacatcttccaagttcattccacaatcctcagagacaaagccttcagctatccatcgccgtaatagcatgtttgtttcaataatataatcctctggaaatatgcacaaatatatcaaacatgccttaaaatagtttggaaggtcattgtagctaagggagagtatgcttttcattccttctagattttggttcttgtccaatacaaaaccaatcgattctttcactttctcccactcttccttgataattggtctgtttgataacaaaccagatatactaataattgctaatggaatacccccacatttcttcaagatatctgttgaaacttcttgtaaaatatctgggcagccatcctcatctgtgctgaaaattctctggcaaaatagtcttctagagtgaatttcacttagaggttccatctcaaaattgcggtcaattccatttaagcagcatgaccgtccaacatcggaaatgcgtgtagtaactataattatactagaaccattctccgggaaaacaacactgatagctttccatgccgaaatagaccagacatcatcaattataacaagatacctagttgaagtttataaacaatataagtttgtgtaggaaaaaaccactctattatatcacgaatgtaggtataaagaatttctcgaagtggaaaagaaaaaggagctagagaattacctcttatccacaagtagttctcttagcttttcaataaatttcttttcattccatgtgtcaatatctttgaggaatgcatcttttgtaggcatatggtatataatatccttgaagattttcttcatatcaggcttttgtgataccgacgtaaaagcagggcaatcaaaatggattttaaccctacgatatacctcatttgctagagttgtctttccaagacctccaaaccccacaattgacctgctttatcaaccttgcgatgctttatcaacctgctgtctgcatccaaccaattgacaagttcatcccttggactatctataccgacaagatggttctcttccgcgaagagagcagccaaccgtggatcaacaaaagcattagtgttgctagagctactacaaaaaatatcatcaagcttgtagttgttcttttgatctctcaccgagataactcgcatcttcagttcttcaatctcggcagcaatattatgccttgagccaagagttttgagacgttttgcactcttcccgaagaagtccttgacgccattactagtgtggtgctggtcgtcgttggcaccaagttggtgcatgaacttgtctatgcagtcctcgatgtcataggcaagctccctcaactcgcttgtccaggtcttcacctggatgtcaggatcctcgagtgatgtgtacttgtggagcgccgcatgcatgttgctcaactccgatctaagagagcgtatctcacggtggacacctttcaggcgtgcgcactcgtctacgagcaaggtattgagcttgcccagcagtggtcccagtgccccatgtgagacgctcaccacgatatccatggctactgatcgatgtgtgctttagtttgttcttggtggtctggaaataaatgactgaaaaaatatcactagaaattgagtgagatgtcgtgatgatgtgttccgtctgcaataatgcaggaggccaccacctgcaataatgcatgaggttctgtacaacaagttggatcacagcatggctccaagttggcaggcagttagtgattgtttttagtgggcccaaccctagccgtagctcaagtgctcaaccagctaagaaggccggggacccagccggccagtcatgcaaagacaaccaccccaaccgggcaggacagccaggcagcctgccaagctcagtcgaaggggacgtacggccagccaaacacaacgcccggcgactcgccccgccttcccttccacttgcaggatccagactcacatcggctctactgtatttaagggtgtaaggagctaatccataaaattaacttataagctaaagctgcaaacttgtttatcttgatttataagtgggtgcgcggatcagccatctgcacacctgttaacatcaaaattcggtaagccctatagtcatcatcggcttaaaatcactatcggcttcagcatcttagaataggacgatgggatattttggtcttttattctctcctttaattttatattagaatgttaggagttgcttctttatatgggatagaggaagtagattaagaaccagagctccatcggatttctaacttctctgccatcagcgtgcattcctgtgcatcagccatttgcatgctgctgtttgctgggcttggtgggtcagcgctccatgtcgctttgctggtgaacttctggtttgcaataattcagcatcggaggccgcgccaccttacatacaacaaggtactctaagagcaagtttaatagtatagccaactactagctacaattcatctatagccaatctaatagcttattcatacaatagttacatactatgctattaatatctggtcccacctgtcatacacacactgccttggagtccgtactacagctggctacaaatctgtagcccgctgcccttctctctcctcatttatctcttaaaatatgtttgcagcttgcttatactctgctattgtacctgctctaagggcagtagcaatgcgtcctagcatattgctatgccacaactgccacgtaggtctgggaactccaaaagacactacatccacaattcaagtgtggcaagctagtgtggtttagaaactttataataggacccacagataatataaaaaatctcacccctcccccacccccacctaatcctctcgtgtcttctctagggaggccatggcggtgtgctccgaccggcgcagcaaagctcggcggcgggccggcccaagcgcgacgccacctctcttcctccaaccaggtggagcagcccacgcggcaacaagcagcagctccggcggcgtccagcggtgcggcggaagacggcggcggagacgacaccgtcgtcgacggtggaggcgcagcactggagctgcgcagccgcacgcggaccccgccaacgccaccggcgcgcgagggggtggcgagcttcgggagctccacccgaaagacggcggtggatctcgggaggctcctcgagcggccctactccggcgagccccacgcagcggtggcttccctgagccccacgcagtgacggcgagctccccaagcacccctacttcggcaagcctccgccgagccccacgccccaagtgcgcctactccggcgagcctcctttctctccctctctcgctttcttatttctcgtggaggtgctttttttttttgacaaaagttgctgaggttcgtgtggccaaacttggtcacgcgaagctaggttgggaatggtccccactcccctctctcctccacgcaagcgatttgcctacgtggctctacattgccacacgtcacgtccttgcactgtaaatggcctaagttggcaagtactccctgtttatttgtgatccaaattcatttgcacacacatatatataaaggccaatttcggactgagcgaagtggaggcccatcgctagaggcttgggccagagcgaagcagccgttgggcgttttgtaacctcatctgatatagtgcagttttgctggctggcgctcgtgttttttttttctatcatatcttaggagggttttccatgttaaaacctcgtgtcttctgtgattgatctattgttcttcatcgtttatttgcctatcgtatcctaacactcccttcgtcccataaaaaatcaacctcctatccagattcgttattttagatgatgtcccattctcacctaggttgattttttatgggacggagagagtattctgagtactggttgaatggtgcttgccctaaactctgccatcactctactccaattaatggacacgactgacatttacattgctgtctccaatcaaacattcaagtttaggcccggtttagttcccaaattttttttctcaaaaacatcacattgaatatttggacacatgcatagagcattaaatatagatgaaaaaaactaattgcacagttatgacggaaatcgcgagacgaatcttttgagcctaattagtccatgattagccataagtgctacagtaacccacatgtgctaatgatgaattaattagtctcaaaagattcgtcacgcggtttccaggcgagcggtgaaattagttttttcattcttgtccgaaaaccccttccaacattcggtcaaacatccgatgtaacatccaaaaattatcatttcaccaactaaacaagctcttataattgaagtgttgtatatagactagttttacttttaaggccttgggtgtgtttagttcacaccaaaattggaagtttggttgaaattgggacgatgtgacggaaaaattggaagtttatgtgtgtaggaaagttttgatgtgatggaaaagttggaagttggaaaaaaactttggatctaaactcagcccttgtttagttcgtgaaaaaaaatttttgggtgtcacatcggacgtatgactgatgtcggaaggagttttcggacatgaatgaaaaaactaattttataactcgcctggaaaccgcaagatgaatcttttgagcctaattaatccgccattagtacatgtgggttactatagcacttatggctattcatggactaattaggcttaaaagattcgtctcgcaattctcccctaactgcgtaaatagtttttatttttatctatatttaatgctccatacatatgtccaaagattcgatatgatgtatttgggaaaaaattttgaggactaaatcgggcctaaaatctaggaccgcacgatttacaggggacaatcgcctagtttatttaaattttaaataaacaaatagctgaaaaagtaatagaggtccataaagaaaaaaacatttcagcaactgaaaaccattcaccacaatttcacccccagcgtaaaataactgactgtcacaaacaatgtgcaaaaagtagatggcacatgaatgaagcaaaaataccaggacgcatgcatgtgaaaaccttggtgaccaaaaattagttatcgagatgtcatcctcaccaaccagatgaagacacaattaatgcagtgcacacaaccatatcatttcaattgtgcattagtacctttttccttgcctaaaacaacccagcaaagtgatctctcacatatcatctctttctccagcactacccagccacacaaccataagtcgtctctcagtgtgcagcagcaatccaccatcctccatcgtctgtcagtccaatgcgagctacataccgagagaaggagaacaccacccaaccttcgtgactcatccagcgcctcccctgtgccgcaccggcgactgcgctgctccgatccacaaacatcttggtcgacgaggttaggagatctggcttcatcttcctgcatatcattttagttgtatttgccttcatcttcttcattccacaatcttcaggtctacagtgttagagggaaccaacgatggctgagtttttggttaggccactgctctccgcggtgacgaacaaagcttccagctaccttgtataccagtacaaggtgatggaaggcatggagcagcagcgtaaggctctg

SEQ ID NO: 9327 - DNA, 8269 bp, Oryza sativa
cccgcttcgtaggtggtgttgtgtgtcagatgtgtttgatgttgtcaccattgcaaacagcatatgtatgagcacagagagagatcgtgagaaggctttgcaggacttgcagaaagaagtaggtggaaagaagtatctcattgtgttggatcatgtatggaatcgagattctgataagtggggaaagctaaagacctgctttaagaagggtggcatgggtagtgtagtactaacaacaactcgaaatgcagaagttgctagaattatggttattggagaagttccagtgcataatcttgaaaagctcggagaagcttatttgatggaaataatccagagtaaagcatttagtttgtcaaaaaaaagtgacgagcattttgaagttcttcgtaagattgtgcagagatgcgatggctctcctttagctgcccaatcctttggctcggtgttatttaacaggactactctgcaagaatggaaggatatattagccaagagcaacatttgcaatgagggggaggacataatttttcctatacttcgtctgagctatgatgacctaccgttacatataaagcggtgttttgccttctgtgctatattcccaaaagattttgagattgatatggagactttgattaacttatggttagcacatgacttgataccattacaagaggatgacaatatagaaatggtggccaaacatatcttcaacgagctagtttggaggtcattttttcaagatgtgcagaaatttcctctacaaactacatgcaagatacatgatcttatgcatgacattgctcaatctgctatgggagaagaatgtgtcagcatagttggcagatctgattatagaagtaagtcattagagcatcctaggtatcacttctactcattagacgatgacaatactattctcttagatgactttatgagaaaacaatcttcaacactccggactttattgtttgacagagactatattcacatctcaacatcacttttatccaagagcagttctctacgagcactaaggctgagatatctcaatacagaatcattaccaatcaggccaaggcaccttctgcacctaagatatctcgatatctccagaaactatcatgtcaaagtacttcctgaagatatatgcacactgtacaatctgcagactttgatcctttctgattgcaaaattcttgttggtctcccaaaggatatgaagtatatgacaagtctacgtcacctctatacaaatggatgcttaagattgaagtgcatgcctccagagcttgggcaattaacttccatccggacactaacatattttgtggttggtgctagctctggttgcagcacccttagagaactgcacagcttaaacctctgtggtgaactagagttacgtggcttagaaaatgtatctcaagaagatgcaaaagcagccaatcttagaaacaaagagaaacttgcacgcctatctcttgtgtggaatagtgaatgctgtgttgaagaaccaaattgcaatgggaaggttcttgatgctcttaaaccacatcatgggctgctgatgctcaacgtaatttcctataaaagcactcatttttccagcatggatgacagatctaagtatactgcaaaacttggtggagctcaaattagagggttgtacaatgtgcgaagaatttcctcaattcattcaatttaagtctcttcaagttctctgtttgatcagacttgataaattgcaaaccctatgttgcaaggaagttagacaaggaaaagaacaaacatttcatcttcttcagaacgttgttatcaagagctgtccaaagtttctaacactaatccctgacatggcatccgtaacatttccttcattaaagaagattaagttgcacgatttggaagctttagagagatgggtagcaacaggaggaagacaagaaaatgaaccagtgtttcctctgcttgagaaggttgaaatagagaaatgtccaaaactgcaaacactatgctgtgaaatggctttcacaccatttccagcattaaagaaaatcaagttatatgatttagagggcttagagagactagtggaaaacgaatcaacatttcctctgcttgaaaaggctgacatcaggaactgtccaaaactgaggagtctacccgaagcaccaaagctcaagattttcagtctaaatgaaaacaaggccgaactgtccttgtttttacttcaatccagttacatgtcctcattatccaagccagttacatgtcctcattatccaagccgtggagtggtgttaacgaaggacaatttgataaaaaggaaatggcaaggcaataagaattgttgtttttgttgcaatgacgagacaattagacatcttttcttcgaatgccgttttgccctttctgtttggtccatcatccaagcagcatctggacttcctccaccacattgtgtagcgcatatgtttgggagctggcttgatggaattcataataatttgaaatcacatgttctgttaggagcagctgctacttgttggtcgctttggctatacaggaataatgtggtttttgataaaaaagtcatatcttcacatttgcaggttatatattctcttatccattggcttcgtatatgggctatcctacagaagcctgattcgcgggatatggtagttgcggcatgtcaacatttggagaaggtggtcaaggagttttttacccagggatatgggtggtgatctagtcttagaattggtggtccttaaaactctgtgcttttggaggagatggccaaggagttgttcatgagtggcaatttagtcgttagattgatggtcctcaatactccatgtcattcttttttcctttcgagtgtcgttttgtttgttcggcggtgtgcatcttagttatgcagaggccggaagtgttctcaggataattgtatcaccttgatgtaattgactgagtttaataaaagcttccattatctaaaaaaatccaagctaatactggacgtggatgacaaagaaggaagagtgcagcttgatcagattcacgaatcatctctctcagaactggacttaaagcactgcaactttttcttccccacgagcccatcacaaccaataatcatgttttggaaatgccttagacaacttgtgtgtttggaaatctggttctgtggtgtgctcatctactggccagaggaagagttcctgtgcttagtatccttgaagacattgggcattgagggatgtgataagctaatagggcgtcccacgctggtgaaaggagagccaccttgctgtgcaagggatcagctcctgccacgtctaacctcacttgaaatttccaattgtgatagcttgagagagctcttcgttctccccccatctctcacatatgtttataatcagagatgtgcttctatgctcctaaataaaaaagcgcacgaaaatcaaagttcaccggtggctgagattaaaacatgattaacacttaatccttattagcgaggggtatttttgtccataggattaactttgaagcgatccccaccactaggccggttactccgcgaccgtgacgctctctcctcgggcagcgccgctcctcagccgcggaagcatgccagcgcttccatcgccacgccgtccggtaagcagcgccgccctcttcttcccctcgcctcgtcacttcccggccccggcgctccgcctttttttcccctcgcctcaccgcttcccggccccggcgccgctcagtctagcgccacccggcttcctcctgcaagcagtgccgcctctccgtcctcttcttccatgaaaagaatgttatgagaacacatgaggaatcgccatgtaaatgtgtataggcgcttctattgggaacatactcataaacaagcatctgcgtgccattctgcctcccccattcatttatacagctcaccagtcaccaccaatatatccacgatcacaattcacatgatcacatcaaacttgcagcaaactggcgattgcagtgcagacagagatcaaacaagccaaaaggcacaagctggaatggcaacttggccttggatgaggggtaaatcatggcgccgaaaaagctgctgcttcagctgttgctagggccgcttgacagctgctggcacggcggcgtgctcgacgtccacgttaccgtagtcctcggctcctcgcgctcaaggcgaatcttgttgcgcaaatagtggcgacggccgggaggtcatcaggggcggggctaaccggattagatggagcgaggcggcagtgctccatcggcatcggcatcacccgttccccacaacggcgccggccgaccgcctactctggttcccccgcgccgcacgtatccatgggtgctgggtctaggcggcggtgcgggggaggaagagggcggagcagtggcggcgacgcgagtgaaaagcgggcggtgcgcgtggttacggtggagttagactgggctccaaattatatggacaaaaataccccctcactaatgatgattacactgttaattcgcttttaatctcagccattgatgagctttggttttcgtgcaacttttttctaaggagcatagaagcacaccttgctctaaacttgagttcatatgggggaagggggatatagtgtccgagagtgtacaggtagatcatcacaacacatttacatcatcaaagcattgcaattatcgtgcgtgcacaagcctgccagagcaatcgccatcagcagcagaccatcctctgccatgcctagaaagactagatgtctgggtatgtcctaaaatggtagcacttgagaacctaccatcatctctcaagaggctaaacatttattcatgtcccgagcttcattccgtctaacggcagctgtatacatgcactcgagtatatatccattgacagctgcaataaactggagtcactgaatcgtttgggagatctgccatcagtagaaaccctcaatcttgtgagctgcaaacgtctagcatccttaccatgtggtctggggagttactcatctctttcgagtatcacaatccgatattgcccagctttgaatacgaagccgctatataaacacattcggccacggttggatagccttgtgagaagagacctgtgagatgctcgtgcaagagatcctgatgaaggtacctctccattgcttttttcttctttttcgtttttgcttttccctacatattacagatctatatgttgcagtgtacgcactcgaaaattcaatcaccagcccctctgtttaaaattgaataggacagaatttccttttttttcccctgggtacagttaatttcgattgtgaaactaaggtattattttcctattgcagagcctaaacatcctacgctaagggaccccaaatcatggaaatatgcaattcctggctgtcagtgagccagcaatgccagccgaccataaaggttctgttaacaaccctcttcctccaaactcagaattctcaagaacaatagagttcaatacaatctcagaaaatagaagaggaattgagtgagaagaagtagaggaagcttctagaagtggcagtgaagaggaacacgagagagtaagaaaaagatagagatcgacgaggttcaaccgaaccaagccgccgccgccgccgccgtggccgaagccgtcgatgaatctgttcgttgcttgaagttctcctgctactgccttttgtattcatctcctttgtttgtttgggccttggcatggattagcaattgagtcagcccatgtgtagctcaatgggttcctgacaatctcctctccttgaaattcgacttgtccacaagtcgatgacaagtaaattgcagaaatggcaaacctccactttgatttctccagtattcttgcatcgttccaaaagcttcatcaatgtccaatttgttttcagcttgccaacagaaaacttgcgtctcaaaagaacagctcaagcaaatcctggcacttcgcatgtgaaagagagaagaactgtcttgaaatgagaatttgactgactgaaatgtgacttgtccaagagaagagatagctagaaacttgagtaaacataaaccaccaggatcccatgatatttgtagatcaggtgcactaagacgcaattcatccctttgatttacacacggcctctgaacatattttggatgatcaggccacatctttaatcttgctggatcagattcttccaagtttccatccaagatatccataggcaccgcagcttgtttgacactgatcagaaagaccatataacagaaccataatttccacacagacccatcattccaataatgtagtgtccaagaaaattccttccaaacatgactagctagtggcactggtatagagttggtaaatgaggtacttgctgcaatggtgacaaccctgccactgcccttacttttgataaaactagtactttgataaacccaaactgtagcaagctcctctttgtggaatatcaattgttcatacgagaattcttggtccttagtattcaaccagtacacatctacttcaccatcttcaagtgttattttgtatgataatttgcagctctctgttatagtccaatccgcactaattaaatatgttgcaccagaagtagcttctgattgcatcagtttatagccagtgggcttatgccataattccgatgagagcgaagtatacaactcgaaccaattctgagaagaatcactatatgtttttgatataaatttcctttcccagcaaacctcataggatgtcatgttcgatctccttcgctgcataaaactctcaccatccaacaattctcctttaccacaaaataactgtaaacacttccaaagttctctagcagaaagcagagaacagcccggagaccacaatattcttctcacataattccagctcatccaactaggaaccatagagaaatcttccttgaaccttgccaataaccttttgactgctaacaggtgattgcctccataggacatagctgttcctgcccaatatttccccttccccaaatactgtggatgtgtacagggcctcagctcaattgatctcctgagcatttcttccctatcatctagtgcataaggtattatgtcaatgatgaatgggctcactgaatcatgtggcgctacatctgaaaaacaactaaggaataaccaagtttctagccactgtggcggtggccatggttgtatctgttgcacatcatgttgtttccactcaaactctaaccaagttgctggatgcttcttaaccagggaacccttgcatatgactcgacagggaggtgcccaagtctgtagactagtcacctctaccatgtttactagtttggtacctgtgttgtccatgttgagaaggaacacacaaggctgggccaggaatgcgaccatgacttggtcggtgtcacccttgacgtcaaggcccaatgtcgaacacttggtgtgtgtcacctcaggacaattagtggtcccggtataggtgtcacaggttgcctcctctccaacaaccaactccatgaacgccatagaagtggtggcacatgcaaccaccgtagccatggtgtggtcgggtatgacgccgggacttgagcaattcgtcgggcaccttgtgggcatcaagctaccagctccaactccatgattagagcaccccttcaagcacttggcaaccgtcaaggcagtcagctcgatgttgtggcttgagctcgttgccgcatgcatgctgttttcattgaagcacactggagatagcgatgtcttgggtgttggagatgatgcctccctgaggtcggttgtggctgccttgatgatgacagttgcatcttctgcgccattgtgagcttccatctcttcaaacttctccaagacccggttgagcttctcctctaatttacgcttggcatccatccattcctcaagtaacaaccttagtgcttcatccctggatactttctcctccttcatgacaaggatagtatcttcctcgtacacttcgaatgggctcgacatttcatcgaacagttggtgggcgctactcggatgaacaattccccaaccgaattcctcctccctcttgcatggctgcctccccaacacctccatgacaagaatccccagcgaaccgaacagctctgataccagattgttaacaaccctcttcctccaaactcagaattctcaagaacaatagagt

SEQ ID NO: 9328 - DNA, 10747 bp, Oryza sativa
taatcttcagccagcgcatgcaaccaggaatccaatgctattacaaaatgcaatggctaagttaaaaaaatgcaactgaaaaaactagctttcgcacacaagattatttggataaagctatcaatttcccccctaatcttgatgtgcctgctccaaacccatcttcttccggagttcaagaaaccgaactcgtccaacaggcttagtcagtatatctgcaagctgatcttctgttcgcacatactccacagcgatttgcttcttctccacacactccctgataaaatgaaatcgagtgtcaatgtgcttacttcgatcatggagtaccggattcttgcagagattgattgctgatttgttatcaactttcatcacagtttggccagggtcctctccaagtaattctgccaatagcctattgagccaaatcccttgacaagcaccagtagtagcagcaatatactcagcttcacatgacgacaaagctaccaccttttgtttctgagattgccagctgatcaaactgtctcccagcatatacagtacacctgtggtgctcttcctatcatccaaatccccagccatatcactgtcactgaacccaatcaatctgagttcacccttttcccttctcccaaaccagcagccaacatcaagagtacctgcaatgtatctcagaatatgcttcactgctgcccaatgttcagaagttggtttctccataaatctgctcacatacccgacagagtaagcaagatctggccttgtgttcaccaaatacctgagacttcccacagtgcttctatacatggttgaatcaactccttcccctccactctccctcttcagtttcaacctagcttccatgggaacttgagtagaattgcagccttccattcctgtcttttctaggatttttgctgcataagcagtttgtgacagaaacactccatcatccttttggacaacctccattcccagatagtaactcagcagacctaagtcactcatgcgaaatttcttcttcatctcctccttgaaaaaatcaatttcacttgcttgagccccactgataatcagatcatccacatacactcccactatcaaccttgagcttcctgttcctctcacatacactgcactctcagtttcagacttgatgaaattcagagaaatcaaagtgttgtgcagttttgcattccatgctcggggagcctgctttagcccatacaaagctttcttgagcctcaacacctggccttcttttcctttctcaataaaaccaggtggctgcacaacataaacttcctcttccaaatcaccattcaggaaagcagacttcacatccatgtgatgaatctcccatcctttgtttgcagctactgcaatcaggagcctcacagtttccattctagccactggggcaaacacttcctcaaaatcaattccttgttgttgcacatatccctttgctaccaaccttgctttgtgtttcaccacaactcctgatggatcctttttcaccttatagacccactttaacccaattgctttatgtccaacagggagctcagcaaagctccaagtctgattgtcttcaatggactttagctcctcttgcattgcctgcctccaacacaactgttgttcagcttctgcaagactcattggttcctcacttgccagcaagcattggtcgctataatcaaaatcaaggacaggttcagtagcagataggatatcctgcactcggcgatacctgatagggccttcatttgtccctggcgtgacagagtttggtggtgagcaaaactccacccccgccggcacttccggtggtgagggcggagtggccgtcgacgccgggtacgtgcctccctgcacaggcgtgctagcctgttcgcccaagtcggcaacaacagagtccacgggattcacaaagaaatccaccgtgaattcctcctcttcagtcgcctctgtctcaggatcacgccacgcccatgtcgccgcctcgtcgaagacgacatcacgcgacacgcaaacgcgccgcgccacagggtcatacatgcgatacgccttcgacccctgttcatagccaataaacaccatcctcgtacctcgatcgtcgagcttgcgcaggttcggcttcaccgtcttgacgtagcctacacagccaaacaccctcaagtgttcgaccgagggacgtcgcccatgccacgcctcatggggggtcacgccattcaatgccttcgtcggcgaccggttcagcacatacaccgccgccacaaccgcctccccccagaagcacgccggcatcccagccgccttaagcatggagcgcgccgccgcaaccacggtctgattccgccgctccacgactccgttctgctgaggggagtaaggagcagtgagctctcgcctcatcccatgatcggcgcagtagtccatgaactccacggaggtaaattcccccccacgatctgtcctcagagcccgcagctttcgcccggactccagctcaacgccgacttggaactgcttgatcgccgtcgccgcttcatgcttgccggagaggagccgtatccacatatgccggctcatatcgtcgacgaggagcaggaaatacttcctgccgcctggggtcgcaggcgtgatcggcccacacaagtcgccgtgcaccagttcgagcgcctcctgtgctctaaacttggcctcctccgggaacgggagtcgtcgttgcttgcccgcgagacaaccgtcgcacagttgatcagtgtgatcaatgatcggaagcccgcggaccatgttcccctgggccagcctccggagcgactggaagttcaagtgtccgaaacgcgcatgccaccgccatgccatgtcgccaccgctcgccgccatgcagactggatttgcaatatgcagcttgagtatatagagataatttatgtctcgttttacctttgcgaggagaagaccatcgggatcacggagtgtgcagaccccgccccagatatgtgcgtcgtagccgcgcgcgtcgagacggccgacactgatgatgttcttgcgcagcttcgggatgtagtacaccgtgtcgagagaccgatgatcactattcttgcatcggaacaccacggtcccgcgcccctggatttcaatcacagagccgtcgccaaacttcaccgtcccaacaacgccggtgtcgagctcggcgaacgccgaacgcactccagtcatgtggttggtggcgccggtatccagaaaccaatctcttgtcacctcctcctcaccaccatcctcgtggtccaggatcaccttcttctccgtgaggtgtacctcctgtccaccaggtgttcgtccgagtgtcgcctcgccagcaagtgacacccctacgacatgtgccataagcaacgtcggttcttcctcggcggcttgcaccaggttcgcctctccccggcgttggcgtcgtggcttgcggcactgccttgcatagtgaccaaattcatcacaattgaagcactttaccctcgagatgtcgcggctgctgttcgcaccagtggccgcctctttgccctttggcgacccaccgggcttgcctcggtgattctgcgtgccgggcgcgccgcggcccttattgccgctgttgccggagccctcctgctcccgctgcttcacacgtgcctgccattgttcctccgtgaggtacaattttccgccatcgcttccctcctcatcatcgctgtaagaatccactgttgacagccgcccaactagctcctccagcgccatggtcttcacatcgagcagctgctcgagagagatagccaccggcttatacttcttgggaacaacgcgcagcagcttcttgttgacgtgttcatcttccatgactccacccatgtcgcgaatgtccgcgacgacggcagtgagccgcatcgcaaactcctccggcgtctccctctccttgaatcgcatcgactcaaattgacgacggaagcccttctccttcgcctcacgcacacggtcaacgccgacccgcatggtcttgatggcgtcccacgccgccttcgccgtgtcatgctttgccagcccgcgcaacatctcacgcggcaccgcctgaaggattgccgagagagccgcccgatcttcacgaaactccgcgtagccgggatcgatcgccgtccacagcccctgcgcctgcaggttgacgcgcatcaggagcgcccaatccgggtagtttgtcctcgagaggactgggaggcgagcggtgtgcgatgcgtctctcccctgagacacgagcggaagtaatgcgccgtctgctccattccccccgccgctgccgcttgcgccgccgcggccgttgccgctccccccgccgccaccgccaccacgacggccaggcggtgtgtatgacatcgccggatcgttccagtactgctctgataccaattgttagctagaacactctgaacacacgcgagattgtggctatcctagcttgtctgagtagttcagaacgatgaacagtatctgacgaaaatacgacaacatagaaaaacagagcaaaaacagagttttggtgctgaaaaacttcgcagcttttctggggtttttcttccttttattcacctccacaaaagagtctgttacatgcgcgatcttgccggatcaacgactgaccgtgccatcccacgatccgatccctgctcgatctcttctactaccgaaaaaacggaaaaacgataactaacactaaccgagtttgctaatcttcagccagcgcatgcaaccaggaatccaatgctattacaaaatgcaatggctaagttaaaaaaatgcaactgaaaaaactagctttcgcacacaagattatttggataaagctatcaaatacaatctcagaaaatagaagaggaattgagtgagaagaagtagaggaagcttctagaagtggcagtgaagaggaacacgagagagtaagaaaaagatagagatcgacgaggttcaaccgaaccaagccgccgccgccgccgccgtggccgaagccgccgatgaatctgttcgttgcttgaagttctcctgctgctcccttttgtattcatctcctttgtttgtttgggccttggcatggattagcaattgagtcagcccatgtgtagctcaatgggttcctgacaggttcgtggaactgattgttttcatctcagacttgaatccaacagttgtgcaagatgaaagttggctttagttcgagcttctttcttctgatgtttgtggcgtggtttctctgaaggactggcgagtataatcaataatttggcttcttaacaggaatcttcactacagagttattattgtatggcatagttacttactgggttttgctgaagtgctcactatctcgatgctactcaggcatccgtgtcaatgaaatgcggtttggtggtagtgtgctgtttttgcattttttttttagagaagggtatatttacccggactctacatccaactggatatatgtgctcctatggagatttgaactcaggaccttggggtgctactcaggtcactgcaaccactaggctacatgccctttcgcactgtttttgcatatattttcaacaattgttgtctgcatgaatggcagtctggtactctggcagaaatgaagtgaagaaatcaagcatggtgtttccaaattttatactagaaagtgtggtacatcccgatactttttcaaggatggtaaaattacccatttggtgaatagatcaatatgaccctaaaagtttttctaccctctgatatcagaacatttgcagcgtatgatacttgcttgagaatcttgagatcatggtttactcgtgttggaagcaggtaaaaagcacaaacattggcttcaactggaaactgcattgacgagatgactgcgatgagtgtgctggtttccgacggtgagatccttcttctgatatcctaactcattttgtgtttagattataaggctcttcattcatttccttgctttacttgcatggccttaggatgtttcagaattccattatctgaataaatttgcaacgtaaaatatttttccagaagtggcactgccaagcttaaattcatttactaccgctgttccactagtgaatgaacaaaacaagaaacttgattaacaacctgaatagttggaagaatagattaattccgtacaaacacatccctaagtatcaaattatgtcttgaatgtcttgcagaattttagtgtgtacaaaatttcagtctggtagttgtagccaattctgaatcgtttttttttacagttttgctgtttttcctatggcatggttaatttccatcaagaaattctgacattgttttccaccagggattcaaagccctacagtaatagacccgtaatcatggaaatatgccattcctggctgatatgagccgaagcacatcattgatttcctgaatttagtgatgtcaggagaccacagaggtatgtgaaactgatcaccctgctctatcaatatatacaaggcaaagcttttgccctcttttcaacaaaaaaaaaagtgaaactgatcgttttctactggaatccaacaagttgtgcaagatgagaggttgtttattgtgatttaagattcctttttttttctgatgattatgcttggcttccctgcaggattggtaccattcataccaacaatcaatgggtggctctgagtgtaatcaacaatatcttcttgatggggaatctccactacaacgttgttctattttgtcttggttttgtatgttctgttctagtgaagcagaacaaattccaacttgaaatcttgactgaattagtactcctgtatctatgttttagtattgtgtgtttatcttatctaaacataatagacacccccatacttattgtaatgcacaagcactggcacgctgtattgctcatcgtttcgatgtttctctgacagtggatgcagttcgtggtaatcttctgctttgcacttatgttgtaaattgttatgtccagttccgtgtataagccacaacgggcagtagctccgacctgctgtcagtacagtcagtgactcagtgtcagaagaatgtagtcgctggaaatgaaaatgcagaaattccggcggccctgaatcagttcgtatttggctaactcctgaaactgtatggctcagtttgtacatttctgatttttcgccatgccaacgtgaaaaggtttggcaattgttgttttagacaaaggccatttagccaattgtctttccaaaatgttgtcttctcgccattgccaattgtgattttcgtgcaagcttggaaaaggtgtatatctgttttgttgcaatgtagatccatcgaggtccacggtctttggtcatctttccattttatccaaggccatcttaatcttaaagctcttgaaaatttccaatcctcctaaaacttttggcctgcatactgttttgccaattcacaaggcttgttccagggcgattattctctggatcagttcctttccttagggatttgcaaagcggtcacttagttaattttgccgtcgtcagaagaagcgtagtgagtttttgtccaacagaaatttgtttgtccctctgtcgaatttcgctcgattatcaacatgtttgctcatggacatgccgctggtcgctttttgcaagtgtttcggtgcgcacattgatctgttcctaggcagctgccaaaattgaatttttggaggtttcttttcataatagcttatttaaatctctaaggacacatatataaaaacttttacccacaaaaatattttttggattgctgtcagctcatcagctgtaggatttaatctgtatcaaaacagcagatctgcttgcttgatgatacctcaaatatagaagaaaaaaaagagagaagagaataaaatgatcgccgaatgaattgatacagtacatttcagggatttcattagttgaactgcaaatgctttttttcaagataggaaaattacatgctcatctcattgaataatttattttatctacaaggtctgacgaaattaagcaaaagcagagcgattgaagttgtaaactatgattaactattactgtaccaagttgggccaggcttgcatgttttgcgacggcccatgaagcgctcaaaatccaattgggccttcgaatccaatcgcgaacaaaaatcgatcgtcatttctgacgaatatacaggagggaaccgaatggcgcgcaattgctcatttgctctccgtctgcctgccatgcgccacgccgccggcgagcctttgaagagttccggccgccttcttcttctgtcctgcccaccgccgttcgcttgcaaggacgccggccgctccgctcctacagcgtccagtgcagggtggcaggagaggtaggggcttgctatggcagtcagtgcccggctggtgttcgacggaatggctgcgaggacaacacgtacgccgtctcggccggcaaaagcaagcaacggttgtcaacacctcttcggcaaaagcaagcaagagtgagcgaaatcttgctgccctcaccggccggctgccagagtaccaggtcccctcgcgtctccacaaggtcagtcaccactcaccactctgctaaggcgcgcgtcagtcaacatcggcgtgcgtgaaaatgagagataaaagcaaaactgactcttggaaattagtggaaagcaagacgcgtcagtcaacactgaaatgcagtgcgcagcgcactgcaattctttgcaattgtctttgcctttgttcagcctggaattaataccccattaatcactctccaatagaactacatatcagcaacagccgccgttgcccttgccttgggttcttgccgtgtgctcctgctcctgagagttgagagagcaacgatggctgaatatttggttgggccactgctctccaaggtgctggagaaggcttccagctttcttgtagacatgtacaaggtgatggatggcatggaggaccagcgtgagactctggagcgcttgcttccagccatcctcgatgtcatccaagatgcggaggagaagaaaaatcatcgatccggtctagtttgcgcttggctcaaatcactcaagaaggtgtcctacgaggcaattgacgtcttcgacgagttcaagtacgagtcgctctggcgtgaggccaagaagaaagggcaccgcaaccacactatgcttggcatggactctgtaagcctcttcccttctcgtaatcctattgtcttccgatataggatgggcaagaaactgcgaaagatcgtggagaaaatcaaggaacttgtctcggagatgaactccttcggactcgtacaccagcaggaaacacccaagcagtggaggaaaactgattccatcatggttgattttgacaaggatattgttatcagatctagagatgaggagaagaagaagattatcaggatattgcttgataaagctaataacacggacctcactgtccttcctattgttggaatgggtgggctgggcaagactacctttgcgcaactcatttacaatgaccctgaaattgagaagcatttcccgctccgcaggtggtgttgtgtgtcggatgtgtttgatgttgtcactattgcaaacaacatatgtatgagcacagagagagatcgtgaaaaggctttgcaggacctgcagaaagaagtaggtggaaagaagtatctcattgtgttggatgacgtatgggaacgggattatgataagtggggaaagctaaagacctgccttaagaagggtggtatgggtagtgcagtactaacaacaactcgagatgcagaagttgctagaattatggtcacgggtgaagttgaagtgcataatcttgaaaatctaggagaaatttacatgaaggaaataatcctgaggagagcattaactctgccaaacaatgatgaacattttggaattctttgtaagattgtgcacagatgtcatggctcgcctttaggtgcaaaagcctttggttctatgttaagtaccaggactactatgcaagaatggaatgatgtattaactaaaagcaacatttgcaatgaaggggaggataaaatttttcctatacttcggctgagctatgatgatctgccatcacacatgaagcagtgctttgctttctgtgctatattcccaaaagattatgagattgatgtggagacattgatccaattatggttggcacatgacttcataccactgcaggaggaagaccatctggaaacagtagcccagaatattttcaaggaactagtttggaggtcattttttcaagatgtgaataaaatttctcagcgggaggagaatgtgtataggagtcagctccgtgacagaacaacgtgcaagatacatgatcttatgcatgacatttctcaatctgttatggggaaagaatgtctcagtataattggttcgtctaatttgaaaaatctgatgcgagaacatcctttatatcacgttctcataccatacaccagcattgctcttccagatgactttatgggaaatgaagctccagctctccgaactttattgtttcgagggtattatggtaatgtctcaacatcacatttatttaagtacaattctctacagctaagagcattagagctcccaagaagggaagaattacccatcaggccaagacacctacaacatctaagatatctaa

SEQ ID NO: 9329 - DNA, 6623 bp, Oryza sativa
tcaagttatgaatatgttggtcatcagattttgctgaatgttacacgttttcaagttggagtcttgtaaagtacatgatttatattttcaactctaaaaaaaatatgatttaataatttcttaaataatatataaaattgtactctgtccagacccacggttatagattgttcgtgatttaatcatttgtaaatttagaaataatacatttttgaagtatcaattataacttttatgatttaataattctaaaaatagtaaataatacattttagttgtacatggtttggagttcacataagttacaacttgctaattatgaatttaaaaaatgcaattaaattaacaaatttctaaattgagagcaaaccctgtcttttatgatgtctgatttcagaattattaattttaaaaaaaataaaactaaagagtccatgttactttccgggccatattttaatctacacgaattcatatagatcgaatatcatagcaatgtaaaccacctaatcaatggtcactagtacatatccttccatctgtgacggcccataacaagactggaatttgcgggccgtcacaaggaagtaatctcaatcgggccgaagttttgcccaattgagatatggtcgcacagccatggtatatcggcataaaactaaagcccgtcacggatgacacttatatgtgacgggctatagttgaggcccgattgagatgagggttccatatctcaatcgggccctaaaagaagcccgtcacagatgagggtcatctgtgacgggctccaactagaggcccgattgagataagtttattgcccgtcacagatgacactattttttgacggccttttattaaggcccgatagagattacttgtatgcccgtcacggttgattgttttagggccgttacaaatatttgttgcacagtataaatacccccaccacctagtgtaactatatcccactgttcactattttggtgggaggctgtagggggcgattttttgtcctttttccaaggaaaacagaaattaaattcccaaaagtgatcaaaatggatcaatcaagtcagtaatataaatcattaattgagcaatttcatcatgtcttacttttgcaatactgatcttataatatgtgcctctaatttgttttttttgtagcaattgatcgaagttggatgtatgccaaaaatttgaaacgtcattctacggagtaccgaaagggcgtaataaattttatgaacgccgcggaggaggatcggataagaagaaacagtgattacatgtgttgtccatgtgcagattgcaagaacgagaatatgtttgatagcggagaggacgtacacggtcatctgatacaacgaggattcatggagggctatacatgttgggtgaagcatggagagcaagaatcaggaagtggagcagcagcaaacagaagtggtgcgcataatcaggaagatgaaaatgagcatgacatgtttataccttctccattgggcggtgaaatggttgatgtggatcacgatctgctgcaagacatgttacgtgacgttgaggacccagcccagaatgagagagatggaatgaaattcagcaggttggtaagtgattccgagacgcctttgtacgctggatgcaaagcaaaacacactaagttgtcagttaccttggacctaatgaagcttaaggcaagtagtggatggacagacaagagtttcacagatcttttaggaattttgaaggctatgcttcctgttgagaacacattgcccgagatgacatacggagcaaagcaggttctgtgtccactggggttagaggtccgtagaattcacgcttgtcccaacaactgcatatgcatattgtaccacaagcaatatgcggacttggatgcttgtcctgtctgcaatgcttctcgatacaagcgaaagaaaagtgctcacaaaggaaataagtcaaagaggggtggtccggcaaaggttgtgtggtatctacctatcattgatcgtttcaagagaatctttgccaacccgaacgaagcgaagttagtacgttggcacgccatggaaagaaggaatgatggtatgcttagacacccagcggattcgattgaatggaggaatatagatcgaaaacacaaagactttgctgccgaccctagaaacgtgaggatatgtctttgtacggatggcatgaatcctttcggtgacatgagtaaatactaaatgatttcaaatggaaatatggtcaacaacaaagttgatcctctcatcaaaatctacaacttttattttggttacttcttcatccgacaaagtgatagttatattattcacaaaaatcacatttctctcatctggtttataaatatcaacacagatatgtcaattttgtaaacattggtactatcactttgtcggatgaagaagtgaccaaaataaaagttgtagatcttgattagctgtacaagttagctgtttatggctttcccatttaaagtcatgtaatatttacaaatgttgtttacatttgtcatattgtcaaaatcaatttcaagttgttagaaacaaagttatatagataaatgaccaaaataaaagttgtagatcttgatgagaagatcaattttgttgttgaccatatttcgatttgaaatcatttactatccaaaaatgtgttatgactaataaaatgaattattatacagtagctatatattttgtactcacaaatataaagacttatctgggaaatggaaaaatagtcatcggtgacaggccttagttcaagcccgatagagattaatctatctctatcgggcattatcttagggcccgtcacagatgagtcatccgtgacgggcctgaatgtcatctcaatcgggcattagtatggagcccgtcaccgatgagtcatctgtgacgggctctacggcaaagcccgattgagatgactcatcactctaatataactagggtttctcagatcgaatcgaaaatttttctaagtcccgctacagtttcccgcctccttagaaccctagcgccgccgccaactcctccttcgccgccgtcgtcctccctcgccgccaccgccaccgagaccgccaccaccgccgccgagcccgccgcctccactgagcccgccgccaccgccaccgagcccgccgcctccaccgagcccgccgccaccgccaccgagcccgccgcctccaccgagcccgccgccgccgccaccgagtctctacaccgaccggcgtcggccttcctcgtcgtcgccgcctgcctcttcaccgacacgaacagcagcccccaccgaggccggcgacgtcggcccgatgccgacctccccgaccggcatctacaccgaccggcgccgccgccgtgaactcctccttcgccgagcccgccgcctgcaccgagccagccgccgcctccaccgaccggcgacgccctccaccgagcccgccgccgccaccaccgagcccccccgaccgacctcatgtgagtcctccaacgcgcctccctctgctacttgcatgtggttgataatgaaaatgtggatgttgggatgaaatgtggatgttgggatgaatttagtgatagatgattttagtgattgatgacttgatgatgaatagatggaatgtggtgcattaatgaatttagtgatagatgattttagtgatagatgattttagggattgatgatatgtggtgaacgaatgattttagtgattgatgacatgatgatgaatagatggaatgtggttcattaatgaatttagtgatagatgattttactgatagatgattttagggattgatgatatatggtaaacgaatgatttttttgattgatgacatgatgatgaatagatggaatgtggtgcattaatcaatttagtgatagatgcatgatatgtggatgaatagatggtatgaggtgaatttatgattttaggatttgatgatatgtttaatttatttatatgtgccattcaattcattctatcattgtgatatgcgcaatttagtttatttatatgtttcatttatttttataagtgacattcaattcattgtaatagattgtagcactcaattgtgttttttttgtttttttggaaaaaagtagacaatgtcttagcaaggcgaaccaatgtcaacgacaactagtgggtcctcaagggaacgtactcctaggacaaggaacaaaattcctaaggaacggttccgcataacagcggtggacgccgtagggttgccgacatctccaaggaaaatattgagccaatttaggtctatctgcggggtcatagggaggcagaaattcagtattctgcaagacgacttcaagctcatgccggccacagagaaggacattgcttggctaacgttcaaggagagctttgattatcctgcagagcatgaggaccgtctcaggcgggctgctttcaaggttatgggcactgcttggaagaacttcaagactaagctagtcggcgagttcgtctacaacccggcaaatccagatccaagagaaaaatttccttggatcacggaacaggtctagtcagaattccatgcgaagaagtcgacccccgagtccagagctagaagcgaggcatatcgcttgctccagaccaggaaccagcatccgcaccggcttggtaccgccggatatgccggtaaggaagaggaatggcagcgtgaggatgaagaagcggaggaatcgtgcacaccgctcgtgtttggcgatatcccacaccctcgggctaggaactgggccagggctaggtaccagaaacatgatgatggcacaatcttcatgccaaatgcagaagatcaacgagtatacgaagctatagtaagtgtctaatcaaactagatgttcgcattgtttcccatcgtgcagtttatttgaccccactaaattgtaatgcagaaggagttggttgccgagcaacaagcctcgcaagaggcctgctctcaaagacgcgaggacgacctcctcacgaaagcgttgggcaacaaggaacaccgtggacggacacggggcgttgggtcttctgttccctggaattatggatttccagactacgcgtggcagtacaagaagcggacttccaacaaggcggagaaagatgcacgccttgaagccaagatccgggagtcgatacgagctgagctgacatctgaattcgacgaaaagctcgagtcgatgagggccaagattaggcaagagatccgagaagagcaacagatcccccaggccgccgctgctgctgcgcacaaagagttaggaagtcccaccgaaaaacgtagcagttgcgcatcaactgagttggcggaaaatccaacattggtcgacagcgccgtcgaccacataacggtaaccgtgaacttactcaatacatgaaagacgtaacgaatccatatgatatataatattctaaaaaaattgattaatctatcgcaggaaccaacgagctgcaccctcacagttagggtaatgccgaccttcactgttctagcagccgagggacttgcgtacaagccgaccccagagacaagagtgcatggagcgcaactcagggccgactgtgcaaaagttcaagtcgactcggtgaagcccggatacaagctgttccctctgaagtatccatcgaacgacgaggtcctctcactaggaaatgcccgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatttgcagttgcagtatgacacggattttggggaggaccgaacggaggccgacagcaaggcgattcatgaacccccaccgatgaagaagagcaggaaggcacactcctcccctcagagaattactctcgataaacccgaagcaaaggggagaggaaggggaggaaaggtgcaggcctcgcttctagctccaagaaagctagatctgggcaagggccaggaagagactaagggcaaagaggtcaagaagaaatacgtcgctccacaggagttccaactaggcatgccattggttggagatgacgtgcttgccgcaatgggcaccgcttgcaaggaccttcacttatactacatggagaaatctaacgccaggaagccaagtaaagctaccgatatccttggacagcacgatggaaagccattccttgatccaacaaattatatcgtggtcgacttcaacgatcttttcgacctctacaggctccgagtggtggacacaagcctccttaagtgctactccttgtaagtattgtcgcccaactcattctgttaataacaatcggtttaacttgcttacaagatcgttgatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgtgcctataa

SEQ ID NO: 9330 - DNA, 11484 bp, Oryza sativa
tgataagaacgcatatgaatggaccccaattcaactagcgatagatgaagcgtgggcccaatacgtgcaaagaggaggcctcaggaagacaggacatgacaccctcatccacaaaaaagacttcccggtgaagcaacaaataggtgaccagtgcggattccatgtgtgccacaacatgcgacttctgtatagagaaaaggtgaagactttggctgagtttgaggtcggtggtctcaattgtgatagactaactacattttagtacttatatatgatcgatcaactaatctggaattatgactatgtagggcacaataaccaagtctctgactaccagctttgaggaggttcgcgaggagatagccagcttcatcctccgcgaaataattaaccccaaaggaatgtttaggcttaaactaaaacgatgaacaatgttgaacttctatgtttaggcaatgatgaacacttattatgcaactgtggtgatgtaactgtgatgcttatatttatgtatatatttcatatgtttatgttaagacttgctaaataaatatttgatccaattaactcggttttgcaggtgaaatatgataaatatttgaatggatgtgaaatatgtgaatggatgtgaaatatgatatggctgtgaatgtgtggttgtgtgaaatatgttgatgtctgtgtatgtgaatgcatatgtatgaatgggtgatgctggggagctggggatattggatatctgtgtttgtttctgtcatttttgcagcgggcatggctagcaaaggcctgaggctagccaaaaaacaaattttattttttttgtggattatagtcatctgtgacgagccataactaaatgcccgattgagatgagatcatctgtgacgggctttagcttaggcccgattgaggtcagcagtcatctgtgacgggctctagtttaggtctgattgaggtcatcagtcatctttgacgggctatagtttaggcccgattgagatgagaatcatctgtgacgggctctagtttaggcccaataaaggttagtagtcatctgtgacgggcgctagttgtggcccgatagagataggtcatctgtgacgggctatagtttgactggtcgtctggatcaaagctatcggtgacgggctttacttagggcccgattgagatatattcattcgtgacggccgtttgcccgattgagataactcttcacatcagtgacttctagcctgtgacggacgctgtgcccgattgagatggggcttaccgcctgattgagatgagggtatccgttctagtgggtgttaagatctttcttcctaatgtgcgagcgtccctgaagtgcgcaactaatattggttttaacacaaattcttgattgatcaagtcatggtaatacgatcgacctaatgaactacagatcttttagttaacgtttatagtaaatgtgagagctctctgggaatacccataaataccaatattatttgcgaggggaatatttattccgacctttattaataactatcatgtctgttgggatttaggccatcccaaagtctgattatcctgaccttgactttggatgcttccttcgcattgtcaacagcttgaaccatgtcattggtaaaagaaaaggtaagctgcagactatatgtagtgcatacggacatacatacagtaaattggaaaattataaatattatatttgctagtttgtatttagatttagagaaaagtcatagataagggtctatgatctgtcgactgatctgattaccggatcattagcacagctcatcaacagctatttcattatttcagtcaaaattagtcatcgctaatttcttaaataggttgcaacatgtacgttcatcgaacaccgaacaactcattaaatagggaaactatcggccagtaattcatcactcaaaagtccaaacaaataaaaaatcaagaaagttttaaatagatggctgaggagatcgcatagaagatgcaagttcgacattacctgtgtgaattggggaacggtggcatatgtactcgattttttggatcggcatctggactcctgaaatttattgggttggatgatgacgtttcagatgagtgtcaatccaaatcaatgaaaaatcaatctgttcaaggttgaggtaaaatagtacccgagttagagaggatttgagattgcaaatcatcaccaatcacattgggtatcatcccgtggttgctagtcctctctcccacctctctatcgttaatttctatcagagagatgaggtcgatctgtatctctctcgattactgctgatctgttgtagagaaaaaatagatgggctgaaagagcccatgaaattagaaggcaaattagcccgccacgttagattttgtatgtacggccatgataataaaactgattaaatcaacggttagatttctccggttaacgtggaagctcgtagaaagtgcccaattagtataggtatagaggtatagagggatagatagatagatagatagatagataggtacggcacctacgaattgagccgagccaacaggccccaccactagcatcgaggagataaggtcattcgaactctctcgtatcctctcgatctctctcgttctctccgctctctctcccctctcattttattcgctctctctcccctctctatctcgctcgcagcggctggaatagtggcgtacggcgggagaaagggcagcgacggcggcggcaccggctcggcaggggtgggaggggcagcgacgccctcccctccgccagatctggcgggaggggaggcgcggtggccgtggacggcatggaggcagagacccctacttcccggatgcgacagcccctacttcccggtggtccgactgtgggaggggaggcggtggtagcccggcggcggagtatcctcggggcaatggtggcagcggtggcgggtctggtagatggcgatggtgagcagcggtggagttcattgttctttcaatgtttgtcgtgtgatgtctgttattgatgttggttgattcgggagtttatagtctataatttctgtgatgatgttggttggttcattgtgatgatattggttgattcgttgatgctgtggatttgagattttgggggcaacgcagggggtggatgcgctcgatgcaccagctcgattcgagccgatgtatcgagccttttttttttggctcgcgaacacctcaaaggtgctgattttgaaaccagcaccaatcacttggagtcaatagtgccgcctccctggtattttgtagtagtgtgggcacctaattcctcggactaccatcaggtatcctggacatatgtgagtgtgaccattactacaaaacacctaataggtattggctcataggtgtcggtttatttaaaatggatacctattaccataaaaaccggcacctatagtataggtgctagttttttttaaaaaaagggacctatacttatattataggtgccggatctgcatataaatcggcactatagtttattgtaggaaaaccagcactcgagctgaggcaaaccgatcaaaccagcgcccatactccactccttatccatccgacatcctctctctcggtactacactccttgtcctcctcctccattattctccccctcctcctctagatccgcctccccccattcttctccccctcctcctcatctctgttagtctgctgtgaggtggttaccggcatcgatggagcggttgcggcatcgcctcctccaccgttgccctcccctccggccgcttccctcctcctccgacccccctctctcccagcggaggcggaggtggaggaggaccgcggcagccacacacaatagcccaaatccagtggcgacggcagagaagaccggcgtgaaggaagaggtagcggtggcgacagcggcccttctcctctacatcaatctccacccaacatgcttgctctctgctatccactaccaagtgtatatgacatattaaactgtacacactaaccacatgcgtgtgcattaagttaaaaaaaaaggctgaagacgatcattgatccggcagagctccgtgctttaagaagagccatgccatcagaatcctcttccaagtgctcaacaccaatcatgtcatcccctgcgttcagcacctgttggcagtggtgaatgggagcatctgcacatgtgcagtaacaaacaagggaggtacaaccaatggatgcataaatgctcaccttgcctaaaagatcaagcagttcatcaagcgtgtaaaaactcagattaggtccttacttcacctatgcttgatcaacggtggaatccgtggtttgccatcgcagtgcgttgtcagacgatcgtccggcgccgtggcctcgtttggcgccaaaaaggagagcgcggccaccaaaacgcatctgttcactgtaaaaagggtaggagtgacggacggcgctgggaaacaacttgttgggccagccttggccagattcacgacgcgtctgctcgtgtatatcatgcagttccctgggcggacggttcgatcgaatgtggacggctggatgacctcgactgatctctgccatcgtgaggggtgaagtcagatgagctgaatccccccttctttgtactggtctgctctcagatcccgatcgcgggaagcccaatggtaaggaggtgtcgcttttggccaagctgggtgtttactcagtgaaggttgagcagccttcagcgtcgttggtgctttctcaaggccgaccacaatcaggtgccctgtgttcacggtggtggtggtttttgttggttccacctcatgactgagctttcgtgagctgaggagttagaactgcttgactgggtgacaatcttgggaacaataacccctcaagtagtgtggttcgccgtgggtggagtagtagtgttgtttgctcctatagtatggggtcgtcttgttttgtgacagagtcagagctgttgtgccgggtggcgagctaggcagcgataacccacaacaccctcatcatgttttttggaggcaatcaaccgtcgagagagaccgaggcgaaagccttacccccagtcttctggcggtggcgacatcgacactagtgagtgtcgtcttccctcttagggcatcgttaatgcggccctctcttcttcaagtgaaaacctacaccacgccaaaacggctcacttctaagaacccaccagtgacaggccgaagtgcttgtcacggatggcctcacctttgacgggtccatcgggaggccgtaacagatgaggtcactggtcgcagtctgtcacaagtattccgtcacctgtgacgggtcggaattagaacccggcagagggttactttcgtcaaatgtgagtgacagcccgtcactggtgacctaatagccagatcatagaggtttgtggaactgattgccatcatctcgactctaatccaacaagtagtgtaagatgagaggttgtttttggttgaaacttctttcttctgataattttacttggcttccctccaagatttttaccattcatagaagactatatcaattgtctgcctttttgatggtgaatctccactacagagggtttttttaaaaaaaatagtttttttttggatttgcaagttttgcttaagtgatacagcttgaggagctcgaatttcggcagaataaattcaaactcgggatcttctttgaattattactcccgtacgtatacatgtggctagcggaagtgttgtctgtttttattgtctgaaactctgaatatatacacccctgtatttattgtagagaataagctctgccacgatgtattgctttctatgcttctctgaaaaagcatgcggttgacagtttgtagtaatctgctatacgttgcatatattttcaaaaattgttatctgcagttcactgtagaagccaccacagcagtaagtttacttttttttttaagcaaatgacggcatgagatctgccggatatattagaagaatgagcagacacaaagtcttaaaggtgaccactacaagcagtggtactttttttttaaaaaaaaattacaggcaaagaagaaacaactttcgcaaggcacaaacctttaggtttggcgcaagatctgcataagatctatattttctttaaccataaaagctacttgtgtggcactaagatgtttttgctgaaaaattcttctgttacgttcaagccacacatgccaccaggttgttagaagggctcctattagcttctttcttctgtttccttgaaatgaaactactaaagattcccaccaatctgagatgttctaatgcacaaggtgatttggaacttgtgagaaatttagccacaagcaaacctggttccagaccaagatagtgaaactgcattcctttgctaaatgatttgcatcttcaaaagcttctgtgcagagactgcatatccaatcacatggccaatgccttaataaaaggttttccgctgtgagggttctttgatgtaggatcagccaaccgaagaaacagtgttttggttcagcttcagctttccaaagtggcataaagtttttgtttacaacagagccttggaactgaatttcataagcgctttttgctgtgtactctccatgttgagtccatttccaggttatgttatctagagagttacagtgtaggttgatctcttgcagctgggttcccaagaagactaattcattgatctcttcaatcgaggtgatcatccttaaagaagtgatccagtggttgttttgcatctctagagctacacaatttgcttttctttttgctaatctgaaaatatttggtgccaagtctttaggagcccttccctgtagccagttgtctgaccaaaacttacatttcattccatttccaagagagatctgcgtgcttgccctgaacagaattctatccatctcgtcacatggaatttccatgttaatccatggcttatgttcatctttccattcataccaaagccaatggagtcgtagagcccgcgcgaatttctccaaattgagggttccaagtcctccaagagatttgggtttgcaaacagaggaccagttgagaaggcagctgcccccactaacattttcagggtcttttcctttccaaagaaaagctcgtctaaatctgtcaattcgcttgtatggccatttattttgttgtagaatcgttaagtggtaaattggggttgaggacaaagtatttttgaccaacacttctctgccagccgaagtgaagaatcgaccttgccaaccaggtatccttgatcccactttatccaccaaaggctgaagttctacttttcttaattttcttgtgtgcaaagggagaccaaggtatttacatgggaagtttgaaactctgcctgggaagatggatagacagtcatcaagattgatctcattgcagctaatcgggtatatctctgttttttccatgtttgtgtaaagaccactggcttctgcaaaaacagagagaataccacgaagaactagcatctcgtctcgatttggctttatgaaaagggcaacatcatccgcgtaaagagaacatctgaaacgtctttgtctttggagacttgacagaagtccagactcttctgcctttagaaacaatttatgtagaggttccattgcaagaataaaaagcatgggggagagggggtctccctgacggagccctcttgcatgttctattacctgccctggggtgccattcaggagaattgccgaggaggaggtacccaacaagttagaaatccaattacaccatttctgaccaaaaccgaagttttgtaggacctctagcagatatggccaattaactgtgtcaaaggctttcgaaatgtcaactttaaggaaaagagttggcttttttgctctatggcatgctttgatcatgttttggacgaacaggacattgtcgtgaattgctcttttcctaataaacgcactttgactttgggagaccaaatctcctagcttaggtgcaagcctgttggctagcagtttggcaattatctttgcaaagctatgaattaggcttatcggtcgaaaatcttccactttcgaagcatcagtctttttgggaatgagacaaatatgtgctgagtttaggtcctgtagccttgagtatcccaaatctccaaagaaagttactgcctgcagcatatctattttaattatatcccagcttgaaaaaagccccaatgaaaccatccgggccaggggctttttccgagggtagatcagaaatgacatatttaagttcttcttcagtgaaaggctcatcaagatctgagagatctaaagaaggtatgttgagggcagcccagtttagtcgttgatttctagggccaaaagaacctaggttttgagtgaagtatcgcttcacttcttctttctggttttttgtgaaagcaataccaatcggtgtttggaggagcaggatgtggttttttctctttctaccgttcgccttgatttggaagaactttgaattgacatccccatgttttagccatgtgatcctggctctttgtcttaagcgaattttctccatagctgccaggccaagcactcttactttcaaaaattttcgaaaacactgttcttcatccgacaaaactctatcctcttgagcaacatctaattgaaagattacttcattcgcaattgccagctgcaatctcgtgtctcctattttggttgatttccatcttctgagatctcttgcaagccttcttagctttaaattaattcgtgcaaaaggattggtggtctgtaaaggtctgttccaggactcctctgttatctgaagaaagtttgggaactttagccaaaaggactcgaaacggaaggagttattttgctctctttccacacagcctgttatgaataagggggcgtggtctgaacaggaagaagagagggcatacatttgtgctgagtcgaaaagaacatcccaatcaggacagcaaaaagcacggtcaatttttgattgggttgggttatcacactcttgtgtccaagtgaatttccttcctgaaagaggcagttcctttacctccaatctgtctaaagttcctttgaacctctgcatcatacttctatttagcctgctgttgttcttgtctgaggttttatagattagattgaaatctcctattagcagccaaggtgacataaccagttgctttatttcctgtagctcagtgatgaactcaattttctgggcatcttgctgaggtccatagaccacagttatcgtccatgcgatgccatcatttttcatagtcactgtggctgtgagactgtactgcttccggagaacattagagaggctgaaatagttatcgttgcaggctaggaggattcctcctctggttccatcagcagggagaaaagcaaattcgtttttgaaacgagaacccagagtatgcaaaacatccacatcagagatttgattcatctttgtttcttggagacaaactattgtagcattcatctgctctaccaacagcttaacacttttttttctaacttggctgttcaagcctctgacattccaattgaggatgaaacagttcaactgcgacatgaataaaagtcattactactgggggagactccatctgcaggggaggacttgtgatgcaaatggccatctctgaaacacagccaagaaacttggcagaaacacaaagaggtgcacatttgcattacaaacatcaaaagccatctacttaacatcatcaacagttggccggcagtcttctgtcacggttggggcttcatatcggcaccaccgatgccgccttcttggcacgcagccgaatgcctttgcagcctccattctccaccagtgtcgtgattgtcttcatgtctgctggggagagcagtttcttgtagtgctgcaagtaaagtttcttaatttggtcatctagacgcttattatcatcaagaacgccaaatttctttgcaagtatttcttgcgcaattaaatcaagctttgtattgcgtctggctttcacggccagtctttcacgttgcctttgtattggagtaatcaccttgttgcagcatgggcggcgtggcttggttcctggcgcaggaaggagtggctgctggatgggtgtggtcacctccgccaggaactcctccacatcatgccgggtcacctcaactggtgtcgcctgtgagtctgcagcagctgaaagaacaaacacaggagaggcagtacgaggcagggaagtatcaggggagtagatggaacctcccatcgtggcctcatagaacataggatccaggtgtctttcaagcaagagcaaagccctctgatcctgtgacacgggcaacagatcaggtgagagaggttggggaagaggagaaacaactgcggaagaatgcccggcatccggggcggctccaactcaggaaaaggaacatcagtggctcttgcttcactgtctggccttgtgatagagaaacttgaagccttcaggatggagctgctcaagtctgagctccaaatccaaagatcaaaggtacggttgtagttccggcgacgggagtactcttctatgtagtggactgaactcttgcagccaatgatctttgtcgccacttcttctgatcttgcatgcattgggataccttcaatgcagactcgggcatggaagcgaacatcaattacttcagcattgcgcctttcattccatggcttgaagtgatacactctcccacttcgagttaccagccttggctcttgcagcacttcctcacgatcgctatggttaacaaaagtgaggaagaagtcttctggatagaacttcgtgatctgaatgtcggagcgatggatacggaaggccgaacggatgtcatcagcaaatgtgccgatctccaccttctggccttcatcagaccaggccaccaccgatcttgccgtgaagagctgcttcagacgttccatttcacttgtcgccgccaccatgcagctacccaggtcagggcgagaggccaagtcacttgggaccgaggccatggtgggaggagcagaggaagtgttcagatggttgttgagaggagggaacactgtggaggaaagcagtggtggcgctggtggtggagatggttgctaggatggcggatgaaactgcacttgttgttgcaatttatagcggcgttctctgcaggctgaggagaggtgaccaaatcttctgcaaaaccaacaacgaagaggatccctgcagtctgcaactttatgaccgggttggaggcagcggaagcatttaccttctgtgtgcttgaggaatcggatctttcttgcagccatgatctcttggttgttaggagaattgaatgaggatcctttcctccactagaacctttgcttaacttcttgccagggctgcaggaat

SEQ ID NO: 9331 - DNA, 7015 bp, Oryza sativa
agaacctttgcttaacttcttgccatggctgctctttctcagtcttggaagtagcacagcttcgggaaagagggggggtggtaatggcgtctcgtcaaatcaacaactttcccactgctcaacactcttgaagacggaggaggcggtgggcggccaagaattgagggattgaggtgatttgcaatcggtaggcgccgagctactggtggatgtccatcttgtcgaagtacggcggagtaaagaggccgagaagacattgggccggcggggggatttgaaatctgcttggagatctgcttggggatatgctgggatgaatgcagatttgaaattgattttgagatagatccggtctccttacctcgatccccatccgttgcagaaacgggcagatggaggttagatccatgggggatctcttctccagcttcagaacagcctggatctaggggggagtctacgaagatttctccctcctcaggtggacagagggagctttgaatggaagggaggaagactggagaagattggttggtggggaaacattcaaggactggggaagaaatgtggagcgagggatcaactgggtggaagcttcgtggcgccgggcgtcgccgccgcgggtgagtgtcggggctaggggagagggacggaggcattttttccgcagtaagtttacttgaaaaactgttatgtgcagaaataagcatagggagcttttgtccaacatatcaagatgagcaagatttatatttgcctttatgtcaaattcctctcgattaccaacatgtttgcgcatctcatacaaaacatgcactattcgctttttgtgagtgtttctgtgtgcacattgatcggttcgtatatatttgcctcttccaaacattcattttctctctccccaacgttgttcaacctttacgacgcttcgatccgttgtgttaatctctaacagaacagcagatcccctgcttgcttgatacctcaaatctagaaaaaagaaaagaagaaaaaaatgattgctggatgaattgatacaatacagttcagggattttttttatcgtaggtgcaatttactcattttgttatttaaactgcaagttgatgtatctaatcgattcttctttacttctttttttttagggataatcgattctgttagtgggctcagtttgattaagttgtcttgttcaagataggcaagttttccatattcatctcgttgaactatttattcaataaagttcttaggacataattaggcaaaagcagacaggtgcaaataaatctttcgctaacttttttttatagaaacacattacaaacacagtgcccacaacacatgcacacatgcatcgcacaccccttatccttatgagcatttttgaaagactgtaccaatatatcttgagatttacagagttgtcacggacgcctcgctatcaacggaaacgtcacctgccacttaaaaaataattagctgtaaatacgagcacacatatcaaatataaaatttaaacctgtgtgaactgctattacaagcaatctaaccagttgagctacactcacttcttttctttggctaacttttactgcgccaaaggagggaacagcaagtgcaggaataattgggccagcattacatgtttggcaatgggccatgtactgtacagtacagaatccaattgggcctccgaatccaatcggaaacaaataaaaaaaaggaaaaagtacacggaaggtccctcaacttgtcatggggataaaaaatgttctcgaaccgcaaaaccagatatgtgaggtcccttaactatacaaacccggtcacccaaggtccttcagtagtttttgaacccggttttgaactacgtggtggctaagtaagcgtgggacccacgtgggccccacatatcagcgtaatccacgccatcccctccctctttctcctcttctctctctcacacacactttctcctccacgggcgtaatccacgtcctccacagtgagaaggggagggcggcagcggcgcgacggcggccggcgcccggggggagaaggggagggcggctgcggcgcgacggcggccggcgcccgggggaagaaggggagggcggctgcggcggtagccaggggggagcgcgaggaggacggggggagcacggcagtagcagcggcgcttggtcctggcgcaccgccgccgtcgcgcctgtccctgcctcctgccgctccggctcccagcgctgacgccgacacggtcctcccgcctcgccgccaccgccaagccgacgccgacgccggggagagggaggaggcggcgccgtcaatgacacacagcccatcaagatgaagatatctccagggagcagcatgtttcgtcctcctcctctcgcgaacagtaccttcgcggcggcgccgaacagcggcggcggcagtggcgcgacgctgttcgccgctttcccgacgctggacattgttggccgccgcgtcgtgagctccggcggcttcacgttcccggcgcggctaaggtagtgagcaccactggcgacgaactgccgcgcgagtcgctcgatgtgttctggcccattgacgaggagtcggtgctcgccgctggcttcgcgcgcgccccaggggtggcggcggtggtgaccccctcgccgccttcgctcctggccccacctccgtcgtcgttgccgcatcgccggacttcttctcccgcctcgccccggcaacctccttccccactcgccggccggctgcctagagaggagaaagtgtgtgtgagagatagaagaggagaaagagggaggggatgacgtggattacgctgacatgtggggcccgcgtgggtcccacgcttactcagccgccacgtagactaaaacggttgtcaaaaccactgaaggaactcttggccggttttgtataattaagggacctcgtatatctggttttgcggttcagtgatattttttatccgacgacaagttgagggaccttcggtgtactttttccaaaaaaaaaaaaatcaaattaagcatcgcatcggcaattgctcgctgaaacctgcaaactaatggcgccaccgctgcatttttcgtctcgccccaccaatccagcgggcgccggatcgctgcatcagcagccgcctacccactcgccagcctcgccgtccgtcaacctcccatgctttgcgccgtcggcaccctcgcctctctcctccctctgtcgctgccaagaattcaagcaagaggcgggagacgaggcggcttacacgccggtgcccacatggtgctcgacgaaatgggtacaaggacgacacattggatccgatcaggaataacagaaacaacgtgacgggaaggcatcgccggagggttattgacgccgacaagatgtgtcgccagagtgttccacggtgccagccgactgcatcgccgtgctagcttctcactgaggtcagatgctgtgtgtctgtactgacattcgttagtcctatttttcatacattggctgcattcttttttatttcttgtcctaaaataaaattggcctaaaataaaattgggtgggttccccctcttggctgaaataacaaatctgcatacaaatacaaatgcccggggccttcatttacctataaacaaaaatttgtttcgaagagagcaataatcgctctcttcaaaaataatcgctcgctttttttttctgcaaaactagcaaagtcttcaaatacctttgttctatgggccttgacatgcatctcgacaggtcaatttgacaactaggtagtttcttaagagcaaatggatgagcatagatgctctcacatgattagtaggtggaattttattccctcttgttttcaattgaccaataattcatgttttacaagacaccacctctaacatatatttactatgcatcatatcaagctaattgttgaatatgacttgatatacaagtatacaactcttacctcctgtttctatatatatgcaattatattctatatacaatataaatactaaaagtagaattgggcttaatatataactcttatattgtgtttccatagatataattgtaaatttatacaactgttcctatcattctacaccgttataatttggttatatcatgatgtaatgttttatattttatttttttctccaagtaatgttgtaatttctaggccttcacatcgaacatggtgttttcttttagagctatctttataatataaaagatatgtcttcaaaatttccttttttttcaggtgtaagtagtaactaatgactttagttctactggatgtttcttaagttcaaatggatgacagcaggtgctctcacatggttatttagatgctaataaggtatctagagtactgtagtgttatagttacctgtgaaccatattttaagtggctgatcattggggacacatcacaacaagcacactcccatctatttcctctgaagcgctcgtccatatttttctagtgcaccccaaagtcttcactgctgcagtgtttccttgtgttcttgtcagttgtgagcgcaacaatggctgaggttgttatcggaccactagtttccatggtgaaggagaaggtttccagctaccttctagaccagtacaaggttatggaaggcatggagcagcagcgcgagatcctggagcgcaagctgcctgccatcctggatgtcattgaagatgcggaggagaagggagcttttcgacctggagtaagcgcttggctcagagcactcaagaaggtggcctatgaggcaaatgatgtctttgatgaattcaagtacgaagccctccggcgcgacgcaaggaagaaggggcagttcaacatgctcggcatggacgttgtaagcctctttccttcttataaccctatcatgtttcgtaataagatgggtaagaagctacaaaagattgtggggagcattgaggtccttgtctcagagatgaactcctttgggttcatacaccggcagcaagctccaccatccaatcaatggcgtcaaacagattctataatggctgactctgagaaggatattataagaagatccagagatgaggagaaaaagaagattgtgaagatattgcataatcatgctagcagcaatagggatctgttggtccttccaattgttggaatggctgggctgggaaaaaccacctttgttcagctcatttacaatgagcctgagatcaagaaccatttcgaactctggaggtggtgttgtgtgtcagatgattttgatgttggaaatattgcaaatagcatctgcaatagcacagagaaggatcatgaaaaggcattgcaggatctgcaggaggcaataagtgggaagaggtacctaattgtcttggatgatgtatggaaccgggaagctgataagtgggaaaaattgaagacctgccttaagctgggtggcaagggtagtgcaatactaacaactactcgtgattcacaagtagctagaattatgatcactggtgtagttgaagcctataatcttgagaaacttggcgaagaatatacgaaggaaataatacagactagagcattcagtttggctggcagtgatgagctatctgaaattgttcagaagtttgtggacagatgtcaaggttctcctttagctgcaaaagcctttggttctatgttgagtaccaagaccagcatcctagaatggaagaatataatagccaaaagtgacatttgcaacgagaagactggaattttacctatactaaagcttagctatgccgacctaccatcgcacatgaagcaatgttttgctttctgtgccatattccccaaaaattatgagattaatgtggagaatttgattcaactatggatggcacatgacttcattccactagaggagaaatatcattttgaaacgacatcaggggaagaaattttcaaggaactagcttggaggtcattctttcaagatgtcaaacaaactcctcttgtgtgcagtaataatggagacagggtgcaactccgatacaccaccacatgcaagatacatgatcttatgcatgacattgctctatatgttatggggaaagaatgcgtaactattacggataggtcctatcgcaaagagttgttgtcaaatcgttcgacttaccacttgctcgtgtcaaggcatagaactggagatcatttcgatgattttctgaggaaacaatctacaactctccggacattattgtatccaacatggaatacttatggatcgatacatcatttatcgaagtgcatttctctacgtggactgcagctatatgaaatcaaagaacttccaattagaccgataaagttaaagcacctaaggtatcttaatctctcagaaaactgcgacatcaaagaacttccagaggacatatccatactgtaccatctacagacattgaatgtttctcattgcattagacttcgccggctcccaaaggatatgaagtacatgacaagcctacggcacctctatactaatggatgcaaaaacctggagtacatgcctccagaccttggacatctaacttctttacagacactaacatattttgtggttggtgctatctctggttgcagtactgtcagagaattgcagaatttaaacctttgtggtgaattagagttgtgtggtctagaaaatgtatcagaggcacaagcaagcacagtcaatattgaaaataaagtgaaactcacacacttgtctcttgaatggagtaatgaccaccttgttgatgaaccagatcgccaaaagaaggtactagatgctctaaaacctcatgatgggctcctgatgttaagaatagcattttacaaaggcaatggttttccaacttggatgacagatctcagtgtgctgcagaacttggccgagctctatctagttggttgttcaatgtgcgaggaatttcctcaattctgtcatttgaatgtcctaaaagttctttgtctcacaagttt

SEQ ID NO: 9332 - DNA, 679 bp, Oryza sativa
tgaaatccctccaaaagcaccaaagcttcggatattgaagctagttgaagaaaaggcagagctatccttattaattctgaggtctagattttcttcattatcaaagctaacactgtctgtcagtgacggaaatgcaggactggagcttgatcagaattatgaagcacctctttcggaaatggagttatgtggctgcgccttcttcttccccttaggcccatcccgtccaacagttgggatatggaaatggtttggacaacttgtggatttgaaaattgaatcttgtgatgtgcttgtgtactggccagaggaagagttcatatgcttggtttccttgaagaatttggccattgaaaaatgtaataacctaataggccacagacatgtgagtggggagtcaactcgagttccaagcgatcagttgttaccgtatctaacgtcactatcaataaggcaatgtaaaagcttggaagagatctttagacttccaccatctctcacatctatttctattcatgattgcagaaatcttcagctaatgtggagagaggataagacagagtcagagagtgtaatacaggtggaacgcaggtcggaacactgcaatgaccttgcttccacaattgttccagatcagcaatctccatcactaagaaataattctctgccatgtttagag

SEQ ID NO: 9333 - DNA, 11924 bp, Oryza sativa
  unsure (1)..(11924): unsure at all n locations
ttcctgcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaacgggacatcgctctgcaagattagtgccacaaaaaaatacgagatttctagtatttatgataaatgtaagcatccacaaccatccttctaaacatgctagaaatgaggactgaaaggtggttgtggtcctcgcacagagacgcgacactaatcgaacaggactctgggattccttaagcgagcatgaattcaggggaatttcgaaataaaaactttcatgctcatatgtgaaatgttttctctcgccctctagagtcgatgtctcaagcttgtccgaggcctgaaggttctccatctcaagagatgcatcgtgcaagaacatggttctttcttgatgataaacaagaacaacgttctgaagaccaggcggacaaggcttaggcttgatcgagggtgatgagggtcgttcggtttcatgaagatgggcaataggttcataaggaacgaacgaagatacaaacatcacctcctcgaacggctcatgcttgggatgagccttcgttttgctggaataattcagggtgtttccataatcttcataaagatcatccttgaattggaatggaatttctggaggatgaatttcctcttcctctggctccagcaaccggaatgaggattcggcagttgagttgggttccaactcctcgtgcagaggatcttcataaataatcttgacctccgggacggcttcgcttcggccgaaagaatcgttctctaagatcaaatctaagagctctcttccttcggcggttgtcttgtgtgcgaatgatccttcggcggagatatcgagatttgcggcagactccttgtctaacccgtatcgaaattgttgtaacaacacatggtcgggtaaagacaagtctgggccagactgagttaacaatgagaacctggcccaagctacaccgagatattccttctcattctgtcggaaagagatgatgtctaatcgaagattaattacacgggttaatggaaagaaagcaaggcagaatttgcacttaagctcctcccattcaccgtgaatttcatgacagacagcgtgtaccattgcttcgcttcatctttaagggaaaaaggaaacaacttccactttagagtttcatgtgtcaagcctacgatggataggcatgaacacactagctcaaagtcccgaagatggaggtatggattttcaccaataccaccagagaaggtttgctctcgaatcatggctataaagccaggaccaatttcgtagccatcggataggattgattttgaagaataggatggctcacaaagattagcccgaggagcataaaggttttgaattgtgggttgctccatcaaggaaaagaatgaaagaagaagaaataaaaataaaaatacgaggatgacctagactcggataaattagcaaccgttccccggcaacggcaccagaaatgcttgttggtatttcttacgaccacagataaatccgcaagcgcacagaataccgctgtagcacttcaccttcgggaaccccaaaaggatatcgaactcagggaacgtgtttaatctacctaaggctaagacgatccaaggacaacaattgatgataggtaggctaggctagagaggtctttctatgggttttaattagcttagataagttgaaggtaattccatatctgttgcttcgtgcaccaacccctgctggtctgccagcgtggttctgtctatagctctattatgtatctgaacgtggaggattacctggatgggattcagggctgtcaccacctgccgcctacctctgacaaatccgtgggatacacaacaaacaaaggtaatctctaacctagacaccacgtctaagatatttattactactctaatacttgcgcaggaacttccttctctatccaaattcctagtactagagcacttagtataaatactaaacaatgaacccgcaaagatggaaatctatcttacttaaacaaagtgattaaataacataagaaaggaacacgaatgcttactttatagaagaagtttctccgaatccggagcagagtataccgacagctccggtactcctccaaaattcctcctacgaagctacacttgtcgaggtagaagtcggttgagcgccaaacttccgggcactcctccagagcttcccctcactctctacattattctaatgtacaaaagatacaatagagcctcttgtaattcagctcaaagttgtgtgtgttggaatgagagtgaagacctccttatataggctccaaatgacggttaggggtatgagaaatgatcaaaacaccctgcaaccgccataggggaggaatccaagccgtccacgtgaagccagatggcgggaggcgccaggattggttcggccaaaccaaaaatccgtcctcccggcctctcctttggccgataggttgcttattgggccccccaacatcttgcacaatgttttggcccaattctaagtggttttggttgacatatgggccctccaatccgtgtaaacgcgtcctgaatgcgcggaggtgcattttttcgcatgacggatgtgttttctcctcaaaatacctgcatacacatatttcaccaacactagtggaaatgattagtaataaaccctaccactaagttggataccatattttatttcattatatgtaagtattgacggtcaaatattatgatttaaggaccgtcaacaatgggcctgcttgctcatattgtgtttgtgtcgaacttcaggtcactcatcgtgtacctacacttgaaacactcctatgcctagctacatatttgtaacatcctcaaattttaaactaaaatttgactgcatcatgctggcttttgattaaattagtgtgctttaaaaatctatttgactctttaattggttcaagtattactttcttagagccctactaatttaccctaattattccctttattccaaaccctagtgaatttgtgcaaattctcttaaatttgcaaccatagattatttccttagtttatcctaatattagtgaggatttgctatacttcaaaccctagtgaaactctttcaaatccatagattaaattcattcttttctagggaaatatttaaaaattcctgaaaacactgttcattgcactcaaggtgctcgacaaaatgcccagcccagctagagcagcccaatcaccacccaatcttgtgcaaagtctagaattgatcctaggggaccacatcccactcaaaaaccgtggtttagttggccttctcctcccccttgcgcgcgccgtcctggcggccgactttgccgcacgccgagccgccacgcgtcggtctccggatcgattgcgcgtgcccgaccgccttggcgtgccgctagccgttcgacgcccttagaccaccaccgccgcaccaatcacgacgacgacgaagtcaagatgaccaccgccgcaagaaatcaccgctcgacgccgtgcgcgcccgtccaaagccgccgccgagtacgatttcgcttctaccctaggtgaatcgcgccaattcttgccgcatggttggattaaagttagacgttggtttcccctctcacaattcaaaccattcacccccaaatcggttgttttcaccctcgccgccgccgtgcgtcgcgcccggattggcgccaacacgtcgcaatccgaattcgcacgcggtcaagtcaatccttcgccggtaagtattcaaacgtggcctcccgccactcaaattgatcttgcccgccctctcatagcctctaccgccctagccatatccaaagctcgagctcatccatggtgatgacggtgctcgagctcatccattcctcccagccctataaataggaccccaatcccttccctgtccatcatcgatcatcaacaaccataaccccacaaccctgaagctctgcttcaccaatccatcccatcaaccaccatcacccatcggtcgaacaccttgtgcgcgatcgactccacacctctctctccatcctccgccctaaatatcccttagaacactttatatcaaccatgttctagtataatagaccctaaccaaagtcctgcgtcgagttctacctcgccgtgccaagccgagcactgccgctcccgcgctgctctgttcttcgccgccgcgaagtttttccggccgcaatctgtggagattatggttaccccatatctgcatgacagttatactttagtcggatatacggtaccaaatatagatagaatatctttatgaggactcgggttagtttttaacttgtatgtcaaggaaatacccggggtcctagtcggttacgattgtattttatctataatcccatattccgttaggatatggactgtattttgtaaagcggattccttcccctatataaggagggtccgtgtgcctcttggggcacgtttttcttttttccagtatatacaatcaataacacactcggcagaaacatccccgaacaggagtagggtattactttttgaataagaaggcctgaacctgtataaaattccttgtctccaaacccatccactttcctagcttgatagccaccccgttttattattgccgaaatcttgtttcgacagttggcgcgccaggtaggggcagcgtcaagttctcgctgactaagtgcgatgggtttcgtttctggcatcgatgacttcgccttccctcccgggcaggcgttccggttcggcagcctcaacttcatcaccgacgacttcggcaagatctctctccttgactcggattcaaaccagtcggggagagaccaggtccccgtgccattcggtattccgaactcggccgaggcctactccaagatcatctctcccgagtcggcttcaaaccactcggacgagatccaatctactctttcgcgactagatcaagacgacgggtcctatccctcaatcctgatgaaacttccttatgatttggccgctatcttcactgccaagacatctcccactcgaagatctaggcgagctccggcttcggccccgatccaatctagatccagagaggttggcgttatactccaacctcttgggacagtatcgacggaagagttggatggttaccttagctcccccggcgtcagttctcgaccaaccgagatcctcgactacgacgatttcggctaccactacgaccatggcgacctcgacaacttcgacgacagttatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgattacagcgtgagcaacaagatcgcgaacggattgcaaaggaggctgaagatcgacggcaacgcgccttggaatctgggcgccgagcgagagagctcattgggctacaagacgtcgatggaacagcggtctttcgcacccccagcagaacgcggttgcagcaattactctcctcgacaccctcctctaagaaaacgcactcaaccaagctgatcatgttgtcaacatcttgaaccagacgaagaccatgatcgctgcctcggttccagccaactccgcaagcacccgcaccccgactggtagccgagttcctcacctccgatctcatgattatcatcagccaagcctcagcatcatcggcacaggatctagtcgcaggagcaggggtcacgacgaacgatctgttcacttgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtggagtggattggccagccagctttaagccgactggaatcgagaagtatgacggcaccactaatccagagtcttggctcaccatctacggactcgcaatccgcgcagcaggaggagacaacaaggccatggcaaactatctacctgtggccctagcggactctgcccgatcctggctccacggactaccccgtggcacgatcggatcatgggcggaacttcgtgatcacttcatcgccaacttccagggcacctttgaacgccccagcacacagtttgatctctacaacgtcgttcagaagtctggagaatcccttcgagattacatccgacgcttctccgaataacgcaacaagatctccgacatcaccgacgacgtcatcatcgccgccttcactaaaggcattcgccacgaggacctagtcggcaagttcggacgtaaacctcccaggacggttaagcaaatgttcgaaaaagccaacgagtatgccaaagccgaagatgctattaccgcgtccaaacagtcgggcactacttggaagccaaagaaggacacgccgaccgcaggagggagtggaagcaacaaccacaaggatcgcaagcgtaagcccgaagaacttgtggcgaccacctctccatcttcccgacaacgttcccgcgtcaacaccttcgacaagataatgaactcccaatgtccgcatcatcccaactccaaccacgtggccaaagattgcttcgtctacaaacagttagcggagcaatacgtcaaaaacgcacgtaaaccttcagacggagatcaaggcacatcaaagaagaaagatgatgaagacgatgccccgactggttttcaagatcatcgcaaagaacttaatcacatcctcggcggacccctggcttatgagtctaagagaaaacagaagctaacagaacgggagatcaatgcggttcagcctaacacgccccaatatcttcggtggtcagagatagcaattaagttcgaccgctcggatcatcccgaccgagtggtccacccggggcggtaccccctggtactagacccagtggttcgcaatgtcaagctccgacggactctcatcgatggtggcagcgcactcaacatccttttcgttaagaccctggacgatatgcagattcctcgcacggaattaaagccgagtaatgcacccttccacggtgttatcccaggattgtcagctacaccactcggccagatcactcttccagttacctttggcactcgggagaattttcgcacagaaaatgtttgtttcgaagttgctgatttcgagacagcatatcatgctatacttggaggaccggctttagctaaatttatggccgtcccacactacacctacatgatgattaagatgcctggtcctcgaggagtcatatcactacggagtgacatcaagcaggccgtcacatgcgacaaagaaagttgcgagatggcccaaacccacgagactactctcgcccgcgaagagatccgactggctgcgaccatgggaagcgaggaagaagtgcctgcaaccaagctgacgaagaccgaagaaagtgatgccaagatgaaaaagattcccttagatccctccgatcctgataagactgctgtaataggcgttgagttagattgtaaataggaaagcacgctcatcacctttcttcagaataataaagatatttttgcatggaaaccatccgatatgactggtatccccagagaggtgattgagcactctttacatattaaggaagacgccaaacctatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacgaggcaatggcgcatgtgtgtcgattacaccgacctcaataagtcttgtcctaaagacccttttgggtaacctcgcattgaccaggtggttgactcaacagccggctgcgagttactcagtttcttggactgctactcgggatatcatcagatccgactaaaagaatccgactgcttgaatacctagtttattacgccctttggggcctactgctacatcaccatgccctttggattgaagaatgccggggcaacctatcagcgtatgattcaaagatgtttttcaactcagatcggtcgcaatgtcgaagcttatgttgatgatgtagtcgtcaagaccaagcagaacgatgacctgattgcagatttggaagaaacttttgcaagcattcgagcttccaggatgaaactaaaccctgaaaagtgcatcttcggagtaccgtcagggaagttgctcggatttatggtatctcagagaggcatacaggccaacccggagaaaatcaacgccatcctcaacatgaaaccgccaagctcccaaaaagacgtccaaaagctgactggttgcatggcggtgctcagccaattcgtctcacaactcggcgagcgggggatgcccttcttcaagttgctgaagaagactgacaatttccagtggggacccgaagcacaaaaagccttcgaagacttcaagaaacttctcaccactccaccagttttggcctcgccacatccacaagagcctctactgttatatgtgtcggcgacctcccagtttgtgagcacggtcctggttgtcgagcgtgaagaggaaggccatattcaaaaagtccaacgaccaatttacttcgttagcgaggttttagccgactccaagacaagatatcctcaggttcaaaagttattatatggtgtcttaattaccgtcaggaaattatctcactactttcaaagtcactcggtcacggtggtcacatcgtttccactcggggatatacttcataaccgcgaagtgaacggacggattgcgaagtgggccttagaattgatgtctttggacatatcgttcaagccacgaacttcgatcaagtcacaagctttagctgatttccttgccgagtggaccgagtgccaagaagacatgccagaggaaaagatgaaatattggactatgcattttgatgggtcgaagaggcttacaggcactggagctggggtcgtcttaatttccccgactggagaaagattgagctacgtattgtggatacgtttttctacgtcccataacatggcggaatatgaggcgctactccatggattaaggattgcaatctctctaggcattcgctgactaattgtccgtggagactctcagttggttgttaatcaggtcatgaaagagtggtcctgtctagatgataatatgactgcttatcgacaagaggtacgcaagttagaagacaaattcgatggactcgagctcacccatgtcctccgacataacaatgaggcagccgacagactgccaattttggttcaaaacgggaagcagctccttcagatgtgttcgtcgaacatctttacgaaccgatcgtgcccagaaaagagacaattgaagctacggatactcaaggcgtaagcatgatcgaagctgactggagagaaccgtttataaaatttttgagcaaacaagaactccctcaagacaaaaatgaagccgagcggatttccaggcgcagcagactttacattattcatgagggtgagttgtacaagaaaagtccatcaggaatactgcagcgctgtgtgtctttggaagaagggagacagttgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattctttgccggacaaactcatttgccagctcaagagttgcaaaccatcccgttgtcctggccgtttgcggtctggggacttgacatggtcggcccgtttaaaagggcagtcggcggttacacgcatctctttgtggctattgacaaattctccaagtggattgaggctaaaccggtcatcacgatcacagtagataaagctagagattttttcatcaacattgtgcatcggtttggggtacctaatcggatcatcactgataatggcactcaattcactggcagagcatttaaagacttttgtgaagacttcggcattaaaatttgttacgcctccgtggcacaccctatgagtaacggacaagtcgagcgcgctaacggcatgatacttcaagggatcaaagcacgagtttgcgaccgactacgtccctatgctggcaagtgggtagatcagctgccgtccgtactttggtctttacgcactactcctagtcgggctaccggccagtcaccgttctttttggtttacggtgcagaagcaatgttgccaagtgaagtggaatttgaatcactacaatttcggaacttcaacgaggagggctatgaagagggccgagtagacgacatcaatcgactagaagaagcccgagaagcagctttaattcagtcgactcgatatttgcaagggttgcgccattatcataatcggaatgttcgatcgcgagcctttttagtcggtgacctggctctgaggaaaattcaaacaacacaggaccagcataaattatctcccttatgggaaggaccgttcataattgctgaagtcactcggccgggttcttatcgactcaagcgcgaagacggtactctcatcaacaattcttggaatattgaacaccttcgtcgattttacgcttaggcatttcatttgtatctttcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgtgggttttaggctcaacaaggtttgacaaaaacttttaagaaatcaggaactaagttaagatatcaagcacaacataaattcatcagtattgtacaaattgtgtctccatcatcattaatcatcaaaatcattggtacattaatcagtattagtcttttcatcatcagaattatcaggaccagtcggtcgaagatcggtgtcctgaaatctctcaactacatcaactgctatcttatcagcagatttttgtgcatcgctgatgaggtcaagagcagctccttcgctcgtcccgtctgcaaagtcatcaacggcatcaacgtcaaccctcggataaagagttttggtcaccgcgaacaccagacttgctcccatacttccagcttctttgatgctcttgaaatatgtatccggagcaactctcagcttgtcgaaaatttcagaagcatcaagtgcactcgggccgttgttattgaagaacatcgcttgaacaattggggcagcagcgttagcaaccttatcccgagctccttcaacttttttgatcttgccaaccaggacgtcgaattgagcttgagatttcatcttg

SEQ ID NO: 9334 - DNA, 867 bp, Oryza sativa
tgatcggagctaatcgacttttgatgaagtgccgagtgatctgttctccctgcaagaatcttgagggtcgggaatcccccggaagaatcttgaggttggaagagaaaatccgccatagaagaaatgagcaaataccacgatttcgtgtgtgtcgagggtcgggaatgcttcgctgaacgccggtcgccacccgataatctccttcgctgggagaacaccgtgcgcctccatctccttcagattatcttctatcacatcggagggcgcccactaactctcgaagctttctctttcttccgccatgaatgtgaacaggatggtttaatttggtccgagatatggctggagaggaatggggaatcggagcggtggacgcggggagaaattttgtgaagtttttgagggtgggttggagcagattgatgaaccctagcttcgtcggcgcggttctgtactgtagcacggagtggggaatggcgagagtctcggcggggaagacgaaatgacgtttggacttcggtgtttttagggtatcgggagtactaatgggcctgggcctgtatagtacttcagcccaattatgttttcagcgtggcccgttgtgatccctagggacttaggcgctttttgctttggcaatatgtgctcacaaagatgcggctcgatgctgttaaaatcctttttaacgcgattcaataattctttggaattattatgatgcacatgaaaaggtgcccgacagaaaggtgttataccatttttgtaagcttttttaggctacaaaagctgttaggttaatttgagatgactggtttattagtagtcattctcctagtgcttattttgattatggtaagggttataggg

SEQ ID NO: 9335 - DNA, 3645 bp, Oryza sativa
aatcacatagtcgggggctacacctaattaggtgcatctactcgatgcaccatgttttattttcgcccttcacagtcttttagcactcggcaagcctgagcaagttgaattgaagcactcggattattttttttttgtttcgagaagactatttttgtcaactgcgaaggtctcgggggctactgtggagattatggttgccccatatctgcatgacagttatactttagtcagatatacggtaccaaatatacatagaatatctttatgaggactcgagttagtttttaacttgtatgtcaaggaaatacccggggtcctagtcggttacgattgtattttatctataatcccatattccgttaggatatggactgtattttgtaaagcggattccttcccctatataaggagggtccgtgtgcctcttggggtgcgtttttcttttttccagtatatacaatcaataacacactcggcggaatcatccccggacaggagtagggtattacttcttgaataagaaggcctaaacctgtataaaattccttgtctccaaacccatccactttcctagcttgatagccacccccttttattattgccgaaatcttgtttcgacacaatccttcatctcgacataacttggtgagttcttccgtttcaacaatctacatactacctagattccattttagcaatccctttgcactatcatgccaccctctgagctgccgacgtgagcacggccgccgcctatggagacgctcgtcggcaactattctcagcaccttgccaaaggtcggcaagctgccggaatccctctagacacctcgtaaatgctctagaacccctcccctagccatgtctaactcatattacttcgatcaccaacacggcctaaccgtgccaccgctgccctagccgccaacccatccacatatcaaattaatccctccgccgccgctcgccgtcgccggagatccctagctccctccccttctcggccgcaaccaatttctccctctagcaccgccgtaatcccaaaccctagtgccgccggcccgatttggggaatggccgaaggtagaagaagagaagagagagagactgacaggtgggacccgcacacagtaacatttcacttttattttattttcaaactttagaagcccatatcttttaaaatatagatccaaatccagtgaaacttggaccaatattcttctaaaatcattctctatcttttgagcccctttttgctctttttgcattttattttattttctctatttttcatatttttggattttatttaaattccttttaaatttgaattttatatatgtctaaccctaggtcttgaggattcttctgactccatagataatatcaatcaatctcaggacatcgagcaaggcaagttaccatatacctattgatcatttaagcctatattttacaaattatttatttatagccttctattcaatactctattttatatgcacaattcaaccatagaaacccacataatttagtattgcttactttgcttacaatctggttaaaataccttatacttagattgggacagtacgtaagatttggttgatttccgggtggctagtactgtctcgatcgatataagttttaccaggtacttatgtcgaacaaacgggtacgaccgcagattctagaatggggacagacctagttattatgttaattagcaatatggcacctctatatagtggttcttatttttaagtcctcgcgcaggaggcaactatagccgcgaagggcaactttagccattaccatgtataggtaaatggtttgtgatactcgagtataaactatatggtatatttctaaaccctgatcgagatgacgtggtgtcatacgatcagttccccttaaatatctcgggaacgccagaactcctcttgctgctgttaacaatacgttcagagcataagaggatataagttcatggaacaggtgccataattgttaatgacttaatactaggccatgactaaagctgatgattatcagcaagtcgtggactgcgggtaaagcgtacatctgctgcagtagaatatctttgaaattattcgaatagccgtactcatggagttgagtaccgggactcatatggtaccctggttagaaatctaaagtctatacattttacaaattcttgctataactcttctagattgtttattactgctttttgcaaagaaccctactatatgtcaatgcataacatatttccatgataacttgctgagtgttgtaaatactcacccttgctcttataacccctttttcagatctaggtcaagaggaggacccttatgactattactacgatgaccccgataacttagagaatccctaaaggttatacctcactagtcagaatgtatagaaacttccgctgtgtattaaatagttaggtgagtacctattattgtaaaacccttagtattgtaaaactttaacgtatgcaatgaagaaccagttatattgtatgtatcaatatctactgatccagggattgatacattaattctagtcggatccaagttgttagttttgggacccgacaatagcccatgtcaaaggctaactctcggaccttatacaaccgaagcatctcaaaagggagtgggattttggctatatgtacatggtagaccataatcagagaatttcttggtgcctttttaagcatgtgcgcttgaatcaaatgctattcagttatcatgcttcgatgtgtaggaatgtattgtacaacatgagcactatgaagcaggcaaagagtatcagtaagtccagtgataatagaggtacaatcaataggccctactctactaaaaacaccttaccattgagctaacatgggcacaactggagaaacatgaattttatggaccatagcataaagcaacgtagctcatcatttcttataggcctaatattagatctaggaaacaagaacatgcctattcaatggtgcagaaaacacaaggtaggattatggatctcattcagtctagggtagccatagtcatcatggccagttatagcttcccaaaactcaactttaaccatgtgtagcttgttctaagttaagatagcatctcacatcaaaacaaagaactacactcacttgaccccaagtaagagtatactcttgcttaaacatccggaatgtaacttccttttgatatgtttacacagagcataaaaactctatggtaagaagtctacactcaaattcttgaacacggcaaaaacctagccaccccacaacattaaaaacagtatcgaacttagaatccatacctgccttggagaggagattcagatcatatacctctgtgtgctcgaagactcgctcttagatggatatgtacttattgtactccttgttgtggaacttgagttgcatctctggatccaccatacatgtggagttggctcacgtatgacgtagcatagtccatcatttgaaacctcatcatgagaggaggttcctccttgagagcaaccatgacaataacaggagtgccttgatgagctcttgattgtggcctctcgcaccttcttggatatcttgttgaatgggtt

SEQ ID NO: 9336 - DNA, 811 bp, Oryza sativa
ccaactaatccgaagaagaaaacctccagtcgtcctttgccaaaaatcagaaagtcttccaggtacaaatcatttggccatcttccttgtcttgcagcttaccctctgttgaaataatactaacagcataactcaaactcgtaggaagccgtctgacatagaaccttctgaaaaagaccccgagccggctgacatagaggcaaacccttcaaaagaaaccgggccaactgcagaggatcgtccgagtgacaaacaaccggcaaccgacaatgtagaacccagcaacgagcccccgactgggaaccagtcggccgaagctgaagtcggtgctaaccaggagtccccgactggaaaccagtcggatgcagggccaaaccaaaagattcccgaggttgaagctcaaacgaacagtcctctcgggaaggatgctgacagtgaatcagaaaccagatctcctgtgaagacaccaaagtccactcgtccccgaccgggaatcatcacaggtagacacgctatctgaaatcattttgatccaacagactttatttggctgcttcatcttcattcatggatacactagggccaataattggtgatgaagaagaaatcctccggatacaagtagctgaggattcatgccctccgattctggtcaagtggtgggatgacaacatgcagcctcaagggatcgtgataaataagcaaaaagaggatgaagagttatgcctactgaagaaggcacttggtcaggcaacccgcattgtaaatgtaagccctctggtacctgatctcaaccatcttgtttgccatt

SEQ ID NO: 9337 - DNA, 7741 bp, Oryza sativa
  unsure (1)..(7741): unsure at all n locations
nnnnnnnnnnnnnnnnnnnnnnnnnnnnnnnnnnnnnnnnnnnnnnnnnnnncaagtggtcctattgctgcttcacctaaaggcgagcaacggatggtccgataagagcttcactgagttgctagagctcttgaaagaaattctcctatggacaacatctagccagaatcgacatacaagccaaaaaagttatatgtcccctttggtcttgacatacagaaaattcatgcttgtctaattgattgcattctttaccggtatgcaaggcttctagctataagtggggagacggggatgatgagggtggaaataagaaaagagtgccggtgaaggtcgttcggtattttccaatcatctcctgtttggaacgtatgtatgcaaacaaaaagcatgccaagctgatgcgttggcaccacaaagagtgtaaaaaagatggaatgatacgacatccagctgatgggtctcagtgaagaaagatagacaagaagtaccaaagttttctcacgacatcagaaatgtgaggattgcactaagcactgatggcatgaacccatcttgtaacatgagcagtcgtcatagcacatggccagtggttgttattatctacaacctcccttctgggctctgtttgaagcataagtacatcatgatgctacttctgattcaagggcctaaacaacctggcaacgatatcgatgtgtacttcaagccgctggtagaggatcttcatacactatggacggaaggcgtgcagatgtgggatacgtacaaacaagaacacttcacatgtcgggctattttgttagggacaataacagactacccagcacttggaaacacgtcgggccaaatggtgaagggcatgaaagcatgtgtatggtgcatggcccaaacaggaggcaagtgactgaatcatagtcggaaaaccgtgtacatgcgtcatgggaggttcctcaggcgggatcacccacaccaccaaaataaaaaagcttttgatgggacggtggaaatagatggacgtccaatttttagaaccggaagtgagatcttggcggaggtgaagatccacatcgagcggtgagacccctctattcaaaaagaagtctatcttttgggacttgccgtattggaaagacttggatattcgtcatgcgatcaatgtgatgcacgtggagaagaacgtgtgtgaaggcgtgctcggggtattgttgaacacacctggcaagatgaaggacactttgcaagcacggaaagatcttggaagacatggacatcaggaaagagctgcatcctcaagacagaggaaatggctgctactacctacctccggcatgctacactcttagtgctacagaaaaaacgagtatgtgggaatgcctgcggggtgtaaaagtcccatccggttactgtgcgaacattaagagacttgttagcatgaaagataagaggttggttggaatgttcttaagcttcacatgactgccatgttcttatgtcgcagctgctaccggtcgcaattagaggtatccttctagaaaagatccgagacccaatcatcaagttatgccagtttttcaaagcgataaaccaaaaggttatcgatccggcttcattgggcatgcttcaggaggacacgattctcaatctttgtcagctagatatgttgttccctctctctttcttcgatatcatggtgcatctgattgttcatcttgtggaacaagtaaagatcttaggtacagcatatctggatagcatgtgggctttcgagaggtttatgggtatcataaagaaatatgtcaggaacagatcgatacccgaaggcagcatcatcgagggttatgcaacagaggaggtggtcgaattctgtatagattacatggatctacaacctatcggtgttcccgtgccccgtcacgagggcaggatgcttggaaagggaatattaggtcataggagaattgtcgcccccaatcgacaaaccataagacatgcccattttgcagtgttacgacaatcagctttggtggctccgtacatggacatgcacttggatgttctccgtagagacaatcccaggaaaggcgcagcatggctcgcgaagatgcataaacttcaatttgggaaatggttgatggagtacctaacaactgcagacatcgatggtgcccatttttctttatctcggtggccatccaacacaatccacatgtaccagggctatgatatgaatgggtataccttttataccaagtcccaggacaacaagagtataaatcaaaacagtggtgtgcgcatcgacgcctacgatgatggtggcaacaagcagacttaatacggtttcatagagtcaatatgggagttagattacggagccctcaaagtccctctattccaatgcaagtgggtcaaaattccaagggggttgaagattgacaagcatggaacgatcatcgttgacctcaatgatgttggctacgaagatgaaccattcgtgctcgcaaaatccgttaagcagatattctatgtcaaggacccatcactcatgaagccacatcatgttgtactcgaagacaagcaaagtattgtcggaatggagatatcatcgacgaagatgactacgatcaacccgatgagccaccgacacccacaactgatgtcgagactgaaaacgaggcaagcgctaaagagaatgaccaaggcttgtatgtatgatccgatcatgcgaaagggatagtagttagggtgtgaattaatttctaacttcattgtatggatttgtatggcaacttcattgtacggatttgtatggcaactgtttgatttaaatcaacaaaatttggaaatatattatgtgcactctaatatttaatttctattttggtcctttatactcttttttggaacatattaagtaataggcctattttctagtgaaacataaatttatgaaagaaattataatttataattaatacatataaagttacatttatataacatgcttatctctactattataaaaattagaacctattatagtcaaaggttccggatttagtgttagaaccaacacctatctcctttacttaaataccctcacttatccctttactctctcacccttatccattcactctctccttctcaccctcggcggtggcagtggcgggggctgtggcggcgaacctcaccctcggcggcgcggcgccctccaggtacggcggcgaggaggcagtgggtgtggtgcggcggtgtgtggcggcggcaatacagtggcgaggagggctcgacggagcgcggcggtgcggcggctcgacgcggcgatgaggagggctgaacggcgtgcggcagcgaggaggaggtgagcggcggcggtggcatatccatcccaacggtacctgcatcctcctccttctcttcttcttcttcctcgtcgttgtcttgccgcaaccacgcctccacgccctcctcttgctgctactgctactcctgttgtcgtcgttgtcttgtcgtttcttgcggttgttgggggaggggatgcgagggaagggagggggcggacgctagaggagaggagaaaggcgacgaggaggaagaggagggttcttgcggtggagatgaccggcgagaggaggccagcagcggtgggtgccctggaaaaggatatataagggagagcggacggtgtattggtatgagaaggaaggatatggagagattgcagcgggggaggcggctgacggcgaggagtggctaggaggaggaggtcgcgctggcggtggcggtagatgaagcagagagagaaaaggaggggaacttgaagtacctggaggtgtggcgctgcaagttcagcgataagctcttcatgctgtaaccgccgctagccagcgtctcgctgccagtgacccacgtaggatggcgcggcggcggaggcggcggcggcgccagccatggcatgcatgcatgtcgatcagtagcatagttttgacttttgaaaggggtatagtagtgtaaaagaggggtagaaagtaattaattaaagttaatggttattttgtgatgattataactatttaattaatcaactaggtcgatcttaatcttaagatggtgtactgagttgatgatgctggtaatgtctgtaaatgtggaatttaagatctggattttaccgtgtatgttcttcttttgatttatctgctttccctttttcgactagttcttttgcttaggtaaattttcattttgcattcttcagttgtagcggttgactaatggctgagatgcgactttatttcattttcatcagattttacatggtttcttaataaaaaaattgcttgacgaaactcagctctactccaaagaaatatgcaaaattttcacatgatttatggtcggatcgagtattcaagttcagcttatttgtataatgttcttgcagcggcagcagtgaagaggggcagcggtgtgcggcggcaaggcggaggtggaggcagcaacgatggcccaatgccgaggtacacccctcctccccccatccatcctcttcttcttcttccctcctccacttaggaaaatttgctcatgtgtgtgatggatttgtcccttactgtcatgggtgacggatgtgtgaatgtgtgtgatggatttgtgaaatatgttttgttaatggagtagtatagatttaagcttcacataaatatatttgtaaaatgccattgtatcattgataataatgctctattggtaatcacagtaaagtatccacattgtgcttgtcatcataattcgtcactagcatgctaggatatatagaaaaatggcaagtctagcatggtaaaccaagtggcatctgtggacggctattaagtacaaaattctcgctgtcaatacctgcataaaaccataaaagtaaaacatccaatatagtggtaggatttatttctaaccatttccacgagtgttagtgtatatttgtatgcaggatgcaacccaccaaagttgagatgaaatgtacatgaaggatgagaatataacttccatatccaagccatagagttttgagcccacaaacccaataagatacatttatcttgagccaaacttcagtagaacatatagtgggacccacatgtcagaacaccagagaaggagctaggctggatgggccagccagggttcggctgaaccagcagctagcccaaccagcacaatattttaccaactgatagttatcctcatcctatgacggttaggagcgttaatactggtggaaaccgtcatcaagaggacacatggcaaaaggagaagttaagaagatgctcttaggattctatgttgaatatttcacagtatctccactctctcaactcacctccacactataaatacccctgtcctctccctcattcacacacacttgaagcatgagctgaattacaagaggctctagtgtactttattgtatattagaatagagagagagtaatgtagaagaagttgtcgatgcaaattaattctcttcttaccttttttatcttgttaattactctgcattaattgaatatcattataagtaattaaaatttactctgtgagaattatctcttggttagttcctaattagcgtgcgggatcatcgttcactatagtctattataatatagattactttagtgagttataaacactacagtagctattaattgcttagatgcggtgtctaagtagttgatttatggtgtttgctccgtatcccacagtaggtgtaaggtgggtgtagaggtgggtgtaagtcctccctgtccgggtacgtaatagagcgatatctgggagcagcaagctggccagtgcccgaagtatcgcgttaggattaagttaagctttccgtagacattgtttctcaccggtgaatcctctctatcctttgcctatcattagcttcgtgtccttggacaaacctggtaaagagctgacacacacgttccctgtggaaatcaatacctgagaatactcctggctgaagtgctacatcagtattttccgtgcgcttgcggattttatttgtaaagttaagaaataccaacagcatccaagataaatggtaaatgcaactgttagcactatcctgatcctaatttcttatatactttaatcgaaaataaaatttctgaacacccataacttgctgcactggacctaggcttcaagatcacctctacagggtatttatgttgctcattaagtaactaattatatatttttagtgtctaataacaccgaaccagctgtttggattacccagttgtataaaccatgattacccatacatgtgaacattttacaactatagaatatggaagttgtatgaggatgtaattatgtgtgtgaatgtatgatggatttgtgcatgtgtgtgatggatttgtcccttactgtcatgggtgatggatttagacatgccacaatgtgttggaaaatctgcagtatggcactaagacacattggcacatatatggcacactaagaccaaatatgtgcttgttgcacttgttactccatttccaatgtctaaggacatttcagtcatgttactgtatattttgtgctgctactgctgctgctgctaaaatatattttgtgttgctgctgctgctgatatatttggtactttcctatatcagtttatttccacaatccatcattgggttgaaatgtacttttctactttcctgctgctgttgatatatttatgcattgcccatgtgaatataacttgttgctcgatgatgaaattcatatggtgggagattatgtgtggaagtatttcatttatttgtgtgatttgtgaattgtgctgggttagggtataaaaccggcacctatctcctactacttaattactcggcctgccacctacccactggccacttcaccctctctctcttatccacacactctccctcactctcttttggtcactatttttgaattgccctttattctcgtctctgtttatactgccacacataatcgatgacgacctagtacaccatggcatggaggccattaagttggcaacctgccatctgagagcaaatatgttcctgttttgtgcttgtaacagttctgagagcacaaaatatcttacacctttagaccatgttatttttcaacattagtaatgttattatgcttgatgatgactagacggaacacaaagaatttgccagctccagatctgagggtgaacatcatgccagccctagcacgttcttaaacttaaatcaagagcattccgaaggcggagaggtgatttcgacgtatatttcacgcaatagtgcattagcaaattccgactctaatggaccattcgaactaatcaaatttgcaatttccaaggaggttgacacttccactggcagttcaggccagaattcaactgtctcatctagcctaggggtcctagcttgatgccggatggtcactacgttgtgacagtgctcatgaaactgggtggccacacgtaccatcgacggtgatgaccccctatggtagggcgtgtggatgtatcgtcaaggatttcattcccatcaagtacagacattggaatgaaatgatgtaacacaactcgactggatggtacctgaaggaagaatgctggcgaaagttgaagttgtcattcacctttccagaaggccaagaagagctagcaaagaagggagccctatcaaag

SEQ ID NO: 9338 - DNA, 844 bp, Oryza sativa
gggttgaagtggaagacgtgccaagccagtatagatgttatgtgctacaatttcctctagaggaaggggttgacactctgagcgctgctcttcacaacctgatcgtatggcccaaacgctacatcgttatcacaaacgatggggcaggggatccaagcgccgatgattccagcctttcaaacggacgaggtcattcttcgcctcgacagaggtcccctagtctacctcctcgtcagaagaccccaaatcaaccacaaccttcgcagaagtctccgagtacaggcccaattaggaaaaagaccccaacaccaagtgcgtcgcaaatgtctggttcatcaagcatggagcgactcccacattccaagtcgaaattagtgccaaatccgacaacttcgctaccgaaaaaggtgagcggtagcatcacttcgcttcttggccccaagaagcctgaggaacgaaagattccaattcctaagaaagtgatcgagcatttcatcaaatgcgcacagccaaggctacctccaaaacctatatcggacttccgtagaacacttgagaaaagtgaaatgcagtctcgatctagggagttgttccttgacaagaaagcgtctgatgaggctgctttctgtaagtcagtcgatttgaaaagcctagacgatattgataaccttgacaaggctgaggtggtactcagttccaacatggatgacccatggtgctcgactcagaaattgaatggttaggaactcaagcgcattggctgcatcaatggtatttggaggaggccgcaaagggtcatgaaatgatcggtgcctactacaccgacattgattttcaccatgac

SEQ ID NO: 9339 - DNA, 714 bp, Oryza sativa
tcatctgactgacagtagaatagaagtttacccaatcattttcatctatgtccgtaaaatattcacgaacaatcaatgtcctctccattttgaactttgcatgtgctattgatccgcagctgctatctccattgatgtacaaaatagaagaaaagtatgatctgatccgctcatcattgcagacatggctgatcaaggatttctttcctaccctgcaaccaccaatgattggaagaacaagacgagcaccctggttacctggattttgcaataaaaaattgataatttcctgcttctcgacatgatgagcaaacacacaattatcggtgtaaaggtaagcatcatagggtcggcgacacatgcattcacatctggctaggaatacaacaaactctttcactctacctccatctgaagtatttatgtgttttttgtgcagctctctaaaaagcttgcttcccatctcagaacagccacccttatatatacttagctggaaatggttcagagcaaaaccagcagccattttatccacagctgttttcaagggatgagaaaagtgactgcaatttgccaagtttaaagttctctattcaatactattggtcgttgattgctttgaatatctgttccttaattttttaccatcacacactttcttgtatgaaatattaattaactggactatttgaagaaactagtatttttcttgct

SEQ ID NO: 9340 - DNA, 5970 bp, Oryza sativa
ttcgattcatacctacacctcttaacaaaacaactcaaaatttaactttatttcacaatccaatattacatacctaactaattatatgtttggatgccatatacctagaattaatcaaaatctaacaaaaacatgtttaaactaagttcaaacttgttttgaactagttagaaaagtagttaatgttaatacctaaatatttaaaaaaatttcatactcatttgaattgagtatatactcaatttgaaccatggagctcgggcaccatggagcaccaaacaaatatatatatatatatatatatatatatatatatatatatatatatatatatatatatatatatatatatatatatatatatatatatatatatatatatatatatatatatatatatacatatacatacacatatatatatatatatatatacacatacatacatacatacatatatatatatatatatatatatatacatacatatatatatatatatatatatatatacatatatatatatatatatacatatatatacctatatatatatatatatatatatatatatatatacatatatacacatatatagatatatatacatatatatatatatatatatatatatatacatatatatacctatatacatatatatacatatatatatatatatatatatatatatatatatatatatatacatacatatatatgagttggatttttggcacgcgagttcacatgtacccacaatctacaccctatatgtagcttgcacgaatcttagggcaaatatattaggtgctaacaaaatgtaacatgcatgatgtttacgttatactatattttttacaagtgtaaaatacgttgtttatgtaatttttgtatttcttgtatgcaaaacttgtttatgtaatttaccttgtttatataaattaccatgtttatgtagtttttgatggtaggatatatatcattttgtaagtatcatttttgcaagatgacaatttggtgatatagtagatatattgttttctcattttcactaaatatcatgttataaacaaaataagggttagagaaatacaatgcactagatatataaatgtcatacatatgattattattgaaaaaaattatttggtaaaaaatacaacatacatgttatacatattgtgaaccaacctaatcctaatcttttctccctatagtaatcattcatttggttaaggttaggtacattttgcagcacgaatcttggaacacatcaacggtgtagattgtaggtacatgtgaacccgagtgcaaatatgcattttcctatatatatatatatatatatatatatatatatatatatatatatatatatatatatatatatatatatatatatatatatatatatatagggatgcgctaaaccgcgcctggggtgcgcaataactaaactactcctctcacagcactcctccccacccaccaccccccctggtgcccaggaggctctcccgcacctttttctctccctcaccatttgtccttcagtaaataaattacttgcagttaatatcttcttattagtaaatgaattactaactaatatattgatttttgcattgtaatcccgcaccttttggcatgtccattccaactgcaacccgcacatttctcttgcacacgtagtaaataaattactctctgttaatatcatttattagtaaataaattactcggaatccaactcatttcttctctcagtaaatggattactcccaggttgtagcccttctcagttggttcattctctcagtaaatgaattactgtcgggttggtcttatttattctcttagtaaataaattacttaagataatacaacacttaattggatatcataccttctcgcagtaaataaattacttaaaataacgtattgatatcgtctcaagattttcttagtaaataaattactattacaccaatctcaacataacatattgacattgccaacaaattctcttagtaaccaagttactattacaccgatggttctcaacatatgtctctcagtaactaaattactattacatgcacgaatccaacaagcaagacaacgctagtgcctcatatcgatgttgagccgacaaagcactatagattccttaggtctccccatcgataggtatccatcacccacgaacatctagagaggcatcccacatgcacctggatatagacagaaacgattacatcatctaagagaagtctttaatttacactcataaatgactctaaatgagatatgattcgctgaagaagaaataaaatgcttcataaaaaattgagcagcaggaagagagaatatgtgcaaaatgcagcctccatctgaagaacataaatcgagtagaataaattttagaactgatgagtctatactgctttatttacaggaatacactccattagactgatcatagatttcagatgttcacatgcatgttaaattaagaaccaaaattctaattgacacattatcagttcgccaagataaatccagaaaaagtgtgcaaagtgtacgacatgaaacatttagagcgtccaagtcaaatgaaccaaggatcctatatcttcagagatcacccggatatcattgaggtcaagagaaaagttcaatttggcagtcagtaaagatctgtttctagggaacatattattatgcataaaaatgatactaatcaaatagactcgtcctaaatttttcacgataccaatgcccaaataagctaaaatgatatggaaattattcatggatgaaaactcccttggtgtccttgatccgcacctgcggaactagtgaaggacatgccatgtgcacatgagcaattagaacaacaatctcaatcctctgaatatgaaaaaaaaaagcatacttaggcaacaaaaattattgtgtgcccagtagcaaaacacctgcaccaagaacagggatttgtgccaatagactgaacaataaaggtctcaatgtacatcgttgtcagtataatcctcatctgcattgatgctgcatccggattctcactctgcccctgcgaaaaaaagacatatcttgtcttttcatgtctagttataaacactaaactaaaacctgggaaaattgcaaccataaagcatagaagattgaatcgagaagaaaaaccaccatgaatctgaacaacgtggggaaaaaaggcctgatcaccgatcatgcaaacatgaaaaaacaaaaacgaaaaaaagagaaagggaatagatcagattggcatggcagcaccaaagacactattcctttcatgggggatgcagacttcaatcacgcagacgagttcggggttgttgatggtgtcgcttgtgaaggaacgcagatggcgccggccctcctcctcctttgcccgcaccaacaacttatgcaaatccaatccaaatgttgctactacacctcctcagcgtcctccacgggcggcggacgagggcagcgggcgtgggcgatggtggcgatctggaggccgcctgcggacaaaggcggaacggcggccgccgacgaggacgaaggatgttggctcctccgtatagctcgccaacgtggagcagatcggcagcggtggaagggaagccggtggagaccatgggcggaagaaaggcaggcgcccttcgtcgtggagcttgcctccagatccaggcggcgtgatggcctctccccggtgctgccttttctcgaatcgccgccggcaacctcctcgttctagatctgaaaaaagcaaaagaaattaacaaaaaaaaatgagtgtattaaatcctatatatataggaggaagtttagtagtaaaagaattactactgtatgggaaaggggaggaggtcgggggtacaggggaggggtggggtgggtaggggtgggttgtgccatctgtagtatagtatgtctatatatatatatatacacatatatatacatacatatatatatacacatatatatatatatatataggttcctactaccaggagtagttactccctccttttaacgggtcaggttagtggaaccatcttgatccaataaccggtagttaggttgtttttttaatttaaacaattaactaaattgtttattagttgaaattatttcttttttgttagttgcatgcaaacgaacttctgcattggaatttctgctacgtgctggtcaacagaagatacatgttagctagctaaactgaatttctgctcgtttggtgcatgcatatatttcccatgtatttaggaacgttaacgtgatgaaaaggcagaaaatatgtgaacgttgacacatttaaaatgcacggtctgtgaaacagaaaaggaacagagcattagttgagaaggaagcagaacattgtttggaaatgcggcagaacatcacttggaaaaaaaaatcccaaaccgaaaatggagcagaatatcgtttggaaatggagcagaacatcgtttggaaaaaaaaatacattctactcttcctagacaaactccatcttctgctcgtcccggcagaaaatgtatctaaactgaaaatggcagaacatcaaatgaaaaaaaaaatccaaggaggaaaataaacctcaactaaaatttggcagaacgtcaactggaaaaattccccaaatatcaagggcagaacctccctgggtaatacgtgattagttacaaacaacaattgcggcatgtgctccgtgatggccgagtccatctgaacttgtaaataggcaatatagttttattagctagtaggaaggacgaaagcttaacaaaaaaaaaaaaggtgcagaatatgttctgctggtgtaactgaatcccatcctcttataggaagctctatggcaagaatacaggcagaaagtttctgcttgggtaactgaatcccgttctcttataggaagctccctggcaagaatacaggcagaaagtttctgctcgggtagaaacaggaacgggaaaggaagcagtatgtgagtatgtgactcagaaaaggagcagaacatcggttagaaaggaagcagaaaaataatttgaacagaagcacaacatcttctgctccttcaacaaaatcgtcactaagcagatgacgttaaaaaaggcagaaaattaaaaaggaatagaagaacatcaattggaaagaagcagaacattatttgtaaacggaacagaacatcaattagaaaggagcagaacattatttggaaacggaacagaacatcaatttgaaagggagcaaaatggtttctgccaatcatagtgtccatgttctgctcctccggcagatgaactaacatgcattcgaaactgtttgtatcccacgaaaatagcggtcggcattctaaacgggttggataacatggctaattaactccgaaatagcagaaatttgcactgccacgtagcaaaccgtacggtggataagctggaagtagttactcccagtagtagcttataatattcatatatatatatatatatatatatatatataggcaacatatcctatgcacacaggccctcacgtgtacacacgtgcacaccaactaaaaaatgtcaccaaaaaatttagaaaaaatcatacacatactttcaattgtattacacctagggttaaaatcttaacatcaaattcattatattttagccgtaacaaaaaaaaaacaaaaaatctgacaattttaaggttgcaattttgtcagaattttatcttttttgttattctctatgtagaatgaatttgaagatgcgactttgcacgtagatgtaatactattgaaagtacatgtatgaattttcctagaattttttgtgataattttagttggtgtccacggtgtgtacacgcgagggcctgtgtgtataggatacgctcccatatatatatatatatatatagggctgcaggaat

SEQ ID NO: 9341 - DNA, 611 bp, Oryza sativa
tttcaatgataaaatggtagaacttcagaacctaccaccgtccctcacgtcactagaatttcattcttgtccgaagcttcagtctctatcagggcagctgcatgccctgaagtttttggatattaggtgctgcaataaactggagtcactgaattgtttgggagacctgccatcattagaaagactttgtcttgtgagctgcaaacgtctagcatccttagcatgtggtccagagagctactcatctctttcaactattgctattcgatattgcccagccatgaatatgaagccgctatatgaacgccttaggccacggttggatattcttaaggaaagagatttgtcacatgcccatgcaaaatgtccttatggaggtacctttccattgcttattccttcctttttgtttttttttccctacatactagtattgcatatccatatgttgcagagtatgcacttaaaaatttcaatcacctccccctctgttttatagtcaataatacaattacaaggttgtcaacagaatttccttatgtttcaacaaacacaggagccatggttaaatgttttcttcttctgttttcagatgcatgagcattatttcc

SEQ ID NO: 9342 - DNA, 668 bp, Oryza sativa
aattgccgcggaccaaatgacggaactgataccaagcgctaaatggagttaaagctatgattcgtagtagtaattaattatatcaagattcgtaataacattggaacttatgacattacctgtctataagttaaaaaacctggtcaaacgtagactcttttttatccattgagtcatatacattgactacgcaggcctccaagtcgaagagtaaaaagacccagtggaatctgcaatgtgcgtcggatgtgacatatgaaacacttagcatgtacgtacgggaatgaaatttggtagcaagctggtcagaaagttcattaatcgcaaggacaaaaagataaggcaataaaggacaaccttgacgaatacctccctcgatgagctgaaaagtacccgtacgattgaccatttataacaacagaaaaattagcggagttgatgcaggaaaggacaagacgaacgaaattagcatgaaaccctttacgacaaagagcatccgctatgaatctccattcaatcctgtcaaaagctttagacaagtctatttttaaaagaaaagctttttgattaaaagaggtgagattaaaagagtgagcaatttcctgggcaagcacaatattattagagatgcgtctccccttgacaaaagcctgctgagtgtcacaaat

SEQ ID NO: 9343 - DNA, 694 bp, Oryza sativa
tcgaattcctgcagccctatataaacaaacttcaaacatgtaaatcaggtgagcacttactaaagaattaatagactagagggtaacctgcaaatggaagtttcaactttcaaggttatgagaacaggtgactacaatccgaaagtgaagattataataagtcgtgcattttcatatatatgggcaaaaggaagaaactagtatcaaaaccacatgcatgcatgccatatatgtagaactaagactggaaagctttaaaacaataacagagtaggtgtagtagtgattaaaatttgagtttctcaacaggcaaaaagtacagcaaggtagtactactatcaagggaaggttgatcgaaagggaccttcttcaggatttcttgaatgaacatctgataactctctgatctcaagactatcaatccgctgcccgaggcgttcatacagaggcttcacatttatagctgggcagtatttaatcgtaatatcttgaagaagtgggtaacgaccatggcaccctgctactgattgcaagcgtctgcatccctcaagacggaggattcgtagtgacggaagatctcccaaacaatccaatgactccagtttattacagtgatcaataattaagcgcttgagtgcatccagctgtcctgagacggaacaaagcttctcacagccaaatattagtagcttct

SEQ ID NO: 9344 - DNA, 10651 bp, Oryza sativa
cccgtccgtagtgtcttgatccaacctgggggttttttcaacatgccggaaagctcaagggcaacaagatatcttgggggtgcggacatgttacccaaggagttgataaaattagattgaccttcctcattgatcgccaaagtctggagaccacagctgcaaagatactcaatagaagagcgtagttctgtcaagattttccttgtgcccggttcctctgggttgagcttgagcttgtaaatagtaagcttctttagacccgtcaattgatgaaggcctgctacagctgttgtctcatcgatcttgatcccagacagtatccggagtgctttcattccttccttctctttatcttgggtcaacatacttttgtgttgctgcttcttacttttttcttgaggcagcctcaaccctttccgtgggtttttgtttttactcccaccaagtattctgctgattagttttagctgctctacttctttcggcagctctttaacacgtgtttctcttatgtcaagagtttccaaatactcgagcttcacaatcgtcggcggaacatgggtaatatccgtccctcggaggctcaaatacttcagcacaaacatcttacaaatgtgtttcatatgcctgttcttgaatcccttcagtccttgaaaatccaggacttgtattattctgtcattgaaagcatggaatggaagctgggtgaggctcccgaaaacggtcagtgaccgaacttgtgacagattcatgccttttgttgaatctccatgcttggaactgctgctctgcatggaaagccgacggactttgttattactgggtgctatcatcatcagatgaccaccaaccacagtaataaaattctcttctcttgccttggtcacaatatagtcaagaaccatgtcatgaacttgaaaggtttttagtttcccgttgctgctgtgctccacaggacgtatcaactttcttcttaaaatatgattgaagtatgattccgcaacttcctccgccgtcagcccttgctttgcattgacaaaaccttcagcaatccatcgcctggacagacacttcctactaattttccaaccctttggaaatattgccaagtacagtaagcaggttctgagatatccaggcaaattattgtagcaacaatcaagtatccttgtaaccccatccaaattgagagaagtttcttgttcctgagccccagcagtaatagaaacctcttctggcaataatttgtgaagtccagcccagtaactctttggctggtcttggttgcacgccactagaccagccatggtaactatggccaaaggctgacccccacaccttttccataaatcaccagggacattgttctgtaccttgtgtctatctttggtgcttttggattcagaaacacttcggttgaatagctccttggaatcacgaggactgaggaaactaatcggatacaatagatccttgttttctggccggcagcaggtcgaaccaaccgcttgaaatcttgaagtaactattattctactgcgctctttattatcagttagcaacaaataatctgatattgttttccatgtttttgcagaccatatgtcgtcaaccaggattatatacctggcaacaaaaagaagacgacaatgtgaggtagacgaagagtccatcatccagtaacaagcttataaattgaaaactacaaacatacataatgtgccaccacgtacacaaaataataaggaataaagcaaatgatttaaactaggaaggtagcccgcgtgaatgcgcagacatgcatcacatggtaagtttgagatacttataagagcgaaatattaaccggagaacatctaccatgatttctctgtaaattgttttcatcagcattaattgcttttataattttctaacctctgaactttatattatatcatatttaagtaatatctatgagcaattatttataatcgtcttcatcatttgaaaagaaggtagatttattttctttagaaaacatgccaatgaaaagtaagtgtaaagtaaaactaaggtatttttctttattttaattgcatatatattatcatggtttattcgaggatgaattgggtgggacaggaagctccactaaaagtatggatcaatttatatagcctaatatgattgatgtagtttgagaaactactacaaaacttcaaatagatgttgacactataggtgctagaaatattacaaccggcacctataaaacttttcccaactctgcggagtgacaaaatagaaaacccacaccttttagtaactacatgtgccggttctaaagaaaaccggcacctatatcataagtgctggttttttaaactaaaacggtacctacatagaggttaaaagtgccggtttataaaataaccggaactttaatagagacgagcgaggattttttttttctagtccttatcttctcccgcacctcccaccaccgctcattctctgtctcgcctttcccctcacctttcccctcctcctcctcccatttcccctcacctccttctctacctcctccaccggcagcgacagtgtgggaaggccactggccacctcctcctctcgttccttcccaccagccaccggcgctcgcgggtggccagatccggcgccgctgctcctcccctccgtcccaccccttcccattagcgctcagagcggctagatccggcacgcccgcccccccccccaccccactggtgctagggggtggctagatccggcacccccaccacaccggcgctcatcggcggccagatccggcaccgctgctcctcctctccgtcccacccccttcccatcggcactcggagcgggcagatctggcacccccccaccacaccggtgctcaagggcggccagatccggcgcagccgctccaactctccatcccaccctcatcccatcagcgctccaggcagccaaatccggcgccgccctgaccaccggagcttgggggcggccagatccgacggtggtggtggaggaggccgggtgtagtggacgttggcggaggtggaggctgggcgtggcaggaggcccccacgaaggtgcagtgggctgcctccttgattgatttttgattttgtggtgtttttgaatgtgttgttggatggcgagcaacagaaatgtgttgttgttgttgttgattcactactgtctctttttgttgttgttgggtggatggtgagattgtgagaaatgttgttgttgatgttgatggatgtgttcttggatttgggtgatggggagttgcacgatgcacaatatttttatatttacacaaaaaaattgaataagacaaatggtcaaacgttggttaaaaagccaacgacgttatacattaaaatacggagggaagtacgtatgtatacatacaactattcacgggattttttttattcggggaggttacatgggatgtattttaaataaatctaatctaatggtttaaaaatagcgggatccgccaccgccgtcgtctcctgttcgggatccgcgccagccgtcctccgccgccttgtcgctcgccttcgccaggcgcgcgacggcgcagacgctccgggcgcagctcctgccgtcggcggcttggcgagttcctgacttcatcgcggccccactgctgcggcggcggcgggtaggaaccaccgaggctgacgaggccgtgcagactgcgactgaggtgagaggggcttgcttccccatccccctcggagggtgatttgtgcattttgttgcacaccacatgtttttttgttgcacatagtgtgtccatgatgttgcaatccgtatttttctggatgtttcttaaatcaatactggatgttgcatttggtctcttcgggatgttgcatatattggttttttgttgttgcagacaatgttttttagtgttgcattcgattgaaacatgttcgataatgcagtgaaacatcttcgataaagcagtgaaacattcctcaaagataaaacatcaagaaacaattcgtgttgaaacattttttttgagcaatgaaacattgcaacattcattcaacatactgtgaacatcgtctgggagatttcacgttgaaacattttttttcgagcgatgaaacattgcaacattatttaatatacagtgaaacattgtccagagatttgcaaatctccggacgtccgatccgtagctttccccctatttttttcttccggctaacagtaggaagctttatttgattttttttcgattgtattaacgtacatatatttatgttctctttccttttcccagccaccagttaaatatgttatttggagaaaaaactatcacctttttaataatagatctaatctaactgtctaaagtatcatgtccatcaatttaaataaaaatcgacggtgagattagatagtgccatgtggcggtctagaagtctttgtaggagcaccacgtggcggtttgagagctagcgtttgtagaaagtttaatgaacttttagtatatagatatagatatagatatagatagatggatggatggatgtacacacctctttttatccaggagcttctttatttggctttcgagtttgttgtcggtggtttctgtgcgctttagattggaggtctcctcaatactgcgagggctgctttgacggagacttcctgtgcgctgcacgtctcgcttcaatttgcttccaaagcgtgccagtgtcttgatattctcagaggttccagtcttgctgctgcattgctgcctgtaatctgggtctatttgcttgagaatatcattgagtacggcatcaaggtcatagttctgggacacagtaacccacgcccggcaatcaaattgatacatgactttcttgtacaatgccatggcaatggtggtcttccccacacccccaaatccaacaatggacacaacagcaggctcctgacaagcagtgccgtccacccactcctcaagatccttcatggccttctccatccctacaggctcattcataccaagctcatggcttgcgagctgatcctcagcaatgtcataagacgtcgcatcgggcgggcccttgcctttttgggtatttggattttccactccgtatcttatgcgtcggtcagcaatcagctgcgcccggaccttaagctcagcaatactggatgcaatctcacggcgaggcccgaacgtccagaggtcatacactagtgtgactatccaggggcagcattttgcatccaaggaatcgttggggaggcggtgagcaaagtcatctatgcagtcctcacagtcatatgccatgtcgcggatctgcttcatccagtgcttcttcctgttgtcagggtcttcccgggcgaggtcaagaaggaaggccttcatgctggcgagctcgtcactgatgtactggatgtcaccacggacgcccctgatcagatcatactcctgggcgagaaggttgcccagcttgcccaggagagagtccatggtggcagtcgaagcaccaaccaccaactccatcttcgtgttctttatgttcttcaatgcagtgtataaacagcaagcaaacacaaggtcagagtgaattgccaatgtacaggaccagctgaacatataaaaaagatcttaatcaaaatgtatgatgaatcacatcgggacgattgcgcgagctataaattatcggttttttttttttttggatccactggtaccaatagttagctagctaattattagcaaaggttgttctgatccatctcctaataggatgctaatagatggttgttgtcacctattagcagccatgaacctgctagtgaaactaatagttagcaatcgcctagcttgtagttactcagtcttacggctgaagtttgcaaactggtagatttagctgataccgttcttagcttgtcaagtaccaattcaagaacctatgcaaattatagcaatagctgtgctgaagtttttacacactaaaatgctaatacaatcttctttgaaatatcttctttcaggctcccttggtagtgcttgtgttctgggtgcagtttcttttctcgtcagtaacccaagaaactctgaagctggaactttggtttctgattcacttgataagataggagaaatattcctaattatcatacaagctgtgcagcagcttgacccaatatgatttgtgagatgaatcacctcctcttactcacatagacacactgaggaatgaaaaggccaacaaataaactagagaaacaggatgcaaaaaaagtatttctagttcaccgaagaaacactttcatgtatggagaaatattaatttcttgagaatctggaactatgccaagctcaagctcttcctgagtccaatctggcgaggaatagattgttcgacatcgagtaagcaaacctagcaatcaccgcggcttctagcgccaacaatttaggcaccagtagatgcggagaatatttcgaactagactagaatatccataactggattatcattgatacacagagtactcaataaataaaacaaactacccgacaacaactttagttcttgcttgcaaatacggaaagtaaaattaattccaatcacatagtacgtagtaccttgtaagttagctcaaggaaaatagttgttcaccggccggcaagagcatgagcgatcttgttagctggctcaacggggggggaagaacaaaggaaggcgctctcagtctcagatctcagtctcagatcgctcaagtgatagagaagcggaggggctccagttttgggtgcagaggagggacgcacctgcggcatgggctaattaatatacccaaatgtccattaacaaaaaataagcgttctcgaaatttgagtagctgttgtctcgctcctgttttgtttttattttatgaaacgttttggtcttcttctaagggcgtcaagtcaatggctagctcacacagtggccgtgtttagttgttttggtaaaaaaaattttaactatacggatacacatttaaagtattaaacttagactaataataaaataaattacagattccgtctgtaaaatgcgagacgaatctattaaatccaattaatccgtcattagcaaatatttactatagcaccatattgttaaatcatggtgtaattaggctcaaaagattcgtctcgcaatttacatgcaaactgtataattggtttttttgtctacatttaatactctacacatgtatccaaaatttaatgtaacggaaaagttgaaagtttaaagggaactgaacacagccaatatctatgagtacaactttggctgtgtttagttcatgctaaaaatgaaagtttggttgaaattggaacgatgcgacggaaaagttggaagtttgtatgtgtaggaaagttttgatgtgatggaaaaattagaagtttaatgaaaaacttcggatctaaacaccgcctttattacgggagtatctttcttccttccctctgccctcctttatgaacaaacccaccattggcctgtattttgagtgaggtaggtgtggagagaacagatactagacttttatctttctgtcttctctctcttccacgtaaacaacgtgttaaactcctgtaaaaaaaacatgttacactactcccttcgtacctatatttttgacgccgttgatcttttaaatatgtttgaccgttcatcttatttaaacacttttgtgaaatatataaaactatatgtatatataaaagtatatttaacaatgaatcaaatgataggaaaataattaataattacttaaatttttttaataagacgaacagtcaaatatgtttaaaaagtcaatggtatcaaatatttagggacggagagaatacattcctatgagttagctgaagtggcacagttgggatgcactaagctggtattcctagcatgctgtctgtgttgtcgcattgcttttaatataagcagagtaaactccttttttgaaaaaaaattaaacaaatatccattaataaccaacgaagccagtgccaaactggaagtccacaacactatacaaatcacatatgtattactatttctcacctctcttctaagttccaagctactttaattttatcactaagaaaaacttatctaagtttgatttagtttacggaaatatgcaccaacatctaggacaaaaaagataaatcctaaaaactttcacaaaatatacaaattttcaccataaattcagcgagctttaatcaatttttatactaacaagcattagatctaatagattttataaaaaaattacccatatctgtggttatgaaaaacagcacagagtaacactaaattttcatataaattactagtcatcttttctatttcgtaacacaaactaattaacctcttaaatttggatcaaaattacccattgataccattatcataaacaaactgaaatttactcccaaatgtacacctagtttgccaacctatgcacctaggactcccagttgtttttagataatgaaaaaatccggcttcagcttgtcgtcaatgccatagtgacagggggaaggggttgcttaactgatgccccataggacgctagctcatggtggcccttgcgacctcctcctcgagacacagtgttgggtgcagtgcctttacttgagctggtagtagtgtagtagtaggagccaaatctaaccattgatcctgatgggtacttaagaattttacttctacaccgtggaagggtattttcgttatttcagatgctcccaagaaggctagtgattcgctggttcccgttctttttgcgcgaacccacggccacggcggcaccgcccctcacctcaatgcgcggccgccgcccgctgcccctccttgcgtagtcgcgtgaacccacggccacgtacgacggcgccatccctccaccccctgtggccctgtgcaccgcagcaccgctttatttttgggatatgatggtgtatctgctctagggaaggtcgctttgtcgaaatgtgttcttgaatcactcaattgctatactgcaaaactaattactgaatcactgatgtttagctgatgatgtataatttaatcattttcgcattagcatcaggcaaatgagctaatgccgaagctcgtttatctgcagcagaactgagttgatggaccaagtactgagttctagactcaactgaaataaggttaaaaaagaaagctcaacgacttgcggttgcaagcacactctcactctattagcgtcattctaatcagctatccgaatctacaatttgactgacaaaaataactacaatcagatatgtgctaaaactgtgttagtgtcttcttataatcagctatttcaatctgcaatttgaccgacaaaaacaacaattgacaagaaattgaccaacaccagcatggctacgacggtcttgaacccttcatcggtttgatcaccttccggccttgtcttagattctgatatggatcatcccacttcaattaggtgttgctaaaccttgatgctacggttgaaacaggtgtactagcagagtccttttttttttttttgcgagagtactagcagagtcctttgacaggatctcatcatcagtaccaaattgacggcactgccaaacgcgtgaagtgcggcggcctccgtcgcgcacagcagcactgcaggtctgcagcatctcgcctcgcctccgttctccctctcgcatctcatttatcgacagaacgactctcctcgccatccccgcgtgctgcagttgtgaactgattgggcatattgacccgtggactagattacgaacttactcctaagccaattgcaaattcatcacaatgccatctattacatttctaacattacccctccacgaattatactacatctactaccaggtgtagtacgattgaatctaatccattagatcgaatcaaatggacgtctcacattcattttgaggtactttaaaaaaaatccttgggacaccttctcgcgtcgcggcatccttagccagtgctgccgaatgcattgaagatactgtttttacatggaaccggaggctgcgtgggatggagatttcgggaagaccttgctcagggcggcagggacttatcatgatgtgacatattttagtagagctttgaaaaattatacaagtcacatattttgtctatttgagtttaatttttctatgatgggttcctgtattctcctaagtgtgaaaaaaatatcaaaaaaaaaataaaaataaaaaaaactgcatctctctgtattgttcaacttatgacaattatttcatgtggttatattttgaattagagattaagtaatttcatatagtggtagagtgcattatgtttaacatgctgatcaaagggttttactaaaggaggtctaattttgatgaaggtgcaaagtaggctaagtggtatgctattttcgaatatctagctaagtggtatattccgtttgagtttaattttttttttgtggttggttgtatcgtgatcctaagtgcgaaaaaacatcaaaaaaataaaacatgaatagagaaacaggaatacaggaatggaggcgaggggtgggggggaggggggtt

SEQ ID NO: 9345 - DNA, 2529 bp, Oryza sativa
ctcctccctagggcggcgccagccatgttggcgccctcctcctgccacgtcggcgcgcgtgtgccacggtggcaggaggacggcgccagagaggctgacgctgtctcgttggacgacagcgccagccactctggcgccccaaaaaggaccatttctgggataagttttttcaggggtctatttgcgagataagtttttcaaaaggaccaaaatgtgaaaaatctagtcttctggagagtctagtatagcccttgtacctttcccttttcagtaagattctactttatttaatatactattcttttctctactttacttagtctttgtgcaacattatctttgtcattgtgctgttgtggtttctcttagttcatatagttgtatgccacacgaggatacaaacgcatgcctgcaacacttcatggaggggtatctcttagttcatatagttgtatgccacacggggatacaaacgcatgcctgcaacacttcatggaggtctgtggcaccttcaccatcaagggaatcatattggacgccatccgtcttcgccttttgccattctctttgctcaggagggcaaagcaattgttttgtgccaaccgtgaacctgtcaccacctaggatagctatggcaagtccttactcaagttcttctcgataggcaaaaccaatgcccttcgtggaaagatttcaagcttccaacaacacgcgaatgagttgattccggaagcatgagaacgtctcgctccaatagtacatccgagcgtgccctaaccatggcatcaagattggctcttgatccaaggtttctaccatgggctcaccaataccacctgtagtctaacgttggaagagctttcttctcactcaatgtgagggaagagacgaaactcatcaaaaatatggtctccaacccaagaagcaagggatgcacaccatcaatgaggtggacatgccctccgccaggatggacctctagatgaagatgatagaagaaagatccaacttcaagaaggaccatgaagccatccagcactatgccaccacgcaggccattgaaactgatccttggtgcgatgtttgtggaggagatgaccactcgggcaaccattgtcctgaaacaaaggaggatgtgaacttcatcatcatcgtcatcaacaacaatgggtatcgatcccaacaacaacaaggatggaattcacaccccttctgccaaggtaacggaggtaataacttcaataatttcaataatcaacctttattaaaggatcttgtgttaggccaagctaaaattaataaaaatataaataaaaagttgtttgctaatgacaagatcttagacaatttaaatgccaaaatggacagtttttcttctgctctcaaaactcaatcaagctctaataaaatgttagaaacataattagctcaattagcaattgttgtcccatccttcgaacaaggtaagatccctagtaaacccaaggaacctatcaaatctgtaaatctagtcacaacgaggtttggtaagcctccactaagatcgaggtatggtcatccaagaagggagacaatggtcatccaacaatcacgtgctctgttggatctcaagaattctacaatgccacctgggaccttggctcaagtgtcggcatcatgtccaaggtaacatatgataatttgttatgtggtcctttgtccactacttgtataggcctacagctggtcaaccagaccatcccctatcccaaggggattgccaaggatattatggtgaaacttcatgaggactatgtccccacggatttcatagtgcttgacatggggaacaatagtgacacacctcccattcttgggaggccctttctcaacacaatgaacgcatgcatctatgtgggtctagacaaattcacttccactttgttggaaggaaagaaagtttcctttcacctcttctactccaacgaatcatactaacgagcaggttaagaaaactggtcaaaaaaagaagccatgatccacaccaaggagagaaagacaaaaccaccaagacacaaccaaaactgaaattggtttggtggaaaaaggaggtgcaaccatctataagaccaaccgatgcacctgaacaatgggcccaaaggaggagtcctactctacggacttcaaacattgaggccttgccgaaaggtaattcggtttgtatctcatatttaatttccaattgtattcttcctttgcattttttttgaatttttcatatttcattttgcaacaaaccttttttgctttttgcatttcaacttgagacgagtcttcataaagatttgaaaacttttaggggaaattgggggttcggccaacccccctatgacctctagtttcgctttttgtgagtaggaaacattgatttaactggtgggacaaagcacaaaagataagtagaacaaggtggtcggacagccacccccttttgcctttctcttttcagctttgccttttttttctgtctggaatctcatgaagtttgaa

SEQ ID NO: 9346 - DNA, 566 bp, Oryza sativa
agctcaagaagatcattcaggattcaaaagaattggtgatggagtcagatattcgaagcaggatgcaagcgttgaaggaccaacttgttgaggcaataaatcatgtacacaaggtcactgaagtccatgtgtttgtagctatatgccgaggtttttgggaccgaatgggacaggtatgaatagaagtacccttcatatttttctctttgtcatacatgttactaatcaacctggttttaggatgtcttgagtttcctggagaatcgcaaagaaaacagagcctggtacaaaggcgcacgtgttgcagtatctgtaagtttatgctcctacagtccccatgtcaccctgcttgccagtgacggcctatttatttagttctccattgttgatgctcctcctttctgctatgattaaataaacatgcaacattgcaggtgctggatgatacatttgcatcccagatgcagcagctgctgggtaattcgatccaacagaaggagctggaaccacctagatccatcatggaagttcggtcgatcctctgcaaagatgcaccccgacagaag

SEQ ID NO: 9347 - DNA, 8339 bp, Oryza sativa
accaaatttctttggggcaatacaatccttaagtggagccaaaacatccccgtactgtttttcaagagactctatcactgctttctcaatatccgcaatagccttttattgtaaagcaaggaaatagcacatgttaagttggatttctttgctgtgcaacagttcaataaaggtcccatgaatgatacaaacttacattctcaagaacaaatatgtattctggccatcggcaaatgataacctcgtactctgtcaatgtattcttcagcaaatcatacatctcgtccacaaaaggtgtggtcatatgctgagtcctaactcctgaccatttaacctgatataattggagaaggtgatgcataatgagatacaattacaaaatatattgactgaaaacctgggtggacaaactattttagtagctgccagggcacagtacctacatataacctctccaatgttacacaaatggagaataaaagcaaagataaatactggattaacactgaggcaacacagtaccaatagcaaatggtatttgtcatatgaagaacctgtgctaaccaaacatatcatagatcaacaatgaacaggagcaaaagaaagagcagaacctaccttatccatcctgcaattttccagcaacgtcctgcgcttgtcttcgatccataagacaatgtacaaatgaaatagctcttttgcgtcaacaccggctttaattgggctgtgcagaaattcaaattcagtcttgcctagacaaggcatgagaaagaagagaacctagcaaacacataagaattcttttttaccatatattccagctagcaaggtccttctgaaagtcagcagttgcaatcaccaaatcagcaacaggtgatgaagggccagttggagggcatgccacaagaaaagcacgcagtctatttgagagttccacactatagatggacgcagctaaattggggaggtcaacaaaactgtagaagcagagggacaaacataaaattgaaatgattgatagaaaaaaatagaaacaatagcaaaagcaatataatcagtagaatagtcaacgcgtctaaatactctacaatgaaactatgcatacaaagtaagtaatgaataacagtacatggtaatatactagcctagaacagatgttgcaatacaatcacaatacctgggaagtatgtgctggttatgaatttcaatgtctgtaaagatttcattacgtagattacagcataatgatttcatcttctggtaagctgttgtaaaggtcaccagatccactcttatgccttcggaatttcctgctacatattcatcagtctcaagcatgtatcgtcttgatcgtttcctggcagcagcctggacatatttttgaataaatcaagctacagagttctggctatagaagataaatatcgagatataaaacagttgaagaatgacctggaaataaccgcataatctgagttgagcctctggagataatacatcatggagaagactgtaaagctttatagctggttctagagcacaagcagccaaaccagttggaggtctaaaatcttccactaaacccgacggcaaagattcattcagagacttgtaattctcaaataccatcgctaaagtttgctcaatttgctcctcaacttcacctaatatgcggttctgatgatacaattccagtgaagcagcacagttaagatgttaatgttacgtaagcaatttcagaaagaaaaaacaaaataagccaataaagcataatataatttattccacgtaactagattaatttgcctgttatctctacaacataagaagagttggtgatggtgttggtgtgctctatggtgatcttctatagattgatacatgtatacaattgtgtaccatttgtaagatttaaaataattccataccgtatatgtgcttacatatagatagtcggttgatacaaatttctttagttttacatctgaagataattattctagcatttcttttaatattagaacatataaaatacacattcatttgtaaacagttagcatataggtgcagtactgctattgcacacaaggataacataacatcaacacaaacaagggtacacccagtgctgaaagctcccacacattattgggtgtaaggaagggaatttcttggataatatactatatagcattaacattaaatcatggcatttgctatcagatgtgcaacagaacttgctgttccaggggaaatatctgaagaaaagaacagtacctcttgatggctcaatgcagcagtgccttgggtcttcattagtacgggtaacaaaaggtcatgaaccagattgagccaatcagcagtaggggttgcaacatccatgatataagagagatacctgaacaaggagtcaagggctagcactcagcaatagcaaaggaaaggaaatgagggaagatgacagatatttgaaaaaaaattatgatatgatagaaaaatttaaaggttctaatcaactgctagaacagccttgtgagtcagacttaaataatctcatcaggtattgtaaatatttcttgcatctagacagatcaagaaaagggaacatatggcaagacttaagcaagttaagtcacaacgtcatgccaacaactatatgctaaggctgagttctttccccaactttcccaactcacctccctcgttttacgcgcgcacgcttttcaaactgctaaacggtgtgttttttgccaaaaaaaaatctatatgaaagttgttttaaaaaaccatattaatccatttttcaagtttttttagctaatacttaattaatcatgcattaaacagtcgcttcgttttgcgtgcatgggagggagggttcccaacccatgctcacgaacgcagcctaagtaaaagtgatggttattggtcctatagtaatagccaaatacctcagctttgtgtaggcatctgaaacgccatagtacaatgcaaattctgtcaacaaccatttccaggaaccatgcaagatgagattccgttgttgaatgtgctgtgctttcattgcaacttccaaaacaatatcataagccacagtttctgcaacagagccatactgcaaagaaaatcacggccatgaaaattaaatagatgtcaattagtcaagtatcccttccactcaatagagcacatttttaatctcaaaatggataggccatttcgaatcaggcagctacgaaagaaaggtatacttttaaatcatgtttatatgacttagatcctgataaacagactaccctgttcagacaaattcaaatctacaatgtaaaatcactcttgtttcatgttattccatcagaatgaagatttaggaaacatttcctttgctgacatgctggaattcatagtaacataaataaaagaaaacttcagtcgaatcatgatatgtctggcaagaacaaagtctacagtctaaatacatgataaaggctgttttacactcttttttttaagtgacaaccatgacaggaaaatataagtaagttgatcaatgattgatatactgttgtttccatgttatacaggaaacaatcaaatggtaaaaaatgccatccatgaaaatcatccgtgtcatttaaggtgttcagtaaatcgacagctagcaaaaggagtgtgggggagaaatgagcaataggttacagtgctgcaattaacaggtatcaaataaattaaattcacatgaatacataacatcctaagatgataagacctgaatttgcagaacactgaatcagtaccttcgtgttgttctcatctgcagcagttgtgtagtgtatgtatagctgtatgcggcctacgagttcatgctcaggttcccggtatattgaccaccaacgaagcttgtcagtctacacaagaaagttgagaaatactgtaaggaacaaggattttgaagaagtcatagattgtacaataaccatttagagcaagtatgaaaatctacaataacttctatttaaagaacttaaacagagagtagcaagttggtttggaaaatcatacagattcctctgccattgtagcaacttgagcaacaacacgtccacagggctttccttttgaatcagaaacatcaatgatcaaatcatctccaaggctatccgggaagctgaaatatttacataaaaatattcagcctcactaatctcataatattcagatttccaggcaaaacaatgatatatgtgctcaaagaaaggtcttgctacatacaagacatgtgtttcaccagatcctggctgcatcggtacaacatcatcttcaggtgtacttttaagcctcaattggcaagagtaagtctctgaggcaaaaaggacatgatggattcagttagggaactcaatgttaaaagagaagtgatccatatataccttgcggtgtttcataggatgagctgttgcgcagggtagtcacgccaacttttagcacaccagatacctgcttgatgtactgagcacttgcttgcatgtacgctaagctatgttttgaaaaggaactgttagcaggtagctgtggtaaagtttggatccttcgaaccgactcccatccagaggagagtgtggattgtacatttgacaaacggtaccgaactgaatttagtttcaccatcggcaatgatgagaaattgcaaccagatggtacatctacagacatccggactttccgcactgcaattggaaatattaactaagttagcactatcatcttggcattcctttgcatgcaacaatgacaatgcaaatcaatattctggtaatggtagctatgaagatgtggatataagtagttttcataaacagtaggggaaaatagccagtgttgggtttccataccttgaaccttcatcttgccaattgttttcttgggtttggatgcaactccatcgctaacaagctcagatgtccgttttgccatgagctcttcttctgattgtagaagcacattttgcaggctaaaaaataaacaagaatatcaacttaagattgtattactgtttatgcactaaggatggagtgaaacaaatatttaagcactatcagcatgaatgtgcattagcagtttagcacatggataacaaatgtttaggttatgtttacaagaggctagatccaaacactttctatcagttttgacttctaaagtatccattttaaaaaaaggaaagtacaataacaatttactcaagatccataaatatttccaactgtagcaaatcaatggacaggaacaaccacagcagtcaagtaaaactagaatgaatagataaattttgtatctgaggaatttatttaaagatttttcaaagtacaagaattggcaattgcagacagaaacttaaagcactgttcacctcaggttcagaataggcaggtataaagccagcaaacatagacagctacagtagttaatggcattttacatactgtcatattttatgagcagaaagcattgttcatgcataaaaaataactcaccaaaatgtatttcgcagaagtgtgcattcattttccagaaaaacaggagcttccatgcaacctctagcccatgcatgaaggcacaagcgaacacaagcatcataagcaagaacagaataccagggcccttgcaaacttggataatttttttaagaaatgtgttagtagtgagcatagtacaccagaacaaattatgacttgcttactacacatacctggcatgaaacgtggggactcgaagaggaattgaactagatggtttgctgctgtgcccaggatttaaagtgctcctacataaccgaacaattttacagaaataaatgcaaacataacaaaaaaaaacttctcaagaagtatttaacaaataacatgtattacaaaagctacctttcacttttctcaggcaagttaggttccaagccatcatcattatattcctcttttttgacagtcgaaccatcgcatacgtttgcatcaacattttgagaaacttggcttatttcctgatcataagcatgtattggcggtgcactgggtacatcagatagtccatcctgcacataaaaatcaatcatcacaattacacaacttaaaagtaacaatgtcatcgtgcgacatgttcaatcaacacatcacatattgttccctgaaaacttatcaatataaaaattctcaatatatatgatttcctttggctagtttggatcatttatagaaaacttgacaacaaaacattccccagaaaactgcattttaaaaacggttttgcatacaagattacagtacctgctcagcgcacatgcttttctcaagaggaagcaaatgttccagatttatgacagataatcctaggagagggtttctctttagaatccagaagcaaaaattgtttttttaatcatccagaccataatcaaagtgaactaaattacaattctgcttcagaaaatattcatggaaccccaccaaaaaaaagaaaaagaaaatattcatggaaggggggaaatatttttttttctcagagaactatggagttgtggaggacatactatcgaacaaaattctgagatatagaatgcaacaaacagtatcaggtaatctagattctggacagatgattcctcaaaacaagaaaactgtttcatttttaagtttaggtgctaattttttttagcagctggttgcttggtgcgggttcacatactactgaccataaacattttcagctttatgcaatacaggcttttctttcctaactcaaccgaaaggtgagtgcttgtacatggtaccgcagaatgaagtaaaatggaaatgacaagtaatgctattgctttcacagaaataagatactgaagctgaggataagaaaatgaatatgctttacaggtaagcgcagaaacgtaccatttgagaagatttcacattgtcttgagcagggacatgggcagaatacttatcctgttgatatgttcttgagtttaaaggtgcagtgcggctgtaattctctgcagctgccatccgggttttcggaactgcattgttcgcttctcttcgcgctgggccgttatgagagtactcagatgcatacccacccctcgaggccacacctttgctccgtgtctccacctgactggagaactccgagctcccagctgagtccgagtactcctcctcctcaacatatctaccgacctgtgcctggggccgccgtacctgctgctgcttcgtccttggcagtgcagtgtctctcgacgagctcagatccgagtaatcgctcgagtagtaactcggcatcccgggaaccgtagcataccggtactggggcacggccgtgcgcctgagaatgtcctcgcggcggggcgacgagtccacggagtatctgccgctgcacacctcgacctcctcggtgtccgacgactcctccatgtcggatcccgaggcgacgctgccgtcgtcggtgcgcagcggcggcgccgccgcgcgaggcaggtgcccgctccggaacttctccggcggcggcatgccgaggccgcccccggcgccgcgcaccgcgcggagcgcgtcgatgcggtcgtggctgtgcaccgccccgccatggccctgccacattttgcatcaaccaacaccaccacgcagaaaaaaaaaagcacgcgtcagtgacgaaaacccaacgcgacaccgagcaaaccagctagggctcgggaggagcacggcgagctcgaactctcacctcacgaacccacttgagggcgtctcgatctagcccctccgtgaacatcatcagcgcatgcgagttccaactgaaacggacgaacaaattcagcagaaaaaaatcatcaacaaaatttcaagccactcacaccaaatgcatgcgatccaaacacccacaaaccaccggggaaaaaaaatccacacaacgcagattcaagcacgacgagcaaattccaacgattaggaaccaaatccagcagagaaatcccacttaccttgcacccgagccggagcgcggattcggcgctggaactgagagcgacacgaccgctctggtttgaattaattcgaaaaaaaatccacgcaaacaattccacccagcggctagcggaggcgacagcgaccggagcccggaagagagcccgagtaggtggtagggaagaggggaagaggagaaggaaagggacaacgaagagtttaggcttgggtcagtgtgggagaagaaaggaaaacccactgtaaattttcgaattaacggaaaaaaggcagggtaatttacatgttagccctcgtctggttcctcgtttggtaaga

SEQ ID NO: 9348 - DNA, 9931 bp, Oryza sativa
gtaaaacaaaggattgtaaaacacaagaaaaacataggaatggtcgtttgattggagcgcaggaaaaatgcaggaatcggatgagagagatagactaaaaggaaattttccaagaggttggagctcttgctaaattttctccaaaatctacatacaatgtgccgtttcatatgaattttataggatttggaaagcttcgatcctttgaatcaaagggccaaataggaaaatttcctataggatttgaatcctatgaaatttctatataaatcctttgattcaaagaggccctaacagtaacacacaactaggcccttgctggctgctaatgatggtagggattgccattttgttcctgcctgagctgaaacatagctgttgattgtttgtaacgtgaatttttcatgcatttgttaatctataattccgcaaagcgatcatgtgttaatgcaaccccagcattttcatccactaataaagtaataaacagatggttaaattcaactgaagttgttccgcgtgaacttctctactccaaaattcaggtactagaagcaattcatgcatcgagtatgaacataaaacgctaacctgtacaaaacaatatcaagaacgctccaccgacactaccgatccacccgaccccagcatttccttggctcctcgtcatctgcaggtcgtcgtcgtcatgagcttttcaccgatgtcgaaattgtacgtaggtgtcttccaagcttgagccaattacgtacctttttggcttttgcagcgtggccgatcgcgcggaaaggggagcggtttggtcgggttggacgagaaatcgacggggcaccccggcccgcccgactgatgagatttcacacggaaagcgttgcgcgcgagcgcgagagctgcaccccacccaacacgtaaaggttgcgtccggatcataacggtgaacgttcaggggcaaacctggaaacacagtattaggccattcccaatgcaatgactagatgatgtgtatagtattaaataagctgccacctataataaaaaatgatatgacaactgaataaatgaggaaagagaagaaaactatgtctcaagacatggtttctacacgatatcaaaacatcatgtgagataaataacattaaatttaagtatgaaatagtgatgtttgcattagaatagttgtgtctagtagtagtttcttaatgatatggagtttatagaaactatacgtttagattgggaatggccttacgtaggagtactcgttaatgttcctcgtttactgagcagtgtgaaactgcacgtggacctgaagcattttctccttcgtttactcgatctgcttccttcgacactacggaatgtcagtcagctctgatatgtcgattgtagtgagctgtttttttttgttaatagcaagtggtagtgcaaagcgtttcttctcccgtgtaacacggcaaaatgccatgttgccatgggacctgaggcttatttgcttagcagtgcgggatttgctgaaacgaaaccgattcccgttttgcgtggatggatgcttcacgccggctggatccgagtttcggcgtggatcacttttggtgtgagctaatattattttcgacgtgtgtagagctaaacccaactttatttcgaaccgggggcggaataatagcggaatgtgatcgtgccgtgtaatgattccaattgtcgagtaagcatcgttcgtgcactttgctaatgtcctctcatcgagtattttacatggaaaattcctttgtagagtagtactactgtacttgtagctgcccaagtgacgagggagttggtgagattttcgtcccaggtggatggtgaattggtgatctgtgtcagttcatcctatgggccgagacaaacaaaatggatttcaaagcccatccaaaacacgaatacgttgtacatgggcctgggcctcaagtgcaaccacaggcgaagccacgtcgggcgtgtcaaattgtggtccattactcgaccagaaaatcccccccaaaaaaatcagaaaaatctactactagaaccttcctggcttcgtcgaagcccacgaaatccaactaccgccagccatctcacgggacgggagaatcgccggaatcggcgcgattctccgggcacgaatcgggccgagaaatcccgggtgcgcgctgcgtcgaagcggcgcggcgagaggggaggggaatgtggtgggagtgggaggaggacggcgaggaggcggcgcggccgggggaggaggtccccgtcgacttcgacttcatctccctcctctgcaagcccaaggtgggaatcgccacgcccacgcctcgtctcgtctcttctccttcgatttctccgccgcgatcttttttttttctgtggcacgtttgttcatgacctgagttaaccctcacgggcgtttggattgcgatagatgattgctgtttttgtgttggggggagcggatcttgtagatggaatgccgcccgctggttgcgattgtgctgtttccttttacccaattgggaattggctcagggaccccgattcgtgaatgcaggattactacaagattctggaagtgggatatgatgcgtcggaagaggcgatcaggtcgagctatatacgtcttgcactggtcagtgtttgctctaacacggtgctgatttgtgcttcacattcttgaatcgtcctgtgaattatctcgtcaagtaaagtttggcctaattccacttttgtgcttcacattcttgaattgtcctatgaattatctcgtcaagtctagggattccacttttgtgatggtttacaccaatgcctgcctaatgatgtccactctcttcattcagaagtggcaccctgacaagaagcagggcgaagaaaatgcaacctccagatttcaggagattaatgaagcataccaaggtgagcaatgaagttgtttaattgatctgatacgtctatgtctatgttaacttcaatgtgaaaatagtatgtgccgtactgcagtttacctttgtttttttggtctcttgctaacataataagttgccagcagcaaatcaaaatagatattaatgttcggttgcatgcagatttatctgtattagtgaatttcataactattactcctgagatgcctagacatggaacaattgatgtcatctatgtccaagagaccaagatgttattcttgaatttaaatacaaggaattgctaccacaagactaaaggatgtttggctgttctttcaattgtttaggtgccaatgattcgtgtgtttcctcatttacaatggattagtagttactaggaatctgggttgtgcttaattaaacaatccaatttctctcggcattcagttggagatagcttcctcgtattcttgtcaagtagattgtcaaatcttctggagactaatgcacttcgaacaggagaaattgctcattgcttaacacaaaaatgctcagataatctatagtcaggctagctctgtgattgaatcattgctaagaaattatgtgaaacatgatcttagttcgttgtcacacttgagccacatttatggtgcaccttgaacatcttggatacattcacgtagctttataaatttatatgcattggtgttactatctgtgctcactgacagggcatcttttcgtaactaatctttcccattgtaaagagtgttcttcagtttgatatatcaggtctcattcatgataccataactgtttttcacagtgctcagtaatccagccaaaaggcgagagtatgacaagaaaggcattctttatgttcaagatcataatgtagtggtaagtccccgccctcctacccccacccaacacacacacacacactgaaagaaaatctatgttgcacaagacacttctgatttttcataactctttcaggactatctgaaccggcacaaaggtttaatccttacttgcaatggccttggcataaggcattcagtatggtgatcttactcaggggtactacagtctgcatccatctgctgtctttggatggtgtgtgtcattgtaaaatctcatgtaatctgcaaaatgtagcacggtcatgcggacctgccacttttgggaggaaatgatgacgctgagttcatcctggtatcctacaacatagatgattcttatttggtgatcagttgttgtagattgcacgaagcaagagttctaagttacacatacatgtcgcccctttgtgtaacatactaacataccatatgaaatgccagcacgcacttcaaaatatcttgttagttactgatgttattgagcgcagctgaatggcagggggaaaataactcggttaaagacttacctggcaagttttatattgcctttaaaggggaaatataagtacttcacataacggtatctgcatttcgcactgatgcaactacagatgtagcgatttgccagagataggatttaggatttgtgatttgtctaaaaagttctctatgctacttgcttagtatatatacaatatatttcttccaatgtttttcaaactacagtgttttgacaaatggaaagtggtcggaagggaattagggaaaatatcagctgatctgttggtgacactgcttctcccactcaattttcaatgtgtcaaaactcaatagttctttacaacaaaagggacggacagttatgtgctgaagcaatttaccaaatatgaaggtcgacccatttgatatattattatgtatccaaggtacacagcttcacagttggcggcactttcagtatggagtatatacatcggatcaagtggtaaaaaaaccagaaagacttgagcaagctccgctctaacaaacaaaaatctatggatgtctgatcatatttgaagcgaaagaaacgtggcttacatacacaacttttttccctttcagtaatagaaaaaagaagacctaataataagttggctgcgaagcctaacatacaccataggatcattcatcgtgagctcaaataatcctctctttcagatcttcgaatttcgcaaacagtttgtccctgctttcctgcatatatgataaaatgatcttaggatcacacaacaggaatgactggcgcttgctttgtagggagttgaaaatgtaccttgaagaggaggtaccgtgaagtgaaccaaattgagtaaccagttcctatgagttcaagaacttttggaacctgcaatgagatgatcaagcggtttaggaagtacagtgtaaactcttcaagtaataagtacgacaaaactatatcaaccctactactgctgacaactagaactacatttttcagatactggacaactaggactacatttttcagataatggacaactaggcgtatataccaggagcggtttgaagacagattttaactattttcgatacatacaaatttgtaaacaatgtcatatctacatatttggtgaaaaatgtcatatctacataccaagggaatggaatcgattgcagaaacaactgaagatagaacccataggacaaccaaagcaccggatccatagaggacaagagttggtgtcacttggatgtccagctgaaatgaacgattaaaaaatttgtgtgagcaacagtactaaatgcagtacagcaaaggcgtttcaatgcctcatcccgtatagcaaacacaagaacaggcaagctgaatatatggaaatggatgcaggaaagatgagattatggtgatacatacactcgcttctgagttaacagaaatagaaggaaaaaaaacaatgtggtacgctatacatgaaacaatcaaacttcaatccatagcaagaaaactatggcatatggcatttgtttctgtctatcatgtgttggggtttagagctctgtctctgcaaacctcatgctaggtcctaatcacccagctcacaaactctcacattttggtacacgagtcggtgactgaactcaattttacattttgagatctatcaagtatgcatttgtcattggattcttcaccatacttctgtatgcaatattcttcaactcgtctctcctctcaatcatttgacagcaacaggtaattgggcattgatatgtcagaattggcgatcaattcagaaacatcaacaggtacaacgaggcaataccttgctgaggatgtcatccaagccgccgtcctcctcggctgcccccgacgacaccggcgccgccgccacggtctccagagacccgccattagagaccgccgcgacctcctcgctcttctcctccgccggcggcggatcgggcttgtcctccgtgacgacgacggtggacgccgacgccgacgcgggctcctccgatggcaccgggtccggcgccgccgcgctcgcgcaccgccatcctggcgacaaccatcaccaacagcaaaaccgtcagaaagataatcaatcaatcaatcaaaaaaaatcgtggcgcgttcgggcacctcgagtcgggaggtggcggttgctgcggcggagggtggcggcggcggcgacggcgggaggagcagcgcggcggtggtggaaggaggaggcgaagcataagggggcggtggcgcgcgcggaggcgacggtggagacgaagagctccattttttttttctcttcctcggctttctgtggaggcccgagaaggctgggggtttgaggtttttgtgagctgggaggaggatgagggtggtggtgggctagtggctcagtgagactgtgcgagtgagctgtgcactactactacttgtgctgatgctgtccgaatttttcttttctttttctttttcttctcttttttcacacaccctgattttttgtttgtgcttttggagggtgacatgtggcgctttctcttttgctcgctccttttctctgagtaccacctgtgtgtgtggtgtggtttcgcattctttggatggatctactttcattttcattcttctttttctggtacaattatactccctgtaactgtagtcctgtaccatgcaatttaactgtagcataattcgtattctagaagattttggcctgttaaaatacaaacaaattgatagtgtccgtagtacatgtggagtagtatgtgctgcccatttagatcgagttgtctgggtacttccacgccaccattttttccaagtccataaaatattttctatttattttagtacggcagattttcattcgctagccaaccatagaactgacacattacataggcactttctctttttcctgggataatacattaacatttggggtaacattttctagtggaccaaaaattttgtcggctggtaacacggcctttgagaaggcccagtactgcaggtataccattccgtccggtctccagcccgcttccttacgttgtacttagtaggataatttgggctggcacagtaagtaggcctagcattttcaccgaccacgcgcgtgggcctggctgggtggtgacaatgtgtgtcatgtggagcccaaattggcagattaaactcgtgttagcaagcgaaattaatgggcccacttgtcagtctcatttattctcgttaaacaaacaggcaaacattccgagccgttaataccgtagcctcgttactcgttactcactccgtccaaaaaaaaataaatctaaaatatagaatgtgacatatcctagtagaacgaatctggacatatgtatgtccagatttattgtactaggaagtactatgttggttttttatgagacggagggagtagccattacccgtgcagacaagcatggctccgttcgagcaggagagattgctgggagattgaggagaaaacatctacttttctacgcgcacacttcccaaactactaaacgatgcgtttttggcaaaaaaaaattcttttgaaaagttgttttaaaaaatcatattaatctatttttaaaacttacaatagttaatactcaattaataatacactaatggctcacctcaccttattttgcgtatcttctcaatcccctctttcctatcctctcaggattcaacccagttatcatcatcaccagtattaatagtttccagcccaaggaattattttgtttcggactagaagtctcagacacgatggtatttgcttcggattggctaaggatttggtgcatatttatcggcccagcccaaattcttatcgggcctagcccatccggtagccgccataaccccaccggccaccgtggtcagcttctcttatcgcgttgcccaaataattacacgaatcgaaccaaaccctagcttttcctcttcgattcccgatcccccacccagcgactcgccggaaccctagccctagatcccgcgcggcttgccgccgtgctagccatggcgtccctcaaggagctcctcccgacgcccaaggcggcggcgtcgacgttctacgaccacagcagcgacccgtggttcaaggagcggtatggcggggagtcggcgcaatccgacgcggcggcggcggcggcgaagccttcgggccccgccaagcccgtgccgccgtacgggaagcgtggcgggttcgtgccgcggcggccggaggacttcggggacggcggcgccttcccggagatccacgtcgcgcagtacccgctcggcatgggccggcgcgacgagaagggcggctcgaagatcctcgcgctcaccgtcgacgccaagggcagcgtcgccttcgacgccgtcgtgaagcagggtgagaacgcctctaagatcgtttactcaaagcacagcgacctcgtgcccaagattgccacggctgattccgaggcaaccgcggacgacgaggagtaccagaaacagatcgaagaaaccactgaacgaactaaagctgccttggagaaggttgtcaatgttcggctctccgccgcacagcccaagaatgtgccgacgcatgattcagagtcaaagtttatcaagtataagccatcgcagcaatcggcagccttcaattcaggtgccaaggagaggattattaggatgtcagagatggctcaggatcctcttgagccaccgaaattcaagcataagcgagtgccccgcgcttctggatcaccgcctgtcccagtgatgcactcgccaccacggccagtgacagtgaaggaccagcaagattggaagattccaccatgcatttcaaattggaaaaatccaaagggttacaccataccactcgacaagaggttggcagctgatggaagggggctgcaggaggttcaaattaatgataactttgcaaagctctctgaagcactgtatgtggcggagcagaaggccagggaggcagtacagatgcgatccaaggtgcagagggagctgcagctgaaggagaaggagaggaaggagcaagagctaagggcacttgcacagaaggcgcgcatggagaggactggtgccccacctgcacctacaggggttcctgctggtggtggtagaggtgctgttgatgacagggaggaagatatggatttggagcagcctcgtgagcaacgaagggagagtagagaagaaagggaagcaaggattgagcgtgacaggattcgtgaggagaggagacgtgagagggagagagagaggaggctggaggccagggatgctgcaatgggcaagaagagtaagctcactagagacagggatcgtgatgtcagtgagaagattgccctgggcatggcaagcactggcggtgctaaaggtggggaagtcatgtatgaccagaggttgttcaaccaggataaaggaatggactctgggtttgctacagatgatcagtataacatctactccaagggtctcttcacagcgcagccaacgctatccacactttacaggcctaagaaggacggtgattctgatgtgtatggcgatgcagatgaacaactggggctgcaggaatt

SEQ ID NO: 9349 - DNA, 1607 bp, Oryza sativa
tggagtttgataaacaggaggagaatgatcccttcggtcttgatcagttcttgactgaagtgaagaaggggaagaaagctgttgagaagattggaagcggaggagccatgagggcaagtggtggatcctcaatgagagatgattacgagggtggaggatctgggaggtcccgcattaactttgaaagaggtcgttgaggtattagatctgcatgttttgttcagaagtttctccatgcattccaaatgttatctggagggtattctgttgagaatatcaacttcttgatgagaggacttgatgtctgagttgtcttaatgcaacgtctacttccaaggggcatcttaaggagtgtacctgtttagatcctgtgattatgcttgttgtttatctatttgtggatggatctgtaagcttaacttatcatcattccatatcccttatattttgtggtgctttatgaagtctcgatgtgtctggctgaccttacattttctggtactgtaccaagtctttaagatgtatctgcctatctggctgaaatactgagacacgggatacatataaattccgtgttctgttttttcacaagttctaattatttcatgctaccatgattgttggctggatggatttctgggtattgccaatatcggtatgttgttttggggatattcatgttttgtgcaaatagtgaattcttcgaaaattttttgtcggtaagcattttctgttgcaagactttgccggagcattccctttgcttgcagttgatgtggtttctgtagtaccaactttcggattaaataacttctcttttgtgattattactggtaagatcatggcataattttaaaacactatccatcctaaaataaataaacttaatacatgatatgatatatcttagtattagaatctgaacagatacacactttcagtttgttttgtcttttcctttagttatgtagattcagccatagtgttgtgtttttcttcaggtatgcagattcagctataggaaattaggaacacagtgaagaggaaagttttcattagcacgttttcttgtgtgaagcgcaaataacaggattttggtgttctttgattttggccaaaatcttcatggcatggatggaattttctcaaagctgaaaaccgtaattttctgacgggctgagcaaattacgctggctgataactccggcctgcttaatgcctaggcccaaacgaagcagccgagcaaccttgaggttccatcggcacccctgttcggctacaaaaagcacctcactttcttccttgctcatatctgagcccaagatcctgatgctactcttcccagtgacaaagagaacctcggtctctgacgaatttttttcatttttaatttttttcttttaatatttacagaaataatccatcggcgcaaaaaattacaaaaatagacccctgccgccctccactagggcggcaagctgacgtggcaaacgggggagggacgggcggtgacggcagacgggagagggagggttttttttgcacgaaaacccttgccgccctctggcccccatgcaaaaaagacagcccgagcctagcactttttg

SEQ ID NO: 9350 - DNA, 2117 bp, Oryza sativa
gcatttagccccttgccgcccttacagagagcggcaaggggctaaatgcaattttcgcagacggcggcagacggcgccgtcgagccgccgtctgccacgttagcttgccgccctccattagagcggcagggtctatttttgtaattttttgtgccaatagattatttctgtaaatattaaaagaaaaaaattaaaaatgaaataaattcgtctctgacctcactctgaacccttctccttttttttcaacggccaaacaagattgctttacgctatattgataaaagaagtttaagtacaaagtaaaaactgaaagaaaaaggaaaaactgtacattactgactgcaaactgcaaatatgcttgcacgtcagtccaccttattcctcatggcaataatctcgtaaagtattttgcgtcggtcaactctagcaacccaacttgtgattgattcttactctgaacccttaaccccctcaatgcagccatggccgctcgtagccgatcgatcgatcgaatccaaaatctcccaaattcagcagctaaaatcaggttcacgtcaccatgccgctgcaggagattccgcaccaaaggcaaagaaagaaacgttctttgctatccagcatatcatagcagcgtagccgtcgtcctcgtcgtccccatcgatccatgtcctacgcggttatcaggttatcatgacactgtttgaatcggagagctttgcattcgcaacgcaaacccagtcgccatcaccgaaacgaatgatcgaactagagagaggaagagagagaaagaggtaggtaaacagatggttggcacgggcagcgtgacgtgcaccggttttccccccgagattatattcggatttggtgttcgctttatcatcgagtacaactgaattgtcccatcttttcttactactagcttaagctgtttttaggcttcctttgattcgaacaaaaattatagaaattttaaagtattttatttctatagaattttttcatatatataaacatttgaatcaaatgaatgaatcctatgaaatttctacgtgaccttattacatgcaagtttacatgggaagttttctttgaatattttatctcttctcgaattcatgtgttttttctacagtctaattataatcctatgttttttatattcctttgctttttcgttcctacaatttaaagagtctcagttgaactgttcggtctgtaactcagtaccgagtcgggtctcatggtggatggcgctgtagaatcagtcgatcaagcgaggcgaggcgacggcgaccgaaaggaaaggcacaccgtggtcaatggatggatggacggatcgatctcggccgtcgccgtcgccgtcgcctgtcactcaccatagcttttccatccgacgcaatgcacgccgtttcgctgcgatcgatcgagcgatcgatggatgcatgccctgccggccgtctcgatcggttctgaaatatcaacttgcaaaggcgatcgatcgatgcagcttacctttagaattgtcaaaactgcatcagccgctgcacgcatggcttgccaatcgtcgtctgctattatctcctaatcctgacgagtggatgtgacgaagtgttaaaggtgcaccgccccccaagtgaatatctgatcagtttggctttggttaagaggacctaattccacgtcattttctcgtcccatttcggtaaacaacaatcaaatcaacacagcataaccgatttgttcttcgagatacctgccggtgggtacacgaaccttttcttaataaagataataatgggtacatgaacctactcccggctttaattaatttgcagaatacaaacctaccttctcgagccagcctgccctagtgagaaaccaaccctttcaagactttacacgcagcaagatgttactgcaaatctgcaatcctaacttcagaatcaccaacttgtttctgaactgtagcatatcatagatattcatcaatcaccattcattcatagtactacctagtgtactactatcacacagtgccatgctactccggtactagcttcaaaaaggagtggacaagaattcgcacttagcagcaacagtagtggccagtggat

SEQ ID NO: 9351 - DNA, 4719 bp, Oryza sativa
atccacatgagcctcgttgaaagatggtatagtactaaagatattggtggactttggcacatgtatgatgagagcatttatggtttgattgatatatactagcttgtggcatgggtgtttatcatgggtaggctgcttgtctcattccatgattaatatcattgtagatgctaaatggaagatagtgacattgtcacttatacatctgtggttatgtttcatgtagagcgcttgaatttcacatggaacagttcaatgaaaggtgtggaactcttgcaaaatttatcctatactcactaataaatttcctgcaattaaaataagcccttaacatcactgtgttaataaactcttctaatttttttttaaaaaaacatatgcattatcagacttccttaataaaatggatgctaggtagcctcttgatgagatcttttaaaggcatgtcacatttgttttgatattcattctggcttttgttttgaaatatagttgaagaaatgacaatttatccagtttgtggcttaaaccaaggggaataatatctcagagactcaaatctgcattattttgttttaatttgaggcacacaaagtttttcctactccccaactgattggctggtttggagttggaagaaaaggggtggatagcatatttgacaagaaaatgcggctagttcatgcatgcaatcttcaggttacatccaaggctgacttgcaagatactaatgaagatagattaacagttggcaaacactacacaacgaagtgacccttgacttaacgctagcggcggatgcttccacgaagtttctgcataacagttcatgttttctcaggcccagactgactgatcactgatatatcctagtatatcatctcaatgttacaagtaacaaccacattttttttcaatcactttttttttttgcatccaacagaagagaccagagttgtgtatgactcatccaatgcaacggcaaaagaaagctgttaggcctaagatgttttaggtacacagatgctgcacaaaaaaacgtgctcatgaccgcacgttgcctgcacagccaagtgtccaacgtgcatgtgagcaaggcatcagctgctcactgtcacggtccagagcacgttacacaggctctgaaacctaacaaaacaatgcaatcaccaaacttccttcgtctcctaccttactactcttccccttctaaactatagcaatttcccttcttaactatagcaaccaaatactttatagaacatattataatatagatttgtagtagtaagatgtgtcagaactatcctataacaatctaatactggatagaatatattataattcagattcatagtactaatatgtatcaggactatttgaatatgtagtattactaagacgtgtcatatctaatattaggctgctatattttaagagagagataatactagcatcctaggttggcaggtaggcgcacaccgtttttttggcaaaacttcgtgacaagttcctaatcctacacaaaagaagtggttcctttggctgctcggtttgctgtacaatatacctctccccatgaaatcacaaacaaaaccagacaaatgcaatttaagagcttaaccttcccgacaacatcttaatggtagacactgggttacaccataaacaatggttagcgtcatactcccagaaaacactcaaagaaacctgagatctacaaagctctggatctactactacctcacaagaccatctctatcaagatgggccatcacatcaccccctgatgcagctcatgatgcagggagaaaggcggcttaaactcgagcctgaaaaaacaaatgcaagatgcactgaccctgggaagcaaatcacatggttgccagcctctcaagagatctaaagtgtaggtttaaatgaccatgataaaaaagacaccctgtttttttgttaattattggggacaacttagggttctgggacactacacaacagtagtggttagcacgcagatggaagatgatgcgcaacaggcggtacatgcgacaatgggattcctcacatgaggctggctggccatgagtaactgatagctttctcttcacttgcgagtagtagttgctagcttgctctcagtgtctcattgagctgggtgctttgaggcttcactccctccaggatcctgaaagatgcagaggaaaagggaaggataaaaagcaaataggaatcaggcagttgatgtcatgaaagatctaaatggaacaaggacgacttctgagatcaaatcattagtagggcctgtccttatgatgacaatgcacagcctagggcatttattattgtagtagcagcagcaattgagcagtcatggtcaaagtaacatgatcatggcaatggaacagtgataggctgaatggctgatagagacaggcaacaaattaatgcattaaatttcaattcctccaatagcttcttgattcataacagcgacgtgaccaagtaaaaggggggtaaaatggactacaaaaataactcaagagagaaccccaaaaaaatgaaaaaggaaacaattatcatagttgagttttgagatctaaaacataaggcaacggatgatggaatattggagcattgccattccttcgtctgagcagatcaaaagatggctaatctaaccctgctgattggaatcagttcctactcttcatctaacagtaaaatggtaggcatcagtcgagtcacagcaaggaaaagaaggatccccatcaggcatcaggtagctcactcgacgaacttctcctcagcaacaatacatacatcaagaagagcctcatatgcctcattgtcagcaaagaaaagaacaatttggagatccgcataatcgaagttccccacgacatttgaaaatcatctgcgggaagcttctgtgtctgattctgatagactgatcagggttcaggaatacaatagcaatgataaggtttaatagaacaaacttgttttgtgagtacaacaaacttcttcctgtagcagtactacaagatgttgacaaatgaaggtgcatcattccttgctcctgccagtgatcgatacaagtacagtttatcaacagtctccatctccccttcatcatcaagatgatccttcatcacttcaaccaccaagtcaggcatttgctgagctacatctctacaacccctcatggttagcctgcatgaattcatccataagaacctcatgttgtaaaaatagctcaggccagagagcaatcccttatcactaaaaggactatctctgacctcaagcttttgcaacctagtgcatccttcaaacacagattggagagacatgtcactatttccagcgaaggcaacagacagtgtctttattagtttcccatattttccaatgtatgcaaacgccttatcagtgagcagaccagagactgaaagtctagtgagcttcttgcagttcatcacaattgccccaaaaccatcatccatgggctccccagtgatccgatcagggcggtgtcgccccataatacaaagacggaatgttaccaggtcagaacagttcttggacatagcaattactgctgcatttgtcatgcgctggcaaaagtagagaattgattcaagcttccggcacccttccgagattgcctgaagaccaacatctgaaaccgatccctcagaatcctcagtggcatcgaaaggaaaaactcgcagctcacgaagatctgagcatgtctcagccacagcccgaaggccttcatcacccactgtatctagaacctagaataagaaattcgaacaaaaacatctaagttgacgtacatacatcaatatttattctcattcacaaaagataaatctatatttatgcattgggaatgagaaggctgacaagataattacccagaaagtgcgaagacggacgcagttgcgaataatcggtgtgagctcctcagcagttaggtttgcaaagctaaaattaagggaagtgagattagcgcagactgggtggattgctgggaggtattctggattgacatcccggaaacctgacaaacaaatcagagacctagatgccgcaaaagatgtagcaagctcagtaacagacagagcaccaccagggcctggctcagaacggaatgcaccagtaccaaggtgtgtgagctggggagcccttgccattagacggcgcaattgctctactgtcacatggtgattcattcgcaaccggcgcatagctggtgagcgtgcaacaagcgcctccagggcctcaaagttgaatgggacactaacacaatcaaacacaagtgactccagcgacgtgttggactccgggaacttggagatccaatccactagctcatcctcctcctcgtcaatatagtcttcaatcagatccagcacacggagatgcctaaaaatgaattgtgcaaaaccatgagataccgcatttcagtgacataaacctattttaattgaggaaaagcagaagagacaccaatttttaatgtgaaatgtctcactctatcccactttgggatggtcatgcttatttactagaactgctccacacccagaccaaacaagaaaaggaaaaactttgcagtagtaactcggagacttgccactccaagattcgattgtgacactaacaagtgtcggacacttagtgattagatcgtcaagaacaataaagatc

SEQ ID NO: 9352 - DNA, 5503 bp, Oryza sativa
tggtgcccggaggaagaaagaaaaggaacaggacgaatgcacattgaccatcacaattcacactactgtgatgggagaaaatgacatggagtagcagcagcagtagttcatgtagtatcatagcatagcaatatcatagcaatggcttgtttctttcttctctcggcatggagccatcaagatttgcatctgtttcggcaggtttggtaaaactgggagtgattaaagttgtggatgttaatgtgtggtgctagtagtagtaattagtttaggctccagttttatcaaagtgtaacgacttgcctcatgtagagtgcctacaaatttagatgttgtgttttatgcgagggaggtaagcttaaacacaggaatattgtgtgcagtaactaaatcttggaatatcaggtgcatggctataagcaaattttggggatgaaataaccatgccaatttcaaggggaatactagaatagtaataatgcttttaactatcggtgtacttttcttaaaataatactgatgcttagcgcgcgaatgacctcctagaggtgaaagaattttgtgggaattgacccatgtaaaaattcatgagttccaaagaaacatattttatttaaatactatatgaaattcagaagcaaataatttacatactactagattctaaagaagatagcccaggttaagggattaaataccttaaacatcagcttagcagtttatttaaggcaattaatcctactaatctttaagcctaaacctagagagctcgtatccatccaataggtccagatcagcctacttaagtagggaccatctttgatacgtgagtctcctctttttcacttgcttaggttgtgtttagttttttttttaaagtttttaaatatatggacacatatttgaagtattaaacgtatattaataacaaaacaaattacaaattacgcctgtaaactgtgagatgaatttattaagcctaaataattcgtcgttagcaaatgtttactatagcatcacattatcaaatcattgtgtaattaggctcaaaagactcgtgtcgtaatttacatgcaaactgtacaattgttttttttttctacagtttaatatcctatacatgtgtccaaacatttgatgtggcattcttagctaaattatttttatctaaacaaggccttactccgtattctctctaactacagtgccaacctctaccgcctggaccctggaggcctagagcttgtgattgtaatctagggctgtgtttagttcacacaaaaattagaaatttggttgaaattggaacgatatgacagaaaagttaaaagtttatgtgtgtagaaaagttttgttgtgatgaaaaagttggaagtttgaaaaaaaaacttggaaactaaacacggtgctacttaacgaaccaagtgtctgtcctcgcattgaattctacatctttgatctgcataatgcagtaatgtcctcgcatcggaccttgtcatggcaatccgcatcgcaaaatatcactacgtctgcagtatgctcttgcaactttacaagcctattccgcgcacacacaattgttcctcgttgcctcaaaccatgtgtgtttgatttctcaagcaagtcctttgttataatccgtcatatatattttttgcgagggttataatccgtcattgtaaccttgaacattgctttatacgatatatcatacttcctcaatttcacaatgtaagactttctagcattattcacattcatttagatgctaatgaatctaaacatatgtatcatggtggtgtttgaatttcctgaggatgaagataaagattaagtgtttcacgtaaaacgaggtggtaataacgtgtgactaattgggttttaaatattataaacttgaaaaatatattaatttgatattttagaacaactttcatatagaaagtttttgcacgatacacaccgtttagcagtttgaaaagtatgtcactagtatccaaattttcatccacttcttacattagaaacgaacggggttatgtgtttagattcattaacatatagatgtatatgggcaacggagggagcaatgactcctcacgactactatgaacgatgttatctggagggtgccaacagttgccaagcctcctcaataggagttgcgacgatcaattcgtcggaacttagtacccctctcatgcaacgagtaccttatcattaaggtggtacttatactcaacgagcatcaatggtagtgtttcgacacggtagcgacgtagatttgacatcaaaatcaaatacggtgattatctccctccaaggataaaaccacctttcatggagccagagaagaagctaagggtctatttagttctcgaacaaaaatttttaacgtgtcacattaaatatatggacacacattttaaatattaaatatagactaataataaaacaaattacagattccacttggaaactgcgagacgaatttattaagcctgattaatccatcattagtaaatgtttaatgtagcaccacattatcaaatcataacgcaattaggtttaaaagatttgtctcataatttacacggaatatatataattagttttttttcatatttaataattaatgcatgtgtacagatattcgatttaataaggtgaatttttttaaaaaaaactaaacaggcctaagctgcaacttcgcaatgtctcataattgttttatctcagtctcattttaccgaattattccttgctcccaacacaagaaatacagtactaagtacccacataggctaattagagtagagcctactgcttgcaaagtttgaaggctggtccggcttttcaacagggacgtgtcacacacccgagcagtcaattgctttcattgcttaaccgcccacactattgcagagattcacaaagcatggccgctcctgctgcctcacccccacatgcaacgcctcactgtacaaccgcgccgccgaggcaccgaccgacagccgggccccgcgccacgaacgcttcgctacgcaacaagccgagcaaagccaagcgcggcgcgacgcgacccaactggacttctcgtgcgctcgctttcctctgcctccccccaccccccgacgtgtccacctgccaaccaaagtttcccccgttcggcgaggcggtgagtgcaaagtttcggcgtcgtcgtcgtcgtcgtcgaaagggctcgcgcgcacaacggctccacaccaacaagggcagtcaaacttgcgtggtagcgtagtcatcccagtcggtggtttgttgtcctcctcattaatcttccggttgatctgtgcggcgtgcaactcgttgtgtttgttcttgaggtctttctgagtggaacatctcttggttcttgttgttgatggtgcaatatagaaacggtaatgctgcacgatcctgcttcattaccgccgcgaatcctgataagagagacagtgagtaagagcaggtacaatagcagattattaaccagattattaaccagctataaatatattttaatgatataaagatgaaagagaaaagcagcggactacaaatctgtagccagctgcagcacggactccaagagacagtgtgtgtatgacagatgggaccatatattaatagtatagtaagcaactattgtatgaattggctattagattggctacagatgaattggagctagtagagcaaggataatagtagagctcacttcatactattagcccatcttaaagccaacatatataatggattagctataaggttggctacaactttctttttctctctctatctctcacatatgcatttaatgtatttaactaggagcttgtgttaaactagttcttgcatgaaagccaatatgcttgattttttgttatctctaactcattattatacttactcatagtaggctatactattaaacttgctctaaaattcaatactctcgattcctcggcgatcgcgccaaaaacgcgacagccaaagcccaaaggaaaagaagacacaccgtgttgatgacagtacactgtagcagtgtagcatcagatatctacacatggctcaaataatcatgcaacgcatgggatggtaaaactggagaagtggatatcacttcgcacagatacgaagacacaccgtgtcgatgacagtacactgtagcagtgtagcatcagatgtctacacatggctcaaataatcatgcaacgcatgggatagtaaaactggagaagtggatatcacttcgcaaagatactaggaccagccgtattttacctcggaactcatgaaaactcgtcggcacccggacgcagtcgcctatttgctcacgaggcctcaacttcagagggtttcgtggtttcgtctgtaccgcacggtgtatggtatccgaagtgctcggtcgcatatattctgcacgaacattcagatttcccagttagtaggaagcatgaatagaaaaacgttagacggaaggatgcaggaatggggcaaaacagaggaacataagacacataaagatcagttcaaaacacaggaaagaaatattggattagaaatcaggtccatttgtacatttgcttcgtatggaaaaagctttccatgagatctgagctcatttttatttgcctctcagatcaaacattaggaagcaatccattgttccaaacaatggatatgcaaaatagattcaatccaatccaaacgaggccttatcccaggcctagattacaggtcacgtcctagtccctccataagttttcagccaagttccattctttttttcttttgtgcaaatctgtctctggttagtctctcctaacaaaattcaaacgagatgccccttcagaagaaaaaaaatctaaatcgagataaccttagtaagagacaaaacatactagatgatatgagtatatgacttgtcttttcggttccagtttaaaaactgttaatcatctcctgtttgagtgcagtatagtgaagcagctctatagtgatctttctggtattgtaaatgtggtagtaggctagtagcagaaaacatttatttctttgcaagctaatgatggattagtgattctaggaaatggatgaagaacaatggcatgaagaggagcagtttaagtctgagctgaaatgtcgagccactaaattttcctggcactcacaaacaagcaagttgcaaagtctacccattgtcctccctagagaggttgtaattgggaatataagttgttgaacggtgcattactggaatgtaaaacgtgaaaaattccttggcaaagaatgatgttgcttcttttcatgtgaaactggagtaggggtttcctcccctggttccaaaaagagataatcccttatataccactgaaaattggtctgattccttatataccattgaaaattggctcttcccttatatgccattggtctaaatttgcgcaccctctcatgccactcccatcagttgact

SEQ ID NO: 9353 - DNA, 17610 bp, Oryza sativa
  unsure (1)..(17610): unsure at all n locations
accttctgacctcattattaaaactagttactgacttactgctttagaattctcctggtcaactttttacttatatcctggctcggattcaagttcccattacactcctgcttacagcctagatagggataacatacctgaattagttactcaaacccagtagaaactgtccatcctgatttttttttctaagaaagaaacttctcccatttcagtaatgaaatgatagtagttctacaagcattccaggttcctccatcctgatatttaataagcttatgtatatagacgttccaaacataatatggaaaacatacagcccttagcatatgatgtttattagtatcaccgctctggtattcttactttttcaggaatcaagatttattatgatcattcagtgagcttgtaataatattgctaatcaacactctttctgtgatatctataacaaataaatggcatcacatgtgttttatcagagaccaataatgagtgggaaacaaaaaggaaaatcactacattggatcagctgcatacttatcattaaacaggttaggtcataaatgaaatgtacattaagctgatggcatctctgacaggcagtgaactgatgtttggggtggttggatatcctttttgttacgaattcactttgaggttgcttcccataatgattgaaaagctatgtattagtttgatttccacggctatcagagacgatttttcatggtgaaactgggatcatatccttcctgcagaactaaggaaatcataaggtctacatgtgagggttgccacttgccaaacaaatgctaccaggaaatgcaggtaagataagaacaattgattgaaatatttttgtttgcttcgccaatttagccattattatgctgattgcacgaaacaaacacactgcaaagtgttggagctaccaaaaatgtaactaattgtgcttttctatgttgaaggtacataagagtgatgttgtgttgctattagctacatgcaagtttctattcaagtatgcaaccagcagtcaaagcatttcacagatgcaacttactcctagacaaattggtaaaataacactgaacctatataggacccaggaaatattttaatacatttgcaagtgacaaccaattgctgcaataataaaccaataattagctaacctcatataaactcctgatcatctgcactaacaagaaatctcgaaatattcatttccttctcagacctatgctcttcttcttctgtgtgattgcaaaacgcctagacattgcaacattgtaaaatctcctcatatgctctgacaaccgatgtatcgcgccaaggttgcctacagctgatagccgcaacatgatagcatcaaacttcttgtacgaaagtttcatgccacggtttattacctcatctagaagagcggtcgcatcttccgttcttccagaatcaaacagcccatcaatcattgtttcgtaggtatcaacagcgcgatggcatcctctcttgtccatctcgatccaaatattgattgccctatctggctctctcatctcaaagaacatcaccatcagcatattatatgtatgaacactaggctcacaatgcgcctctatcatcctttcacagagttcaagcgcgtcatcagccttttgaagaccacaaagcaccttcagaaagcaattgtaagtgacaatgtcagggggaaagccagcctttgccatctcatctaaaacacaataagcagcatccagtttatccaccaacaacatgccttcaatcaagtctttatatgtcgacacatcaggcatacagccgcactttctcatttctgaaatcagttcaaagcactcctccatctgaccagcctttgctagcgccgcaatcataatcgagtatgtcttagccgtgggcgatgaaattgtagacccctctgttctcatgaactcaaacaaatcccttgcctctgagaccaaaccagcactgcaaaatgagtcaatggcagcattgtaagtgaagttctcaggggtgtgcttcatctgaatcatttcctcgagcaccttcatggccctcttggggtcccttgcccggcaccacccgaagaacaggatactgtatgtctcggcattccccagcagcttcctcttcacgcggctgaacaccacctccgcctcccggaccatcccgcacttgcagaaggcgtccagcagcacgttcagagcgtcggtctccggcggcgtgcgcatccgcacccgccgcttcttagccagcttcctgagatgcgtgaggtgcttctccgtgtatgcgcgcaggatacccagcaagtcgtcgaccggcacggaccttgtgcggcggcgcttcatgtggtcgagcacgtcgcagaggacgccgaactggcgggccttgtaccgcgtgccggagaggatgtcgatgacgtcgttgtacgtcgcggcctcgtgctcgtagccgtcctggtgagacgcccagacgaagaaccggaaggccagcttctcgtcgtaacggaggcgatgcagcacgtcggcgacgagcggggtggtcagctcggcgcccagcgcgtcaagggccgcctccgtgccctcgctggaacccgccgcggtctcaatcacggcgtcgtagatcctatccgagagagccgcgaaccgctcgtcctggaggtttgtggggaggacgacgtgcgtggtggagcagagccgtcgagcctggagggtcgggagatgcagctgccgcggcggtggcggcaccgaagtggggtttagccgtggggaggagcggttagcggagtgcgcggccgcgagcgaggaaaggggtgcgaccgcgagaaggcggcggaggtggcggagccggagggcgaggtggcggcagttcatgtggccgtggagcgtcagaacggcggcgcgccgcggccggcggcggtggggggactcgcgttgcggcggaggtgcgcctgagaaatcgcgtggccaacggaccgatgactgggccgtccgaatggcccatcaaaattggatagctgatccaatcggaggtctggcctgttcagatcccgttcagttcagcacttcagctacttctataataacgttataacacactaactcctaaatcttaacatgcaaatatatcaaatcatcatctactaacaagctgacacattatcatccactgacaatcattatatttaaacattatacaaacatactatactatctataatttgaaatttataaaattttagagcttttaaaataaaagcacgttaaatcatcatctttcataattcacataatatttcaatatatgttttcattattttttataatatcctatgtatctaaatagatcatccttacttggttaatgttatttctctcttatcttattaagtcatattgcatcatttttttagtgcttaaacgattaatctactatccaaattatatctctaattttcttctctcattaagccatatcgtcacaattgtttttagcttttagatgattaatctacggttcaaaccatttcactacttttcttctctcataaaatcatatcaccttacttttacatttgaaccatctttctatataccatttacattaaaattatcataaatcatgttaacttacataatcttatattatctagctattttacatattatttttacttatctattatattattaaaggaatagaaaaaggagcctccacgttcgctctcatggcctagaaattctcacattaatcggagaaaaataaaaggcagagtccatatagaaatacaattaggaaatagttgaaattaggaattaaaaataaggaatattagaagaggagactagagtccatatataaatacaatcggagaaaaataaaaggcagagtccatatagaaatacaattaggaaatagttgaaattaggaattaaaaataaggaatattagaagaggagactagagtccatatataaatacaattaggaaataactgaaatttggaattaaaaataaagaatattagaagtagagtatagagtccatatagaaatacaattaggaaataactgaaattcggaattaaaaaaaagaatattagaagtagagtatagagtccatatagaaatacaattaggaaataatagaaattcagaattaaaaataaggaatatttgaagtagagtatagagtccatatagaaataaattaagaaaaaatagaaatacagaattaaaaaacaaggaatattagaagtagagtatagagtccacataggaatttaaaactaactaaaattcggaaaaaacataataaaattaaaaagtggagtttagagtccgtataaaaatacaatttacaaaaaactaaaattcgtgattaagaaaaacatgggaagaaaagcttaaagtcaatataggaatacaacttagaagtaaatgaaattcgaaattaaaaattaaagaatattgaaagatgagtttagagtccacatagaaatacaattagaaataacaaaaatttagaaataaaactaaatattattggaagaagagcctagagtctatatataaatacaatttacagataattcggaattaaaaaaagaaatattaaaagatgagtctagagtccatataggaatatatataattcacaaataactaaaattttatgttaaaaataattaataactaacacgttgtcacgcccagaaattcactagtaatttccgaactaatttgtgcatagaaccctcgtccaggaatcagctgaggtacacaaactgacaatttaatatacagaatcatcaataatagtgttacatacttacaaaagaaaagaaaactgcagcggaatataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccatgaccgcgggcacggctattcgaatagttttactctggccagaggtgtaccactgtatccacaagacacagcctcatcaacatgtctaccatgcgtcgcgatactggaaagtacccgaatagaggctgtgacaataccctttgcacaacacaactcaccacagtgcaccattcctggatcataatcaccccctctataaatataaccagaggcatgaactccccagcgacccccacggacttctcgccgcttctcagtctggtgccccgcaatgaatcatgctatacagaaggtaaagccgttgcccatgctggcttgtggttggtacggttaatgtttcacaacagtagctcgtgaactggtccttaattgtcatgagcacgaccttcaaaaccatgtgctcacaacccaccattgtcaagttttagttatcaattaattatcataacacgattaaacatcgtgagctaccattaaatataatcataagtgatagtgtaacattagttatcctaattatgtgataatgtttctaagcatggctaagcaattatatatatatatatagcatttagctgaaccaaaccaatatataaggttcaagctaatcaatttgttacccaaggtatcaaggaataaagtaatcaatgcaaattggccataacaaaggaataggttcacaccacccggtgacattcgaaaataaatgcacagttgaaataaatagggaatttaaatatatgatcaacatgctcaaaggattgtgtttaggatctgtgtgacttgtcttgcaataatcggtcttcaattaatcttcttgaatacttccggcgcactcacgaaccttcgcaacgacggaaacgacaagctaacacgcaaaacgaagaaaaagactaataaaaaccaaataaacagtacatataaagtaaacaaacatgtagatcatgattttagatgaatttagcaacttgaaccactcaaaaccgagttacgatgatttagttatgaatttccgaagatttaatctattagaaaaacaggaaaaagaaaaaaaaacgatgatgacgtcatgatgatgacctcatcaatggccgaaccaagatggcgacctcgccggagattggatggtcggctgcgactttggaggacaagaacacgtagaggacgacgagacgaacccaacggtactcaccctcgaaccaaacgacgaacgacgacggccggcgacgacggcggggtggagcacgtggcggcggcgctacgaggcacgggagaccacgggagagggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctcctatttttgggggtaaagatagaggaggataagagaaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaagggggaagctcggctgggccgacttgggctgcacggccgtgcagacaaaagagggagatgggctggaaagggcccaagactaggaagaggattattattacttttccaattaaattaatcaatgaaatgatctttggattgttaaaaatacttcctatgctcaaataattccaagaaaaatcttgaacatacttggacacccaaagtatttaacaatattaaaaccagaccatttaatgattaatttaatatgtgggtaattactgaaatgctctttgtatgattaaaaaattaagaattgagctccgaaaaatctgagaaaatttcagagagtgtaattaatcatggagaatttaatcaaaattaaatccatccatgctttatatttagaaaattttatttcccacatttaacttcacttgtaaattaatgaacatttaatataaattctaataataatttattaaataatttataaatcctgaaacaaaaatcaggatgtgacacacgtatataaaatacaatatgaatattacacattagtagtttcgtaaagttattgaaaaatttaaaattatgttgttattttaatatatttgaataatatattgagaaaacatatatgctattatatgagagaaaatataatgatactagccgcgcagattgcgcgggccaccatactagttattattgtactacactcccacaacaacgcgtgggtttcacctagttaaatccacgcccatactcatcggacacggtgcccatgggccatgggtagcggacccagagcaggattgccattcctaatcggatcgttatagattattactatttgcttctcgcctctataaaagtatgttcccttaaaatacttatttaaaattatttgtttggtttgtttctttcaaatatttaatttatctcaattaagtagataatttttgacatatcataatctgatgaatagtttgtttcgaatgggctatgtaaattttgttaggagtatatgccactccaaatgttgtcacttgaagaataacatttataaacttgaaattgaaaaggcacatttctaaaatgtctcttctctggtgctgtttgccaccctgtgaccagattgccctgtagtctgttttgtccatcgtcgttgtatacctgacaggcgacagctatagtagttgacgttgtttccatgcattttggttgtcccattaaactcgttgtaacttttccccatttttcagcacggtttgcacgtacaaagtcaagaaaaaaaagttcatatcgttgtcatctacataaagcaatgattatccctgaaaaaaaaacatgtgaaagtatctgaatcgcttaccgtctagaagggaactaaaggtaaagtcgttcttaattgagccgactaggttgaatttgatcttgaaaattcttttctaagaattttgatgttaaccttgggcagacaaaacagtacatcaaaactattgcacatattatttgccaaaaaatagagagttattttccttttctttcagtccaggaagggataagatttcagttagttcagattgtacgaaaatactccattccaaggaggctgcattagtacttctgctatgtagtaataggcttcagtttattcagatgtattggcaaatcttacatattgatcgatcatcgatatgaattgtaaagttaaattcttaccctcggcgtccagtcgatggagatggtttaccagtcatattgacagagcctgcgcccggccgaaacggcgggtgttaatgcctaacatttcatttatgcattcgtctcctgcacaaaccacagtgtaagagctaggatgaatataattatctatccaattaaagacacaaaatgatactgcgtgcgattgttcaggcatcttttattctactgatttgctcatgtacaataatatacattcacatctaagggtgcgttctttcaaaggagattggggagagattggagatattgtcactcgttttccgcgcgcacgcttcccaaactactaaatggtgtattttttgcaaaaaatttctatatgaaagttgttttaaaaaatcatattagtccatttttgaaatttaaaatagttaatactcaattaatcatgcactaatgactcacctcgttttacgtatctttccaatcttctcaatcccctctccctcaaacacagcctaagtttctagttccaaaaaaaaaaaagcatctaagtttcttcaacctagtatgtatattatttcgcctttgctattctgcagtcacctgattgatcaataggtgctcccataatatttgggcatatcggcgttgataatatacctagtacagagtacagaatacagtcccaccgacaaaaaaagaccatttctttctttcatgtgggaaaatgcatgacgtcaagttcaactgttcaagtttctcactcaaaacttctgttcgttttctatgttcgaacttgcctggtagctgccttctccacgtccacagccgccgccgccgccgagctggccacagtgcaaccagggtactgtgcagtcccatgagcagaaccgtcgtcggcaacatcgacggcggccacgcgcttccctttcaccttcgtcaccgacgacgacgaggatgatgacacttccacctgggtgctatccggcgttctcctcgacgacggggagaggaaagacagctttcctgacaaagaatttgagagaaaagatgaccatctgcccgaccgcgaaaaccgggggctgcaccgagcgcccatgccgaccccttccccgagtctcctcccgcggcgcacgctctgctcccccgccgcgaccatctccctgtgtacgtgctccggcagccgcagcgtgtaccgctctaggtcgccgtcgagccggacggcgagggagtggccagtggagtgcgaccggggaagcttcgccgccgacgtctttggccgcagccccgaccgtgaccgcatcgcgcggagctgggtgcctatcgcctgaagctctagctcctccttcctccgctcctcgtcgtcctcctcggtgaccacgtcgatcaccacggctgctgggtgcgccccgtcttcttgccgtatcacaactatttcactggaggtgctgttcggatcggcggcggcggcggccgggatgatcacctcttcggtggtgtccttgttagggtcgagattgcggcggcagacggggcaggtcacgtggctggcgagccactggccgatgcagtccgggtggaaggcgtggctgcacttgggcaggaacctgagcatctcgtcgtcctcgaactcgctgaggcacaccgcgcactccagcgcggcgccggcgaccttccccacccgcagcgccttcgcctcggcgtacttcatggtggggaacatccggaccaccgacgagtcgagcccgcgcggccgccgctgccgcctcgagacgaagctgttggcagggaggatcatggaacggctcccgccgacgccgccgccctccgtcgcggggtcgtaaccggtgcagtggcggaggtagatggtggagatcgcgatgaacaggaaaaccccgacgacggcggccagcagcacgatcatcgtcgtgctgacgtgcacctgctgcccggacacgtcgccgtaggcatacccctgctgccccgccggctgcgctccggccgtcgacgacgacgccgcgagcgcgcacgcgaggagcgccgcgagcagcgcgtgctggtgctggtgcgcgtgcatcctagctcggcaacttggcatgcagatagcgcgcgtggtcggcggcgggaggcgagggcgccttggctagtcgtcttccctgcgcatgcagcgtgcggagtcgtactaaatagtaaagggccgtgtaggagtggtcaagtcgaggtgagctgtgacctgtgaggaggacgatcgacgagaacgtcgcgatagcgtggcgcgcgccgggtctcgcgggaggatgtggattccgctgtccggccaggtggatacgctgtttggcaggtttgactgtacgatcgaaccgtccaggtgttcagaagcagtgtggtgactgggcatgccagttggatttggaccttggactcctctgatttcagctacgtgtctacctgtcaggtctgtaacggacccagaaacggttaacagttaaaccactaaaaaaagcaagtccacatgtagcttgaatcaacggttacaggctcggaaacaaaggtgaatctagctcgtaattaattaggtattaattaatataagcttaaaaataaatttattttttatataaaacatactccgtttagccgtccagtaaacctattaacaaacaaaaaggagttgcccaaagcaatagccgctttgaaaggaacaggtactaagggcagtcccaacctatggtgtccataagtagtgtctatggtgccatgtcaataagacatcacaatagaaactatactctacaacccatactttcttaaattagaccattaataaatacatcatctttcttctctaccaatcatatttattctttatctattatgaagacaatattctctcccaatgcaaaacttgataattctctcccaatgcaaaacttgatagtgtctagtgcataggttctcgtgttgaagttgtgtcttgcatgagacccagtttcttcctctcttcactctctctcaattaatatagtgccacataaactaaaagtcctacatggcaatgtagttaatgccatagacaccatcctagatggagggctgggactgccctaagagatgttgcaaatgattcattctagtgtataacggaaggattaatcaatgcgtacaaatatatctatgaaaatgaaataaatagttgtgctaaataaaatccaatcttttatagatattaggataatcctaacctttcatttatttattaattaaaagctataaccaagctattaatattatacattccgcagcccatatgtctgcatcgcaaaagcattaacggttgctaacataactcgaatgataagacatttttagaagcaaattgtattgctaaatttccatccatgattagaagtatagccatcatctctaaataatggcatgttgcatcatttcttggtcctcctcacaccttcaaaatccaatcgcacttttaaatctaacctcgtgtaaaattgtgcaacaaacagcctcattggggcctttcaacttataggcagttgccaaattttaaattttaaaactcaacttttaagttgattttaaggttttttcaattgtaatttgtttctaacattggttttaaaatcattaatgacacgtatataaaattttatccatgaattcatttttatgttgctgataaaatattatgttttataatcaacataaattcgcgtgccagttgagtgacgcatttgtgggttccaccctcttattcattgatcaggtgtacggtatctttatatgtttttcatgcgttttgcaacttgataaccattgcccataacgtatatgcatgatatgcatcgattgtacagctatgaacatcaatgagacaatgaccgtacgtgcaagtacaagcagggagccagggatcagctccggcgatgcttttattactctccctatcccatattataaatgatttttaagggatatgacacatcgacagaacattgtaaagttctttgatatataagagaagaaatgagggaattatattttttcccgagccatgaaaacaaaagtgggttgctccaagcttatatggccttccagttgcagcaataaagctaaccttcgtttccgtaaaaccagtacagtataaagaccctatttagattctaacttttttttcaaacttttaactttttcgtcacatcgaacttttctacgcatacaaactttcaatttttccgtcacatcgtttcaatttttttaaacttttaattttagtgtggaagtaaacacagccaaaggcgagcgaaagaattccttgaaacggacttcaaaacaattgacttccttcgcttcgctcaccccaattcccacggagcaacgacgacgcctgtcacgtcacctgaggcgacaggccaaaccgacgatctcccaacgaacgactctgatcgagagctgacccgatcgtcgcgtggcacgtcggcgtgcgccacccccgggcaaagtggcggcccacgtacatacgtagtacagctctagcttggccgtgcgcggcgcggtccacgcgctatccagctgctctactcgtcagtgtggctggccaagtggccgcccgcatgccaagccgacacccgcaggagacggcacaggacaccacgccacaccacacttgcgcggccgcgagagcgacccgtaaggcatagataggctccgctcgccacgactacggcctgggccactgggcgagagggacgccggcgccacgggcgccaagctagtcggagtaggacgcgggaggctatcgcgcgcttggccgattccatcgtggggtccgggtgctcgtcgcgtcgcgtcgcgcgcgcggctcccgcggatgcgggggcagccactcgttcggcgtgcggtggcgcaacgcaacgtgcggtggatatggacgccaggtgcgctgtttgaggggtgcaaggcaccggagccggcgcggcgcgggcgtagatgccaaaaccggcaaactgttcgacccttgtgttatttacgtatgcgcgtcgatctggagagttctggaggattcacgccattcgcgagctgtgggtgatttttcttttagcaagcggcaaaatatggatcatcttccgttagcacgttttctaactaatacacacacaagtgttccctaaaataccatatcactttttaaattttttatagcaattaatatcgattaatcatacaccaattatttaactcgttttacgtgccgtcaatctatttaggcgaaatattaagtcggacgcaccggggtttcatgcatggggattgaatcggaggtttggtcctgcgcgtttggtgtggaaaaacaaatctgtcaggatcgatgtgcatgtcgtagaatttcgcaggttagcttattactaattgcgatgaagaattctacgtgctcgttgatcgtcttcggttgctaacccagatgcaacgtacggcactagctagctgctagttagagagtataataaacacgggtttaatttttgttacatgcatgacgaacgtaatgaggtttcaaacgaggaaactacacgccagggcacccacaaagacgtgatggcacgcttttgtggggcaccgtgtgcgaaagcatgaattctagaatcgtttggcatgtttgtttttttgctctcaaacgccaacgaaaatgaacgcagaatccaaggtcacaggaggacattcttcctagtctaccactccgatattatattgttcgtaagtgtagcttttagaattttgacagttaacttatgaaaatgttatatttgtttacaaattagaaaaaaagtacgaattaccccccccacacacaaaaacagacatattaaacctcaaactattaaaaccggacaaattaccctccaactcaatctggagcggttttaatcctacgtgacatacacgtgacaccgacgtggaaatccaatcagcaaaaaataaaataaagaaaatataggacccacaagtcattctattattgtgtgttgtggcgttggaacttaagacgcgagcagctacgcgcacagcgggcgcgactccgatcagcggcaattggcgacgggcgtggctgggcgagcggcagtgggagcggcagggaaggggaatcggtcggtggcgacaggagcggttgggcgagcagtggcaggagcaagcagggagaggaggaggaggagcccgtggtggcaacggtggcccaccgcgcgtccccgtgcgcccacgacaaggaggagcccgcggtggtggcggtggtccaccgcgcgcccacgacgaggaggaggagcccgccgcccaccgcgcatccccgcacgcccgatcgacctccgcctccatcgctggccaccaccgtcctcggcgctcctccgccacccctaactggctccgccccccgcgcgccgccatcctcagctcgccaccgccggtggggattgaggtgaggggagggcagagatagagaggaatgggaaagagagataaaaactgacatgtggggcccaccttttttttataaaagaaagctgactggactgccacgtaggataaaaaccaccgctgattgagtcaagggggttatttttttggtttgcatagttgggggtgaaaaatgtctggttttatggtttagaggtgtaattcgatcggccgttatagttccgggggcggggggatttgtactttttccttacaaatttctttcatatgtttcttgttttgctgtttctgctaatatcagtgaaaggtattgataccggattgtattggtcctattggagagatggagacagaactttgaacatttcgtttccgctccatttcagtgcatgtcactgccaccgcctcatacgttaggcttccatttccatccttgttcgccaatcgttcaggactttcaagtttctttcctcccttccgttcctgtatacggaagtccgaatggacaaaactcaaaagtctacccagctgtgggccgtgggtaagaggcttcctctgttctgcgccacagagcctcacgcatcggcccaaccagcttcgagctgtgggccgccattgcctcatacagtcatactccacgttgcttgtttcagccggagaaatgtctcgattgctaccgcgagtttgtacatgtgcatgccgtgaggaacctcatcggtgcacgtagaaacaaaaccaaaaggtatcaactttttatcgttccggccacactttacatctccgtacgatgctgccatctgacgctacccacgctacctttcaccagaatcaccagcggcatctcctctcaccaatcacttgcccaccctgcctacacattcccggatacccctctccccgcacggtgagctgcaagcttggaaccacaatgtctggcacggcacctgcatcactctgcaggtttctgaaagagctagcaccggcaccagcccaccagcggctaccaaccaacagtgccatccaacagcggcgagctcgatcggcagcatcagagattttccggatgccgccatggacgccggtgtccgcacgcggcctatatgctcgccgccaccaccgtgggtgccggactgaatgccaccagccgagcgatcgatcgatcgataaagcgcagctcgtgttgcgtccgggagagcagacaggtgcctgcaggtctctccaactctgctttgtacgaatcgagaagtagcaggaggagcagtacactagtacttgcatcgggagcgttttgtcctggttcgagcgttgataaagtgattgttcttttccgagtgaactgtttcaagcatgggctgggcacaccgtcgtgttcgtgtcaggtcggtcgtttgagacgagagaatcaggggatgggaacaagaggcggctaacggcgatcggttgatcttcttctctggtaggaggagcactgatgatggtggcacggcaccgtgcaattagtcaacaggatcattggcggctagcattcatggttgaacttgatgcgtcctttcacaagaagcacgacatatactgagcatctaatcggtctcctcatcttcttctgaacttcatatcaaaaagttcctaacctcacccggtatttagtgagaactgttgcttcttctttctgaatcatggaattcttgcatcggaaaatctatcgatctcgtggctcccccactgatgagacgctgcgtagatgaggcagcagctttcgaccgtggggcaccgagctagctggcgactcctatttaaacctctactataactggcggattgtacacctaattgtcatttcctgtggcgattacaacttgtttatttggactgactagtcattgtccattacgtgggggtacacccccaatcaattcgttaagcatttctttttctcgcaaaaaagggtgcaagactacagggaccctgatcaagagcacataactacatactacttccctgcactcccactctgactctcaaagtctattctactgtttgtatgcattacctttttcaacaaggacaaggaagatggaatcaaagaataaccaatgcgtactgcaccagataattagcccacaaaaggatgattagttgatccctaattaagctaaagctatgctaatccaagcaagctaccatacgcgaacgtggcatcgggcgacaggccggacacgaggatacgtgtggtttgcctcccctggactcgccatgtatataccccatattcccttcttcttccccgtgccgtggcaggttgggtcgttgtccccatagcacatccatgatattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9354 - DNA, 1079 bp, Oryza sativa
attcctgcagccctgattgttcgtgacggcttgtatagtatagtaatggtggtcgagctagtgaaaggcaaagctacatgccactatgctagagattctggcgaagttcatggagtatgttttcgggctgattccaaaatgttttgataggtgctcagcgtcatatatttctcctgccttaatggttgagctaattattactctcttatattataagctttgattttattcctaaacaaatttaaaaagtttataaccaaaattatagaaaggcataattacattttcaacacaatgtactatcagaatatattcaatattacatttagtgaaactaatttggtttgattttattcctaaacaaatttaaaaagtttataaccaaaattatagaaaggcataattacattttcaacacaaaatgtactatcacaatatattcaacattacatttagtgaaactaatttggtgttatagatgtatatttttttttgtaaatttgatcaaatctaaaaaagttttgagtttggctaggaaacaaagtgagcacataccaagaaaaataaacagagcaactaaaaatattgatttctgtaacttttcgccgtttgaaagccaaggctttgatgcaaaaccacctagtttaatttaaagttagtttaaatattcaaaatttggctgcatcagtacgaaataaactattttggataagtttggaatgaactgccaattagaggcgtcaccggttgagcatcaccagttcaccaccacacggccttctgcttacctgaacatatcatgccagtatgccacattgccactgccgtctcagtcaaagtaatgcaacaaggtaacggcatgaaacttgttataacaaagagacgacgaattcagcaaaagtaatacgaaaatgtacggcccgaaacttattatcgtgtccatagacgatggtgtaacgttacttggtcaataacatagaacattccagcggtagcacgcagcagtgttgtgacgttacaattatttcagtactcatggaattttagatccatccggaattacatgatgcgtttactgg

SEQ ID NO: 9355 - DNA, 21061 bp, Oryza sativa
caagtttatacagcaacagaaatacagtattgcagttcgaatatgccttacaccagtttatatagcaaccagaataaatcaaggatacatgagagtgtgtcatcataacgagaagacacaactggcaagttatgatcaaactaaatgcaacataaacagtgaaggcaacagtgcacctttctagctatatcataaatctgattagataatctcaactgtacaattgaaaaaaaatcacaaacagcagtgatctcatgttcttattcatcattagtcaatgcgaggaactactttcgtgaaataaaatgaaattggcaatcgggataactagatgattaatcccttgatgagataacaactttttttttgtttccaccatgtaaccacagaatctaggaacatatgcaccgattaccaactggcagaatcattgtgtatgaattgaatagttatttgagatgagattacctttgatcaccgaccctggcctatattgaaactgaatggctcctggcctgcgtcctttgtgctgagagaaacaaaggacacaacatcagatgaaatttctatcttgtctgaatatttttgggggaaaataactttatccaaaattacctccaagaattttgatttgtgaggtctaacgataaattttctacccataaacaacaaatacacagcattggctgaaccaacgccacgcgacgcgccatccaagttacaacagaacaagaaaagaaaaaggatagtttttgtacctccaaaacttcttagcgagatcattatctttccctgcagaaaagaaagcagcatggcaaggaaaccaagttaggcttaactactccaaaacagaaactcagaaatctatccacaaaccggacagaggtaaactagcagctgcgatttgaatctaaaccatctatccaaaagacaatcctggcatcaaacatgagatccaacaagaaatggatctgggaacgaaccaccttgttcttaccgctcaggttgattcagctaagcacacgcacggatccaagaaaagaaaaagcatgaaaggaaatgttctgggggagatagggagggaggaaagcggcgaaccgaagccggtgcagtggacggtgaccttctggcccttgacgggcttgggaccggtgccggctttcaggatcgtcttctcgaagcccatcctctcttcttcttcttcttcctctccgcttgcctctcctcccttcttctcgattggactctcctcggcggcggcgctctgtgctagtatgatcagtggtggattggtggtgccgtgcggctcgcccttatagagcgctagtagattccttttttattacaccaccaatccactacttttttttattacacgactttctggtggtgtaattgttccggcgtctcctgggccgttggatggagagacgatcttttcagtcctacggtccagcttcaatggttttcttcttttttttcgcaataaaattgcatccgacctctacgtatataggttgcgcacaaccataaaaacatgggaaaccgctcaaaaaataaaaacatgggaaagaaactggaataacataaacataacggtaaacataacggaaaatactatgcgtacgatattttgttacattcctataacgatctcgaaaaatatattttgtgtcgtcctatgaaaaacctattaaaagaaccatacaatattagtcgtgaggctacaaatgccgtattaagctgctgaccggccattgactaagggggtgatgggttggttgtctcactttaccataccacactttagtcatatcacgattatttagtcatgtgattgtttcacttcacaattatgcacactttcttactcttaagacctacccgcactttcaaatttgtaactaaacatatcacacatgcgggcgagaaatttgtaatattgggactgcaaacacgagagcttcgctgttttgacactccgagtggatgacaaatgggtccatctgtgtctataaaatgtgagcctagtgttattatagcaaaggttaatgtttgcaatgtcataattgtaaatcccccctgcgggctataaccaactatttcttagacatattacttgtctaaccttagttatgtcaaagttaggtatcaaccaaacaacccataatcttcctaataacaacatatgatgcctctcatgtaatctctcttgcttgatcgtcataacaaaagaagaaatgataattgcttatgagaaaacaaaatgtgtgttatagaatactctctccatcccataatataacaatttagtactatataatatagtgatgtatccgattcgtagtactatgatgtatcctatccagtaatagatggcaatattaataaatgatgtgcttaacctaagaaagaagtaacaaggcttgaatatgggatttttaacctcgctaaaaaaatcttgttcaaaacacactagcacgtccaacaccaatatatcgttatggtggtagaacaagtatcaacaccaatatattggtttggatcgctagtttttctttgaattttttctctaaaattaactgcaccatggtacaatacaaatatacaatgatcaatgcatgattaataacttctattgtgtaaacgcagacgctcataatacaaacacattaaaaaaacttttattgtagatgtacgcttataatgcaaacacattaaaaacacttttattgtactcttttcatactatgaatctaaactaggatatatcttatacaatcaaaatttcttatattattagacgagggagtatatgctaatctaacgatttataatattgctgattttcccgagctgttacaactccaccagaccagatactgtcgcaaaccatccatccccagtcccccactgtgcccccgaccggaccgctcgcttcccaccggaccgttccgaagccacccaacctagcgcggtaccgcccccataaacacggggacacacccggcgcgccgccgctcatcgccatccacccgcaccctcccaattcttcccacgaaaacctcccaaattccgtagccgatctctcccccccaccggcggccgccgccgatggagacctaacgccggatcgatctctcccaccggcccgaggcgggtgaggcagggcgcgtcgcctccatggagaccgagcggatccgtcacctcctcctcctcacgctccgcgcgccgcacgcccgcctcgccctcgtgggtggcaaccacaccgccgcccgcttctgcacccgctaatccccccctccctcgccggaagactcatcatcctcttcgtcttcgccaccgtctctgtgcggtatagctctctctctcgctcgctcgctcagatgccggacggctgcgtggtgatccggctcccggacccgcgcgtcctccgcgtgatcgcgcgctcggtgctcctcgccgtcgcgctgctctccctggcctggctccgcgatgccgaggcccccgccggggacgcgctccaggtggggctcctgctccgcgacctccgccgcgagggcctgctcgcccccggcgcgcgcgccgtcttcctcggcgccgccgatggagactgccaccaccaccctcccgccctcgacggcgacgacatgcgacgcatcacgccgcgggagttgctgacgacgggggacctgtccgtcgacttcgtgctggatttcggctacttcgacaaggacggcgacagggttggcctcgtcgacagggtgctcaaggatggcggcatctttgccgccccaattggctcggcgagcgagttccgcttgccgccgaactaccgcgtggtttacatccgtcggttcaccgagactttcgtcgggatcaagaagattgcccgcgtcggcggcgacaatgggattgccggcgccagaacagggatggcagcgacgactcctgctctgaaggaaggagttcttgcgttttctgctcaaacagctgacactgccctcgctgaactcaagaacttcaggaggaagctcttactgcctcacatcactggagcatcagcggctcacgcgcatcaagcgtggctaaaattgcgtcatcgtccagtgattgcagttgatttcccagcaatgtggaatgtgaataagctgcagccagcacatcctctcgtccttcaggataaggctgttcatggagcgcaacagcagcagctcaacaggagcgtgagactgaacccatctacaggatattgaaacgaagcctgaattggaacagggaaaaagctcaactgaagaagagcattcttgtccattgcaaatccaggggggtgatgctctctgcctgccaaaagaaatggttggtttgcttttttctgaagttctttatttaagttgtctgtcgtgcgtgatgattgagtttgatggtgtgctactgcttaccagtatgtgtgtatgcttcgttcgatagtctccaatttgttgttttgtattcagtggtgactggtgatctactgatctccaattgcactactgtatggtatccgtttggaatgagcattgttcgtcttgatcacctatccttgttatcacgcttgtgcttcagcatgtgcatctctgaataatgcaatcgtagcagttcggcatctggttataagatgcagtactgactactgagaagtcagaactgctgttttttactcttgcatattcaattctttgcaaatttccacgcgtataagattatgatatgaaacaaggctggaaattggaatagtttactttggacatctcaaggaacataaaagtatgacaggattcatacaaaagggaactcacttctgccaagtttgtgatgtttagcacagaacaaatacaagaatatacaaaacaatgtgctacatggcacatttatttctacaattgaacaatcaatacatatttccttgctcaaatgcacgcgacaactatcatccgtaaataccaccatgtgacaaaaagatgcacaacaaactagtctccaaatgtgaaatatgcagtaccattacggatgatagcgcagtagcaacctcagaggcttgacttaaagtgcagcaaagaatactgatcgaagatggctcaagtgcctttgattacaacaactggacagaccacattgttgatgcagtagttgctcacacttcctaagaacattctgtagaacaaaaccaactcagaatttcaatcagaaaccaaaacaagacgattcatatttgatatagaaaaaaaaggggaataaataagctgacaatcaaacaaaatcaagcaagaagtacttaaaaatcttcatgacctagatacatgaacactagatcaactgcactccataaaataggagtcagttgcgccgagcatttgaagattgtatgggtataggtatggcgagcaggccagccccccttggattttaggttcttaactaccgaagtgaagaaaagctggatcaagaaaaggaggggcactactagccctctgccccatgcatctaaccaatgtctgccttagtgtactcttagagcatcgccaagagactagccagatggctctccaagttaaaatttggctaagttgggcaaaaaatctactccaacagactagtcaaatggctctccaagccatccggctggctaaattccccacctcactagccaaagttggcaagccatccggtgtgggttccacccgtctcctctctctccccctttccccatcccgtccgtccgccactccctccctacctgccgcgaaatctgcccagctactgtcgtccatggtcgccgccgccgaatttccgtcctacgtctccgtgccgccgtccgacctgcaccgccacctcggcaagctgctcaccagtggggacggcacggacgtcactctcgaggccggcggcgagacgtacaaggcgcacaggtccgtgctcgccgcccgctcgtccgtgctcaaggcggagctcctcggcccgatggcgcagccgcggagcaccgccgccgccacgccaacgcgcatcaacgacatcgaggcgccggtgttcagggcgatgctgcacttcatatacaccgaccacctgagctcgaccatggcgaccgacggcttcgagcatctcaccacaagctgccctgccattctcaaggagctcatgtccaagcttgttgttcactgaacactgaatattcagcagaagcatattaagtaggatggtgtcaattcagagctagtgtgtgattctactctggagtgtcaaatagctagacctatgtataattatcgtcatctggttcgatctggtgctaatcccgtgtataattattatctgtcatctaggctagtttagatggtgtgatgcatcatgctcctcctctctatgtttgttttggtttgtggttgtatccagcatggacagagcagtatcggtcaaatgtatggtgatagcctgcaactgtcctcggctccgcctcctcctcaaccgggcacccgtcgtcggcaccgctgcccgccatccaccgtgctgccgccacatggggggcttggcgccgtccggagcacgacgccgcttctgccagggccgccgacgctggggagacggctcccggtgtgcctccaccgctgacgacttcacggagcccggcgaccccgaggcacgccatggtcatcctcacagcgccaccgtcgtcgtcctcacagcgccgccgtcatcgtcctcctagtgtcgcccgtcctagcgccgccgtcatcgccttccctcgccgtcgccgtcgactcgcacgggagaaagaggaagaagggggagaggaggaagaagcagtgattgacatgtagggaccctgtgtcatagactgaaaatagaggggtagatggagaggccgttggagtaaataactagtttggctagccaaatcagatgaaaagttggctatatgggtgtttggagagttcgatttggagaggtcgttggagatgctcttatggccatcatctacttaggctgcagaagtagggttggctactgtgagaaacttccatgtcgaagcataaccaagtccaaactagtagcaaaattaaatgacccaatgcaagctaatggttccactccctgctcactgaatgcttcacttgtgttgtcagtattcacttttatgaaaaaaaatgctggtgccacttgacaaacaacgagattgcttagctgtcttacagggtttgtgtcaggttccagaaatcatctcttgattaggctaggaataagaataggagtatcaaataagcaagacacatagaacgattcgcaaatactacagaatgttttatttttccagtttcaaagctcagatttgcacataaatcttgcgttaaaagcttataaacaggtcaagaactgaacttggagttggagcaaaacaagtgaacagataactattataaaattactgttgcccaaaaaaccaactttcccaacaggcccctgcctgatgatggcaatatggtttcagtaactagaatttcccagatagcttatcccccccccccggcccccctaaccattgtgtcatgtgcatcttccaatggcctgaaaattccctgatgtgtagcctagccccaccagcagtactgaatactgattccccatatattgcagaatgtgatacaatttactatggaattgccctctcaaaaaaaaaaactacggaattgcaggtctgttccctattaagtggacagaatcaaaccacgccaagttagctaaccagtgcagagagagtgcttattatccattacctcttgagggggccaaaagcacggcaccccatgacgagcagatcggccttgagatttgccgtcacctcgcagatcttctccttaggatccccaacgaccacatccgtcttcacctccacctgcaagaagatcatcccaatcatcaaacgagaaggctagaaatcaaaatcgtcgagcaattgtcagcacaaatgtggttccccttacattcttctcggagcaaatcttgagcgcgtgatccaggatagcctgcgtgatccgccgctggtgcgcctcgatcgcctgcgtgaacgccggcacctccacctcgcctgatcagccgcgcgtcacattcaggaagccatcaaacccagctcgaccaaacaaatttcgcaagaaccacagctcacagccacaggaccaagtgtccgtcctgatttccgcgaagacgagtgcgagagattgcttactcgggccgccgaaggggatgggtccggggttgagcccggcggcgatgctcggcggcggctggacgtggagcacgacgagcgcgccgtcggggcggaggcggaggttgtcgagcgcccaccgcagcgcgttcatgctctcctcgctcccgtccaccgccaccaccacgctggccaggttgccggtcgccatggcgagctccctcagctccggcccgagctcgcctcctcgcgcagtcaggggtcgcggaggcgcggcgatggttgcgtcgcgtgcttgcttcttctcctctcgtgctcagctcgatcaaacgagatgactacgcagccttccgctgagctgtgcaagtgactccttgactctctctctcttgtcatgtcacatggccgtctgatgcgctttgggttgggaagcttggatccgtcggatcaacggatcgagagatcgcacggctcagatgacctgctccagtcgcttaccaccgggctgctttcttcaagcatgaaccgcgctgatcaactgactggttgtctattaaggtgtgttttagggataggagattgataaaattgggaagatacgtaaaacgaggtaagccattagcgaatgattaattgagtataaactaatataaatttcaaaaatggattaatatgattttttaaaacaactttcctatagaaaaattttgcaaaaaacgcatcgtttagtaatttgggaagcgtgtgctcagaaaacaatgtactttctaactcaatgtatctagaacgaatgcagcctaagtggagtactccctccgtcccaaaataagtgtagttttgcactattcacgttcgacgtttgaccgttcgtcttatttaaaatttttttatgattagtatttttattgctattagatgataaaatatgaatagtattttatgtgtgactaaatatttttcaaatttttcacaaattttttaaataagacggacggtcaaacgttgggcacggatatccacggctgcacttattttgggacggaggtagtagtaatttggttgggtggaagtagtattactgatatgacagcagcgctgagattactgcaaggtaggaagagcaagtttaatagcatagtcgactactaactccaaatcatctataaccaatgtaatagtaaactcatacaataattgcttactatactattaatatgtggttccacatgtcatacacacattacgtcttgaagtctgtgctgcaattggctatagatctatagcccgttgctcttctattccttcttctatcttcttaaaatatatttatagctgtcttatagcctactattgtacctgctctaagagcaagtataatagtagactgtaagtcggctaaatgctgaggtgaagaagagaagagaggagaagcgagctgtaaacttatagctggtttggacacaagaactaaaaaattaaaaaattatgtgagatagacaagtgggtcctgtattaattgtaaatagctaactattatatgtgtgggtaaaaaaaaagctataaactactttataattaataagttggctgtattattatccttgctgtaacagcgttgcacatgaagtgatggtgcagtgattcagtgcaggtggatgtggtttgacccgccattgatccatcggttattcggttgttcctcccggcacgacagggttcacagttgttaaaccccggaaaagtcttcgtcgcattacagcctgctctgaatctccatcttgtaaattacttccttcgtaaaaagaaaaaaaatatattcctagcatctcaaaataaaattagtggatatgtagaagaactaaaatatccttaatcatgaaaaaaattagtaagagtaatatgtataggtaaagaatattatagggataaaacttctcattttacgtgctgagggtaggggtggacaaaaagcttgggctcgtgagctcggctcaggcttggctcgggctcgcatagctcggctcggctcgaaagccaaacgagtcgagcctaagcctccttcctaactcgtttccgaaacgagccaagcccgagctggctcacgagccgctcgtgagctcgcttggctcactgcaatagggtcatatgcaaaaattttgcaccttttctaactatttatttgttaaaaatgataactttaattgtcatattatatatttatgtgttgtgatgacatattaaagaaaaattatcacattattacacattctatgtggtaaaatgttgttcgatttctcttagatttgcttgagatttactcgatgccaggctcgcgagccagctcagcccataaacgagccgagccgagcttcccttgcaccaagctttcacgagctaagccaggctcagctcggctcgtttccacccctagctgaggataggtaggatggtagaagttagtttttgtgggataaaatttaaactctagaaattgagtttttttacgatggagggattaaacgctgttttaaagcgttcgtttctcatgaaaagggtggatgaaattttggatactcgtggcacgcttttcaatatgctaaacggtgcgtttcgtgcgaaaactttttatataaaagttgttctaaaatatatgattaatccatttttcaagtttgtaataattaaaactcaattaattacacgttattaccacctggttttacgtgaaacacttaatttttatcttcatctccatcttcagaagattcaaataccaactgaatttcttgcaaggtcaataaccagacatgattctgacaaggaacggtgtttcggcaggctcgtagcctcctgccagcatgaacggatgaaccgaacttcttgacattggcaatggcaaagcgtgcttcgaggttagagcgtctctcatctggggacgagttttgccttcacacaggcatgcgagagcacagcgcactacagactacagtctgcatatctgcacaaggcttgtagcatctagcagttcatcctttttttttttacgtcttgcgaagttctagagcagaaaaaaattataatgttactaccctggaggatcgtaaccaagaaaaagaaaaaaatataccaccacccacacgacgacatcgccatcacacaaggccaggagaaggctaacaccggaccggctgccgctaagcgtgaccgaccgccactaggccaacaaagggacacagacgaggtcgccacctaggggatgccaaaacgacgtcttcaagaagagaagcgacagagaaaccgccgccgtcatccgtcaggactcaaaagagccaagacagggctttcgcccggcaatcaccctttaggggtgagacagcacgacaacgccctcaggaggggggataaccatcgttgtctgtccgaccaaggccggactgggttttcacccgtcgctcaccacttgcgaatccacgcgtgacgcaccgatgctccaccaccacacaagctttgtcgacatgtgggacccctgcaccggtgtcccccgccggccagtcttcattcgccaaagaccgcaccacacccaccggcagctcctcctcacacctaggtcgcctcctccaccgccggccgcgccactctgcgccaagccggcctcctccaccggacgcgcctcgcgctaatccggtctccctccatcggtcgcgcctcccgcgccaagccggcctctatctctgccgctcgcgcctctcgcgccgagccggcctccactgtcatcggctgcgcttctctgcgccaagccggtctccgacccctccaccaaacgatgccgcgccggccagatgtagtcgtctcccacgccctcagctagccgtttgaggtagccatgcctccagtgactgcagacacggtcgccaccaccgcagccgctgctgcctaacgcccagccacctcgccgtcgccatcctcgcctcgcagccgactccttccccgccgccgacgtcgccaccgcctccacaaacggccgccgtcgtcgctgccaccgacgccagcccccgcatccacaacctgccgctgtgtcgtcgcccttcaccaacatgcggctggccgccgcccgatgccatgtgcaccactgccgccatcaccagccgacaccgcagccgccaactgccgcaaccgccgccgtcatcgccaactgccaccactgccattgccacaccgccgccgtcgtcgccgcacagccgccgcctgtaggatcgagatgtcgactagagggggggtgaataggcgatttaaaactaaatgacacctaatcaaaactaacctaagttgctaggcttggtgagggtcaactctaactaagcaactaagttatgttttgcaaacctaaagtgatagtggctcaattatatctctaggaaaagtaaatcacactcctatgtcaatgtttagcaatcctagggtgatatgatttcaagtatgtctctagaaatgtaaattgcacaaatgtaaatgcgacaatcaaattagacaaggggacaagagatttttcaccgaggttcggaaactcgccggtttcctactccccgttgaggcgagcccaactcgaccactcaaccacgaagccaccgcacgcccccttcatcaaggggtgggcaaggcgggagccgacccacggagaggactacccaagcctcgatcactagggtagttcttcctttactccgaaggtggtgaacaccaaaccactcacaaaccggcgccgggcctcctccacaatcttctcggagaagtcaccgggcaacttctccacaagccgtctaggaggcggcaacctacaagagtaacaagcaatgacccagcgtggagatgatcaatcaagtgccacactagctctacaaatggaagcgatgcacttgactcttggctaatcaaccctctaacacactagatagatgaacacaaagctcaagtgggtgtgagagaggtgcaagggatgtatgcaattgaattgggtgccaagagagtccccttgttgctggtggggaagtatttatactcccacccaccaaaactagccgttgggggcgaaatcccccaactttgtgctctgccggtctgaccggaggtatgtagccggtcagatcgtgctactctgcaacggctagaaaactagccgttgaagtgctgtcagagggctccatcggcctggccggtcagaccagtgttgagtgggcggtcagaccggcctcggctcggtcagaccgccatcggctcggtctgaccgactacggctccgtcggctctgtatcggccaccccgagcagcaccatcccggcctccaggggccggtctgaccgcgcatgtaccgccggtcagaccggccttatgcgccggtcagaccgccttcttgcggccggtcagaccggccaaggcacgccggtcagaccgccattatgtggccggtctgaccgcccctggtcaggccgagcccagtgaaatcccaagtgattgtgtgtgtgtgatgaaaagcgagcacacgtctaaatgcataatgacctaatgtggcaatttaatcatctctttactaggtcattacccctcttaatagtacggcgaaactagaaaataaactagcaaatttgacgccctacacctcgatcaattctaaattaaagcactagttttaccgtcttgtttttctttgctttgcgtcgtcaattttaatccatcgatagtcatccacgcgcacacatgatgtggacctaacttaaaatattatctcaatagcaacggtttgtccacaattagcgcttgtcattaattaccaaaattaacaacgggggcctagatgcttcaccgccaactgccgccggccaccctccaaatccggccgagaggcgcggatctgggggacaccgcgccgccgccgccgggcaccgcgtcatcgccaccacaagcccacacgggaccaccaccaccaccttcgcgcccgctgccggttccgtccccgccaccatcgccatccctgccgccatcagccgccgccgcccggcgccgcacgcccctgccttcgacgtcgccatccccgccgccgtcctccccgccgccagtcgccgccccgccagatccggccagagcggcctggatctggcggtcaccgccatcccgcttggtggctcccctgcccgcccggtgagaggtcggcgaggggccctgccgccgccgtccttgcggccggccggcggccgctcgagcagcagcgaggcagaggggatggggggagggagaggagcggccgggtcgtcacctcctgtgccgcccaaggggaggacgacgcgaggtagtcttctcttctgacgtggaacatagttcatccaaatttgatcctccatatacctatatggatgattatccaaaagagattcctcctttatattcctcctcactccaacaaatcatctatattacatcctctatatcatatccccctatattttattagtatctttcaactaccatatatttatattatttttcttttttcacctttctttttcttctctcttctcccgtcctctcgagctctcttctctttctctcttctccagcgatagagcaacgcgagcggaggggcgaggggcgccacgagcgatcgggggcggagggcggcgcgggcgacggggcggagggcagagggcggcgcgggcggagggcggcaggggcggagggccgcgtggaggagcggcgagcggcgggagcggaggggcggcgtgagcagcagagcgacgggagcggctggatttggccagagataggggcggaacggagttcgccgatgacgacggcatggcgtgcagcggtgcgcatcctctctaacttcgctcctccatgccttgatccggattggggcgggagaaccagatgggtgcggcggttgcaggatggcgttaggagagagaaacttcaaatataccgattctttctccggaatagcgcatgcgccatctttggaggccctgatggcgcatctgatggagccggattttctcctcccatgagctatatttcggatggaagatgggatagaggatctactgggatgctctaaaggcgatagtgcctcatattatctggcttatcttcctcctgtctatttcagatcgagttctgagtccaacaacatctcggcttggttacttcctactacttaattaatcgtgctaatgatagttctcgttttctgcgtcattgaaaatctctgcttacatcatccgccttaaaatgaatttatttttgagaatgaatttaaagaaccgcgtttgtccagaacttttactataagttgttattttgaggaggaagtgcttacctctggtctaaaataaattaaatttttacacatctcatacatatcaataaatatttttactttatcaaatctcaatacaattatctctcactttttctatctgtaatgcatttgtctcttacttctacaaacaacatataaataagaaaataataaaaataatacgaaaggagtacctcacaaacgaacgaagaaccagcctgtctttgttttgcagcacgtacgcgagtacagtaccacgtagcacaccaaaacaagactgctcgtagtacctgtactgtactgtacaccaaaacaggccacgagcagcagcagtgcccccgtaccgctagctaagctgtgtcgccgagccttgagccgctaggcgctagctgcatctgcatccagggtacgagtacagtggacacagctccgctgcacctaggcgcctgcccgtggcacggggtacgtcgttgtactgcacggtgcacgctgctgttcgctcccgtgcggcgcgtttcgccgggacaaggacacagacggctgtcttccgcgcgcgagggcccgtacgtcccggcgcgttacgccgttaattacgctgttatacgacgcatcgatcaagcggcagcagttgcgtgcatccacgcagcatcggttggatccgtggatcgcggctggctcggcgtccgcgggcgagagatcgtgtttgccgccggtgggcgaaaatcttcgtagccttttggatgccgcgagggctgacgtttccgcttgcggatagcgtgcgggttgggggcctggggtctcagctgtcgacacgcctgtttcctgacaccgcgtgacctgtttatgcacagtgaacttttgcgcgtttttgggcatggatcttgatgggttcatggtcggagttcggctcatagtcatggcccccaataagggaagctatagcctagcggcagagctgggcttgagcaaaccgcaaaaaggcgcgtatggcatttcgtcgcgattcccctgcatgcagggcttcgccgtacggccgcaacatgtcgaaggcattccaatttttttctttaaaattttaatttttccgtcacatcgaatatttagacatacgtataaagcatcaaatataaatgaaaaaaaccaattgtataatccgactttaaattgcgagacgaatcttttgagcctaattacaccatgatttgataatgttatcctacagtaaacatttgctaataacggattaattaggcttaatagaatcgtctcgcagtttccagacggaatctataatgtattttattattagtctgtttaatactttaaatacgtgtccatatataaaaaaaattttagcacgtgaactaaacacaaccaaagcatgagaaagcctgcactggggcaggagtgggctgtcgtgccattgactgctggagactaataaattattgaatttgctaaataatctattttttataatagatttatttttcgtcgctcttattagtcacagagtaaatttatttttcatcaatcattacattggagaagtttatgaaaatgagaggtaaatacatttagagtagatagagtagaaaaataatcgtattgtaatttgataaagttgagagcattttaattttcttattgatatgcgttgatagatgagaaatgaaattattttagaaaggaggaaacaacacactagaaagtcagaggatattgttgacccgttgaattcaggttaagatttatatctaggcggtggacacatacagatggggtgatagcaaccgagccacggagtcaaccatgagcagtggatcagtgttgccaacaggagcagacgaagcgactattcgatggtagcttgtggtgtggagtcacacgagatggggaaaacggtaaggcaggtacacccagctaccatgggcgtggggaggatgaggggtgaggggaatgagtccaatttgacggagggggctatgcatgaatcttaaagaggatataccaaaagtcacacgatatggagttcgattggttgtctaggtactctgtaacttaatattgatcttaaatataatagttgacctagattggtagccaaaaatagctactccatccgctccaaaatataaacatttttacacggatatctacaccatttgaacatggtgttatggaccataacatatgattgctcattgtctctatatcttattgaatataaccgctattgctcgttccagcatttgtccataaagacatgtaacttacagtaaattcttttaagggtttatttaataggcgtcattataaatatgcatattcagataaatgtcaatataattcgtctattcgaagtcatgccatacaaattttacaaaattaaaaccatgccatcaccgtcatgtttttcatcttcttccccatctgtgtgtgggactcactcgtcagattcatctttttcctctatcctcctctcttctattttccccatctctatccacctcttatcagctttctccacacattgcatcgagagcaagagcaagggcaaggatgtatcgagatcgatttgacctccaccccttctcccccctctgctcctcctagatggcgacgtcttttccaaatccctcacctttatttcctccttgcctcctcctcattcgccctctctcccgagtctaaaccctaaccctagcgcagccacttcccatggccaccgagtaccgcacacccgaccgcctcctatccgccgttgcccagcgaggagcatgcgtaaaatccgcccaagctggtgcttgttgttgccgcgacccatgacggcatccgattctagtattacatgcttgccggcgttatcgagcacacaacgatgttccccgtcgacaccctcaagatgaacatgcaggtcggtgccccaccctgttactcggtcctgtcattggaggccgccttgtctggctaagtagtggacacatgttagccaacatgaacaatagatgacaatatggatgacgccgtgtgcattggtttgagtccaagcatggaaggtggtgtgatgtgaaagttaatttgtcatccctcggtgcaaagcgaaggtatatatgaaaccgggtgtaaagggaaaacaaaataaatctacccgatgttaagtgcaatttactctttatttatttttacttatttgattatgctgtaaccgagttggatggcaaaccacgtatggtgtgatagatttacttccaccattatcctcctttttatctcctacatatgtgtttacagttcgcttatagtatgctgttgtatatgctctcactgcaaactataattaattaacctgaaaaatataacaaaggtcctttcagattgctgccgagtctaagggctcattcggaatgtaggattgaaaaaaatataggaataggaaaaatataggaataggataggaatgcaagtgtaaaacagatgatttgaaaacataggaatttcatgtgaataggtgtggatggagtaaaggaaaaacataggaatctttagaagaaaataggtgcactattacaaaattatcacatactactagtgaattaaacaacattaatcaacctaataatgtgctttagttgcttgatggcatgatttgcctcgttcccacgcgaagggagagaaaaaagaggtcagcatggatgtttttcttcctatgatcttccagtgatatggctagcgtaggaaatttctctatgtatttcctacgaacattttcatgtgatccaaatgacgccacagtaaagcaatccataggaacccaaatccttcatttttcctgtgtttctcctctattctgaacaagccctaaagaaattcaaggaggcacctgaacgccggccaattagtgccagcgcaaacagccgatcgctgagaaaatgtgaataaggcaaagcgcgaactctggaaagcgctcgagagaggtcggccggcgacccaacaacacaccaccaccggcctcgcgcccgcggcgcacacaagatcgccacagcgccgtggtcggaacagcgaatccggccgcctgcaggcacaggcggcagtgccacctccccacccccccaatccgctgcgtttccctctggcctcgtcccttcccaacaaacaaacccgccaccacacggcgcccagcgcccgtgctctcctctcctctcctctacccgcccagcccagccgcccatcccccctcctttccgcggtccttttgctcggttcagcacgcacgcgggcacgcggcacgccatcaccgcgcggccggccgcctgctgctgctacagccagtggagtactgttctgggccgcccgcgccgcccgaagccaccaccctttccttttccggaagcctccccaatcctccgccattccccgcatagcgccccatgcccctaccgaccatagcctcccaatcccccatcgcctagctgcttccccgtttattttaagatttttctttgggttgtgagtaaggcttggtggggcccagctcacggttccttctggcataaacaatgacttgggcctgcccgccccgtggcctcgccatccgacactgtgcctctcatcccgcgattagtatatttttgctgtttttttatgggtgaaaaactgtgtgggctctctcgttgggttgctatccgtccacccgtccattcatcctcgcctttgccagttgcggtgttgcccccctcgctttatttatgtcgacctgccaataggagcaagtccccgtctcgagacaccagccgcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccaggtatgctgttctactcccacgcctggatatctctcgactccgcttcgtctcccgcgtttcgatagatctagctaggcgcgtttcctcccccggtctccctttgacttcgatgtctaagatccatccgcctgggctagggtttaacacgggatattttaactagtaacacggatctcaccatttccacccgttcagaaaaatcaatacagttttagaacgactcgtggttactttcgccccctttagatgtagggg

SEQ ID NO: 9356 - DNA, 10557 bp, Oryza sativa
tgttgttttcttttgcaatgtgttaaatcattgcagaactgttgtttgatgagaaatatcctgttgttgttttcttttgcaatgtgttaaatcattgcagagctgttgtttgatgagaaatatcctgttgttgttttcttttgcaatgtgttaaatcattgcagagctgttgtttgatgagaaatatggtagtctcctacacgtatcgttcgtcatatccatctcgccttatttgaggacaatgctttcctcattgcaatcccttttctgcgccttaattaggtattatactgttatgctgtatcgctatatgtatttacatcgtgctgttcagtcttgtttgcagctgtacaatatgagtttgtttatgatatactcgccctttaatttgttactcatgataacaaactgaaataatttactcatagatctttatcttgcatgtatccatttcgaaaagtttcctttgtcttaataaaagaaatgttgtactagtacatatctcattatatcttcatgtacctgtccatcacttcatcgtcactatatatatatatatatatatatatatatatatatatacaaacaaacaaaaatggtgttagctagaattctcttttgctgagaaagtatcttaattattatttcaggtttgttaatttgcatcaatttataataccttaacttcttttacttcaaacagggattttgttaaacaattgcaatttgttttatgtaaatttaagtacatcatttttcatttcttcgatgaatgtagattatctcagataagataacctgatacttcctttactcttctacatatgaatttgtttagttcatatcatatataaaagaatggacggagtatgttttttatggttttacatcagttgtcagtagcacaacttaagcaaggattcaacttctcttgatgtacttttttagaaatgtgcacatatacaacttaatttcatccatggtacaatttatttttagttcatttctacaaactagagttaagtgttggaagaagataaagaataaactgggatggctggtactgttatatgtggacaatcattcagccttggtagcatttaaatatgttcattttacctggtagtgagtactggtagaatccataaatcgtgcttctatcaataaaaaatcacactctataatattaattcaattttggagctgcaaggcttggtttatctaagaagttactatttataaactaacatttgtcttgattatttgttctacagctggacaatgtattgatcctttcttctacatttggatgccataatatctgattttcttactgttttctttttcagtgcttaattcctatatttctgtcaatatcaacttacccgtgttaatttgaccagggaaaaccactttcatttctcaagattactcctgcaatgttatagacttgtagtctacttggcccgtgcctttataattatgaacattcatgtataatttatgttctattttcgttttatctgatggtctgtggcctactgtggtattgatgatgccttctgttggacagtatgaatgaaatcatcgacaagtacaacacacattctaataatctggggaaagcagaacagccttcgctcgacttgaatgtatgtgaatcatcttatcatactgtgttaatagtaaatactgttcttcatatatattgcatcttaatgttgcctaactacatatagtagtattagataatggttcaaaatgggtcattttatgtccatggccttagggtggcacaatagcaaaatattcatatttaggttttcacatctggtagcattatgatcttatttctgtaccctaaaattttacaaattaaacttaaaaaaacaatcgcatatgtggatcctttcaaagttctcagtatgctctaatgatgtctgttttgttggttgtgtgttaaatatgtaaattatttgttttaattttttgttgctggattttttttaaaaaaattaatacttgcagaaacaatttacatctctcacttcctcatatttttggtgatacactataaattaacattattaaataatatagttctctatctttttctattgtatcttgagaaaaattccctggaatcggtacactatagcacaatactaattctgttttttcatggatcatgaactcaaatttagtactgttagtagtaattagtgctcaggcatgatgtaataggtgccttaaacttatgcagatatattttctaaatgctacttatgcagatagttaatactaacagttcaatcttttcttttcagttagaacatagcaagtatgcacatttgaatgagcaacttgcggaagctagtctccggcttaggtcagttcttttaaccttttttttttaaaaaaaatgttatacttgaggcatttgttctcagatcctttattcttgaggcatttattctcaaatgtatatcattggtacatgaacaaattgtagacaaatgagaggtgaggagcttgagggattgagcattgatgaactccagcagctagagaagaacctggaagctggtctgcacagggtgatgctgacaaaggtttggtgatcatcacccagactcatcacgtagctcgtactatgaacaacttattgattgctatatgattttgcaggatcaacaatttatggagcagatcagtgaactccagcggaaggtaccacctgttgctagattaaccctgaatcatcaatgtagcttggcaacatataatttgttttttcttgcaaaagtagaacctttaaagaagactgtgttgcatacaagtatccgttgctggcttatttgtagttcattctttccaatacatcactgtgtaaaaagttgatttatagttctctccaatacagagtgaaatcacttataattttactgttgcatcttgcatgactaatatatgctgccaccttctgccttttcttgcaagatggcacatgcatctgttcaagcaaatttactaaatcatcaccaccctggccttttccccatggatgagtcggaattttggactaaattccctgcccaacccttggaagtctgcgggttttgttcatgccggaaaagtccttagcgattaaaaacaatttcttctagtccttattgtttcaattttaccaaattatattggcgttttaagtcatgtcccttcttcccccaaattgaaacattgattttgactatcttgaagatcaaattagagggtacccattggataaaataactaatttaaatggaaattgtactttagtttttctgtcctgcatcatttaccatttgcccatttacatacatttaagtattgtagatgtttcttgctgtgttggaaactgatcaaacagtaccatttcttgggaaatgcaatcttatagttaaaaaaagaatctacaatagattctaccgcatccaaaatgttcttgtgcctgcttgtttttattcaaacccttaccaattgaaataagagaacattataattatgtgttgcatattctttgttgcattgcagagttcacagctggcagaggagaacatgcatctcagaaaccaggtataaatttactttctgtaagctcttggtttgttgaggacttaagaccagtccatctgaacacattcgttttcttggtactgaatacaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggtgagtttctgatcactttgtttatgtgctgaagttaaattccaattcaagtttcaggaatattggtcatatgattatttggtttaatggattttaaggatgtgattggtgactttaatccttagatgtattatcatattatcaacaggcaagataatccatttatattattattaaactttattttgtatacatggatacaaattgtgtgtcgtgtttttctgggtattgtttgagaccgagctatggccttttgctaattcttattttcttataaatccagatatgtgtacctttttttaaaaaagatacatgtatacttaatacacatttgataaatgctttttttttctcttccttaagctatactattttatttcattccgcatgtcctaatacttggcaaatgtagttaagccacatttggttctctaattgcttattttctttttcttaattaagctatactttgtttcatgtcctaatacttgtcaaatgtagttaagccacatttggttctctgattggtttgagaagaaggatggaatttgaattcttgcctgggggtgtactcaactacgtttgattacttgtatttgcccttcagtattttgttcatttcgatttttcttcaactctacaatttgcaggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttctaagtatgatcttgcgctatcttgcattcttgcgtaatatatatacattgtcgctgtcgttagatttcagttcttagctagcagccactagttggtgttaatagcttttccttttcctttcccttttcttttcatgatttacctgtcacgctatttcgcgggctgcaatttgttgcttgagatatgctctgcatggaagaacactatgcagatgcgctccagcattgattttcattatgggatactaacggggtatatgttgctgtgtgctacagatgtacagcgacgcagcagaaaaggtgacagctgcagtatatgtactgatctttccatttaatattaaaaaatctatatctttccgtttgctcgcatatccttctattttggattaagagcctcaccgtttgacttatctgcggaataagctaaataatatgtgttcttagcgatgtaaaagcaaaggctaaaaaaattaatgtcgatgaaaaaaccttaaaatcggcttcaaatttaaggttaaaaatttagattttggttaataagtataagcataagtgaaaagataagaccgtaaatggttggatttcagttgccagatttattcatcagctagagaattaatccatatttggttcactgtagcatcgcctttgttcatctcattggtataagaaaataagtttaatctgtatatataacaattgcatattaaaattgtctttagaaacgttttttccaatattgattttttttactatcatatcttgatctaataaaacagatcaaaatagcatctcaaatattgtaaaaataacatgcccaaaggaaagttactacctccatcctcgttctcaaaaggacgatgtaacatgtgcaatcaaaccatgatttaaaatgtgaaacttatattgctaacttcgtcctaaaatatagtaatttctaactatataatatttatatatggataagtgtttgttgggatacataaccagtaaatatatattttaggatggagggatttgttaaaaaaactttcatttagttttagttaaaaaaaactttttaatcaaagtttaggatgtacttgaaattttttatatagtttaggagtatatggaattttttatttaaaataattctatatagtttagaaaaatagtgataaaatttgtgcattagattgttgatatctcttgtgtttgatttgggggtgagataaggaccctatttttttagaatatgatggttacattatcggttagatatgagggatggaagagtctgtgacccatgtcaacgagttgagaggaattgggttggattggtccgggcccctcaatttttaatgtgtgaagccaatccggatcttagagaaatattctccttgttaaccatctcacgtaaccccaaaccaaacacctcgactcaatctgacgcatgcttaaaaactgaggtggtgtgatagtggatcttgaacagttcttcttcactctattctcaattctcataagctgacaaacatggcccacttcccagctctcccagaaagcagcaaacatctatccaaccaatgaaccaaccaacacaagtcaataacacgacatactactcctacattgctattcatcttatcatagcatctccaacaacttctccatttcactctccaagctaaattttagccattatagtaaaaaaaatgtcctccaacaacatttccaactggccaaaacccttcctccactagccaaatttggtcagccaaaagtcactaggcaaccgtgggccctacacacattcctcctcccatctcctctccggctcctctctcgcatcggctcgacaacacagttctccaagctctcggcgccgtcgcttgccgcgacctccaccgtcctccacaccgtagccagccacagccgccgctatccttcgcgccgtcgtccgccgccgtcctccgtgccgtagcctctgctaagtagctagccacccccaacgtctctctcacttctgctagtgctccgctctcctctgctgctcaactccacggcgtgcgcgtctctctcactgtcttgtcttcgcaccgatgccgccggagcgcgctgtcctctcaagccgcaccctccgttgcagatgagctccaagcaccgctccgctgccgctgctgctcccgcggctgttgaagacgttgtcggggtctggtggcggtggcaggcaaggtgccagtgtcgaggtacgtgctgaggttgtcgtcgtcgcccgctacgaccgccgccgcctccactccatctctaccccctccccattgctgaggtcgtcgtcgtcgccgcgagcctccgccgtcgttgtgagcctctgcgcagtcgccatcgccgcattcgaggtagagggcgtggggaggagacagtagtacatgaggaggaagaagagagatatagcgaaggatgacaaatgggtcccatttgtcaaatacttataatggggatgatatatggagaggctgttggagcgagtagctagtttgaatagccaaattagatggaaagttggttatataggtgtttatatagttcgatttggagaggctgttggagacagggtttcccaaatcgccggtaccggggttactgcgccccggcggtaagcacggttaccgcggtaaccgcaaaaaaccgtgaaaaaccgtgcaaaatttatcaaaaattcaaattattttttaaatttatttgaatttaaggaggttactgtaatatttatattaccgtaccctgcggtaagcccagtaaccacgcggttaccgccgtaagggaaatccttgttggagatgctctcacgcccacgcagaggtccccctccgccccctctgctgtccccctccctcatttgaatcgagtaatcatccgcaccgcccctcccccatcccacagtacacacaggcgccgtcccgcaacgacacacacagcccacgaggccacgactctctccctccccctccccctctccctcctctcgccgtgagcggaacacgaggcaacgccgccacctcgagaagcgcgtcgccctctagggttttagagcagcagcgatggagggcggtggggagggcaccaccaccgccgcggcggcggcggcggtggctgcggggaaggaggaggaggcggaggtggtggtggtgaggaacccgaggtgctacctcgacgtgagcatcggcggggatatggaggggcggatcgtggtggagctctacgcctccgtggcccctcgcacggcggagaacttccgcgcgctctgcaccggcgagaagggcgtcagcgccgccaccggcgtgccgcttcactacaaggtttgtcctggtttggcggtccgtgtgctacccgtagtttttcctggttgcagccttggagggtcgacgcgtgagaggatgccggctgcggtgcgattgatcgtagttggggggtgtttaagctatccgagttggggattgtgtggtttcgcagatgaatttgatgctgtttgcgtactagtgcgatttccacctgacgattatgatttggttgtgcgctcacagaggttcgcatgattcagtaactatcgcgttccatagatttttattcagtaccgctgccattttaactttgttacttagcgcaatttccgcacaaacctcgcggtgaacatttgcacacttgcagcacatttactgctgagcaagttgatccccaaatccaacacaaatccgtttgcatggtccatttggtcgatggaaatagtattttcaggtgtctgcacgttgcaattggttgtttcagctttagctttgatttgtccccttctgtaacaacgccattccaagtcctcgcaggccttttgttttgattcgacaactttgctttcgctgacattgttacggtgtgttcctattgttagttctcatgtttggcgctagtactttgtatcgttccagttagtgttaactgcttttaatccatatggcttatctttgctttagtactagtgatagtgatgtgcttcatgtgccactgcctacaactggtcccggtactcaaattatggtcctatggccctcctttagttttgacgtcatctcactactcacttgcatggtggcctacctactttcttgtctgatcttatgatgtacacgctgaaacataaagcaccttagttttttttttcttttcaaatttgcatgcctttactttctgtggctttattgttggcaatgttacaatgtactacatattcctgaaatgcttaagcagagcactgccatgtttagcctgaaatgcgcacgcacacgcacaagactctaactcttttgataatttcgaccatgtgccagggttcaaaaagttggacatgataagaatactttcttacagttatgtctgcactaggtggacatgatactattccgattgtagattagccttaaagcagcatctgtctgcactaggtggaccaaggtttgtgtagtatctattatttgggaagtaatccaaggacaaactatatggctgtaagagaatcatatgcggatctggttcaatatggtcaacatttttaagtgaggcttggtatttaaaagctaagcttaggttctttagtcgtcagttggaatgatgatggcaaggaaacactaagtgcagtaatagtgacaagtcctacttgactgttgggggggcgacagggatccaactgcgtaatctgtggttctctactttattttgtagtggtggggactctagatgttggctatccttccacttaactgttgtggctatgatgctaattggacagagttagcatcattcttaaccttgaaaggttacaatggccatccattctttgctgaaagaaagaccatgattagcctttgttacattatttcttaatgttcacaatagttttcctttcttttttaccattgtgaatcatcggatctttaacttccaaaaaggttttactgactgcgtcaaccaatctttttttttttcttttggtgtttttactcctccagggttcatgtattcaccggattgtcaaaggttttatggtgcaaggtggggatattaccgctggtgatggaactgggggagagtcaatatatggattgaattttgaggatgaaaattttgtcctgaagcatgagagaaaagggatgttatcaatggctaatgctggtcccgatacaaatggatctcagtttttcatcactacaacccgaacaccacaccttgatgggaaacatgttgtttttggaagggttataaaaggaatgggggtggttcgctcaatggaacatgtttctgttggagaatctgaccgtccaattactgatattgttattgttgattgcggagaactaccagaaggtgccagtgatggagttgtgaactttttcagtgatggtgacatgtatcctgattggccaaatgatctcgaagaaaaacctgcagaaatttcttggtggatgactgctgttgactctgcaaaatcttttggaaatgaatatttcaaggtatgcacttcctttagcatcctttggaaattttctttaggtcatatgaggaaattctcactgcagcattatgtcttgcattgttagaatgttagttgcatcatcgtatgttatatagtaccggatgatgctcatgtccggagcttgtagggctgcaggaat

SEQ ID NO: 9357 - DNA, 6636 bp, Oryza sativa
agatagatgaaggtaggtatttttttttcttttcctatcagtcttcaattttgttaattttatcatttgatacttatagaccgaggcatatcgtactagctgattctaacagcttattgatgtgcagagaagagctcagcactacggaagacaaagtcaattatactcacaaatagttctgtaagtcccacaactaaccacttgttgcatgacaaatcataattcacaagtttcttccctttcgtaataaatatgagaaattatactgatgagacattattcattagtgctttctgaattgcatctaatgttattacatttcctgtaaattttagcctctgctataaatattgaatccacttatgacttgttcaggcttgcaagctgaagttgggagatttgaaaggtgctttactagatgcagactttgcattgcgtgaaggggagggaaacccaaaagcttttttccgtcaaggacaggttagtgttacactgttactgttgggtgtcatattacctgagatagcaaaatcttaatttgtggagttgtgcatgaggctgtgcttaaaaagccacatttgcatacttttgtatgcattagcaatgcagcactacaatctacatataatcctgttttacttgataaaatattatctgcaattcttgtttttgttgttgctgggaggatttgttcttagtgccttcatagtgagttcaaatttccagatttaacgcagtttaacatgatactgggatttgcaggcacgcatcgcactcaatgatattgatgctgcagttgagagcttcaagcatgctctgcagttggagccaaacgatggtttgtcccttgcccactcaattggctattaagtttcttcattggaagtttatatattttgtgttcataaatctaggaggaattaagcgggagctggctgctgcaaaaaagaaggttagtccattgagttcatgaatctttggactaatggatgttccttcattgaagatgttattgatctgtcaccgacattatcgcagattgctgacagacgggatcaggagcggaaagcattttctaggatgttccaaccatcaggaggttcagagaagatcgatgaagtactcttctgataccacattcaccatttggaatcttttgtttggatctttggcataacatcggtagaggatgtgtcatttggatgatagtttgttttgtttttctgcaggagaataactgatcggcttaagttcaacgttttgtagttctcttcatgacacatactggtgctgcctggtgaaaaaatagagttcaggttgctcttacagcccacagccactattccttcgaagtttgtgttgtttcaatatactgactccatttttatgctttcaggtgatggatgagagagtttttgcataacagaaggtgatggatgagagagttatgcagtttttgcataacagaaggtgatggatgagagagtttttgcataacagaaacaactcccatggttgaaaatagttttggtcttttggacaccaagccttatgttttgcagtatagagtttgccacaatgctatcgtaggaaatgtctggcggattgaattgtcaaactcttggaaaggccttttgaatgaccaatcctgttaacgaaacattgttggcaagtgttctcgcgtgtggttagcttaactttgccttttgctgtgtggtgtgtgctcttgttatggatagcctttttagttttgttcgcgttacaactcattacctccggagtttcatcaatcacaataatcatagctaaatagctttggtctagcaaacagccaatgagccaagcatgcgaggcgggtcatctcgcggtagaacctgaaatttgatctggacatgcttgtaggctcgtatcagttgaagaactcagagcctcagatacgtgcaattcttttcaacgcctcgtgttactgaactattgttccacaaattcatagctgaagcagtttgcaggggcagcaacccaacacaccactaattccacaaaattgagaccacgcacaagcatagccaaaatcctatcaacccaaacacaccattaattcccccaaaacatcctcagattgccaaaatttacgcacagtaaattcatttccctgtctatgcattgtagttgtccacgcccagatccctcaaggcagatgtggcagcatctttgcagctcccgtgcatcatcttggttttcctaataagcttctccacaccatcattaagcaagatcgtcctacaatggcagcacataagtcaacattctgatactagaagcatgttactatcgaactgtaaatgccttaattctgaataggtcatgccagcagacagtagtgcttgtgaattgtacagcataccggttttcagggtttctgacgacaagattacggatcataaggcaggcttgcttctgagtttgagcagaagaagggaacttttgcattgcctgtatagccaaagtgccataccctgctcccattgcacgagctgcattttctggtgaccgcagtgtaaggatagtcaccatagacattacctacacattcatttagcttgtaaaagttagcgcacatagatgcttcagtatttctcatttatatgcaatgtggcagtacctcttgtattattggtgggtcttcagaaaatctcgatgtcaacttcaagaacttatcaaaaccacctcgttcaatgatagtagtcttgtttgcatcacttccagccagcttcaagcagaaagaatggtctgtaagtatgattcatcaatgtaggatttcctctgttacaggattgatgcatttgtgtaccatactacagaccttggacagcagagagcagcaagattttgctataactttgttcttttgttcactagcctcatcaatacagcgaagaagcacatcaatcccaccattttcagatatggatctgcatatttcatcctgaggtaacacaagaatttagtaaagttatcctgaggcagctcataagtcataagagtatagcttgcagcttgtttttggttaaggacattgacaacagttccaccaggtaaagacatcttgttacaagtacaacagggatcaaaagcatgagaaaaaatagcaagagcaagatggtggtgggaagttgattataaagggcaccgtacttttcaaagtgttgcttaccataaatgttaaccatatgcaattgcagcagcagcaattcatattctttttgccagatgacattgaattaatggcataagaaatatctatagtagttcaaaataaacttttgaattccagtataaccatagttttctcttacattgacagcaattgccttcagagccgcacaagctgatggtaagctggaaggggcaactttctcacgtagtgcattgacaagaactgctgcaatcccagtttctgcgaacctccgagaatatccatatacctgcatcacaaatgttggtcaatgtcatctcctatgtccaaattccattcacttaaaaagtttcaaatggctagattgtcaattattacaataaaggttctctggatatttccactacatgtgctgtgcatattataactcaatttaattccatatctacatcttccctcatgtatgtaaactaacttgcatgcacaatcacaaatatgactctttttctataaacataactctagcacatcataatgtttaatactttaatactaccaaaaaccatagattacggagagttgacaactaaagtttcataataaagtgcaaataggtccacttgctaatgcaaaactggaccaaatattcacacaattacacaagcatataggacatacttgagaagccaccacacgattgtcatcaggtgtcaatagaacacgtatggcatcatacaagctttgcacattgctatttgatttctcccccataacttgaaaaatgagttcatcaaccttcaggaccataaagcactctttaacaacttcattgcctgcagatgctgaagccacaaccctaaagccaccttccagtatatctgaactttctgaacctcctttcaaaatacccatgacaacttggggcccttcgctttgcctgaacttttcagtgcttccaacatctacagattgaattgttacctcaaatgtcagggagagagcagagattgcttcttcttatcgataatattatgaaaatgaatgcaagacactgcaacggacatggaagtacagtactcttgacaagtttatgttgcatgtgcgctgacagatcaaggaatgggaccagtccattattttgacttaatgccatttgaacctagcaattggatggtgagtctaccttcacaattgtatgaattttgaatgaaccagtctgtacctgatttcttactacaacacaccattccaacacattctcacacttgcatgttataagaaatttatgaccagcagaaacaagtctgaatttctactgcctctatgctaatagtattagttcaacagaatttctaatcacaacaaaaaacttaagcttacaacagtaagaagtaagaaactaataatagcataaccaaaacagaacacatcctcatatctcagaggtaataacatcaacttaccgcggagcaaggagcttagcgccttcaagcccgaggcaagtagtctctcctgcttaaccccagccgacgcgcacagggcgacgagcgcctccacgccgccattccgagcagcgaccgccgcattctccaacccatcgccggagcacagctcgcgcaactcgtcgagcaaagaggccaacctctcagcatcctcctcggacctgccgccactgtcactgtcactggcagaagaggccttcacctcgtccagcacccgcatcaccgggctcacctccgccgcggcggcctctccaggcacgcgcttgatgatccctggttaggaggcaacgggaggagagagactcgatcaggcgagggtatgcgaagatcggggagatgcggatctggaaggggatggagaggtggaggagttggtgggtgattaccggagaggtcggcaccttggagggtgagggcgtcgacggcgtcggcgagggcctcgtcggcgtccatgccgaggtcctccatgttctcccgcaccatggcgtcgaacgcctcctgagagatcgcgatcgccatttttgctccgcctgttggcttcggtgccggctgccgagtgaacaagtttcagtagtagtacgtgcctttcttggtttttcctattctgagggggcggtttcagttttgaatttggatttctttaccgctacgctgaagacgaaaattaattagcactgatgttagattaattttcaactagtttttggaataacaaattttgcctctagatcattatgaactgatcaaatctaaatcttcgccgggcaaaaaaaaaaatcgggctattttttttcgttgggctatcctctgcccgtattattccaagatttatgtttcgcaataatagaataatcaaataaaacaatcgaacacttgtttattatagaatttataagtgtacaaagtttaaatatttatatgtttattagtagaaactcttgtgtaaccagatggctactactagatggtatgattatgcgcctaactcactactcctccgtcccacagaaaaccaacctactattggatgtgatgttttttttagtataggctgtgttctttgctgggagttcccaactccccaatttcgttttccgcgctcacgctttttaaactacctgtgcgttttttgcaaaaaaaaaagtttctatatgaaagttgcttaaaaaatcatattgatctactttttaaaaaaatagctaatacttaattaatcacacgttaatacgaacatcgttttgcatgccggggcccaacccctcctcccgaacacagccttactcttgtctagattcattgtcctataaaacatcccatccaatactagattggctttttttgggacggagggagtacagtttaaatcttggatttggcactaggtcgttggctcatatagacgcgttatgtgttgtgcccttactacaaggtatttgatccttcaaacatagttctaagcatttataaaagatacatgtgtgggtgggtgtgatctgtgatgtggataaatactacttgctctgtttcatatcataaatcacgttgattttttttctaagttaattttttgtgagtttaactaagtttattgagaaatataacaacttttataataccaaattagttcattaaacataacattaaatatattttagttagtttgtttggtattgaaaatattgttactttttttataaacttgatcaaacgtaaaagaatttaactttaaaaaaaatttaaacatcttataacacgaaacgaagggactactgagtatatatggtttaccatttgctacagtgaatattgtctaatacagtatatttatgtacaacggttttatgcgaaaaaatacaataaatattgtcattttaccgttactgtgttaaactcaaatactcaataaaccaactcatacatacatgtagcgacagaatc

SEQ ID NO: 9358 - DNA, 602 bp, Oryza sativa
cgtgcacattaaataaaaagcagaattgcacgatgcagctaagcattgatcaaatgcaccaatgatagtatgatatccttggctagctgcggcacttagattcagccgggatgcatcatccaaaacagacgagagctttatacagaagcgtaccggcaccgctcggcgatggcggcgaggcctagcgtgctgaacccatcgcagcacaccagcgacagctccttgaacagcgggaatgacttggcgatgagcgcgaggtcgtcgttggagacggtcatgcgcttgaggcagatgcgctcgaggtgcgggtaggcggggccgagcgcggcgacccagggggagacgtaggcgccccagccgtagggcacgaggctgaagtccgcgaaccgcggcttccccttgagcaccacggcgcgcacccctccgaaccgctccacggcgcggcgcggcgacaccgcgtagcagttgccgatgaacagctcccgccgcgtctgcgcctcggcgcggtaccacgaccggcacaccagcgacgccgcgttccggtcccgcgccgccgtcaggaactccagcacgctctccagcacgttctccagcacctggtc

SEQ ID NO: 9359 - DNA, 6005 bp, Oryza sativa
  unsure (1)..(6005): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttatagctattttgctatatcactcatcatattttacaaagcagttggtatatcactcggatcatgttatttggaggattcacaccgcatatgctatatattgatatcaagtcacttggttgagtacgattatcaaaaccactcggttggttggattatttattccttgactatatgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggagattatgggtaccccatacccacacggcatggttatccgactagttataggggataacttatatatatgtaatatgtaacagatcatgacttgggtgttacgtttccttgtatattacggaacggcctaaagtcctgatctaggaaaccgataccgtattggttaaggtttctatcttgtaatcctgccccccatcctatataaggtgggcaggaggccctctagggggcatatataagacaacctgatcgtcagatcaatacacactcggcggattcaaatccccaaacaggagtagggtattacctctcattgagagggcctgaacctgtctaaatcctttgtctccacatccatccacttttaggtctcgtgcgctaccccgtttcattattgccgaattcatgtttcgacaaatgcctaaatatatttaatgttggatttaataaaactaatttggtattgtaaatacattttttataaacttggttaaatttgataaggttaggagcctcttctacagtaattttcttttaagaaaatttaaaagtttgattcaggacaaattaaaatgacttataatatatgaagcggactgggtagcatttcttaattttatctctagaacggaactaacttttcactaatctgccagtatacctctcaacagacttatttttccactccactgtagcacaaagctggtacgggcaaaccgatataaaattaacctgcaagcaagatggcgtgaaacatattctggaaaggaaaaagtagagagcgagtattagtattttgttgcggagaaagacgacaagaacaacacgataatcttgtctgagatagccgccacagcttagtggtgcattgcacactaggctctaggtgattaagtggtgtccttttgctttctgatgttgggtgagtgtgtgtgtgtatggagggggggagccggatcgagctgcgttgtgtgctccattatcccggcgcatgcgaccatccataccctgaaaccgacctgtggcccgacggagagtgacccatacttgaccatgcccgacccactatctatttctttctctgtgtggatgttcgatggtcggcttataaaccaaagcgaaatttaaattttaaattaatatttttagtcttatttttaacagattaagaatataaatataaaagttgtaccataaaatcatcatttctagttgtttcgtttattttccacctcttgtttattgttgtcactgctggagaaaccatcttcactcccggttcgcagcccctcacaaattcacaaaaacctcatagatcatatcgccaccacccactaccgaatcgcgtgcggctcgctgcctgtggcctgccagtgacgcgcctcctcccgctaacgcccacgacgcgcctcctcccgctgacgcccgcgacgcgcctcctcccgccgacgctgccgacctgcctcctcatgccgccacacctccacttgccgccgcacctccacctgccgccgacgacgctggcggccagcctccgcccgccgccgcccgtggcctgcctcctcccgccagccgcgcctccacccaccgctgccgacgcggctccgccctcctctagccaccgctgatgcccgtggccagcctcctcccgccgacgcgcctccgcccgacgcccgctgacggagagagctggtaaagggaggaaggatctgaggagagggggggatgtcacctcggagagggctgggaaggggaggaggctgggatctagaggagggaggaggaggacgaagagataaaagactaaggatgggagcgcgaggagataaggatgaaggaggagaggaggcgcatgcggcagcgttttttttttcaatctttggtcccggttggtataaacaacttggtactaaaaatagtgaggggcctgacacaacttgacaacatgttgaaccgggactaaaaatgatctttagtcctggttggtaacataaagtgtcgtgccgcttttgaaccggggctaaaaatgtttttttgtcccagttcctattcgaaccgggactattgtggattttgcaccacctagcaaagatcagtttttcagtagtgtgtgtttaccttttcgattaagcgccagatcactaccctcggcagtatgcgggttttcataaatgtttatcaaaatttgacatatttcgatcaaaatttggtcaattttaatgttttatatttgagttctcaaaaactattcggaatttcacccggagtatactttcttggggtatcgaaacatcaaaatttcgcgattttcggtcagttttcataaaaatgtgaacatgattattgctcaaccaatgagatatagtttgtgtagtccattgctacatcacattctggtgtttatacgagagttacgatgactatgtatgtgtacatgtacgatagtctcgtgctctcacttaacacgttcagcgcacaaacacaacattattgttcctacatagatcacgcatgcgtacgttcaatctgtttgtgatatatatatgcatctaaaagaaagtgagccattatcacgagatctgcatatatacatgttagtatattgctccgtacgatagtcattggtgcgtgtcaacttcggttttgatcgctcgacgagtcgatgataggcatcaatgcgactttcaggtcccacgccgtggaacattgcctcttacaccaacccgatcaatcatcaatcaaggccagcaattaaccccaaccgaaccctgcaccgtagaacctatcttgccatctgtacacaacatgtacacaagctcacgctcgaatgttcgatatatccctttcggcttaattaattacacgcgtcgcattaaccactcagatgatgaccaggttaaccatctgttattagttaatttaccggacaaacactacttagaaaaaacattttttacagacggccaaaagtaatttttccaggtagggaaaggaccgcctgcagatcaacgactacgaaaatcattcatttttataggcggcccaatggcccgtatgtaaaaatcctctagacgaaaaaaaaattgcgcccagccagccccgcacctcgccgccgccgctctcccccggccttcctccggccagatttgtaaggagaggggaggggagccgcaccggagccaccgtcgccgccccacgcggcatcgtcttcgccccgcgcctcgttgacgctgccctccccgggcctccctccggccggatctgggaggggaggggaggggagccccgccgttgccgccgtcgccgccgccgccccgcgcgtcatcgtcgccaccccgtgccccgcgcctcgccgccgccgccctcctccggccggatctgggaggggaggggaggggagccgcaccggagccgccgccgccgccgccctgcgtcgtggccggccccgcgcctcgcctcgccaccactacccttccccgacctccctccggccggatttgggaggggaggggagccgcgctgagagccaccatcccgcgcgtcgtcgttgccgccctgtgcctcgcctcgccgccgctgccctcccccggcctccctctggccagacctgggaggggaggggaggggaggaggaggggcccggtggggagaggagaagaagtgttgagggagagagagagagttaagagggaaatgagtggtggaggggtggaaggagaagataagagttaagtggtccgtctgcgaaaatcattttcgcaagcgccgcttaagtgatccgcagcgaacttcaccccaatttatatttttataggtggttatttggctaaagggttatgtccgcctgcgaaaaaaagatcctatgtcaggaaaagtgatttttctagtagtgaaaccaaattgcaaaaatatacctgttcgggagggttttaaatcattaaatctaactctaaaaacggagtatggaacggacatatgaagcagcctaaattaaccgtgttgaatcggttccactctttcatatcactttagcccttcgttttctgggtgaagtttaaatcatttgattggactttaagaagagatgaatctagagctagcggccggagcctgtcaaacatgccttaattataactctcataatctaatattgcgctggttaattaagctggtgttactttctcacttgttacacgggacccatccgtggatgtgattagctgtagagccatgctgtgggctgtggcatggtaatgatggtacgaaagccaaggcggtgccaagtcaactactagctgcttctagtgtagctttggcacgtacatacaacggcaaagtcagcttgtatatatacacggcgcgtggcaaccgtagatgccagtagagagagcacgaaaaattccagaagaagaagcgtacgctgctatacaaaaggggccttcacgagaccacgagtttcaaacatgaatttaaaaattccagctctgctgtatgcttcaaatgtcaacgacttgcacgagttgaatcaacggcaattaaacaatttaatcgcacgtttcttgaaccattatgttttgcctatttcaagtcactactacataaacctagataggtaaaactagataggggtcgaatttttcaaccgacacatagaaagcataacatattagaaaaatcaaaggtgctggttacagaaccgacacctttaaggtccaaaaaaaagaaaaaagcggcttaatgcatgggctcgaatcgagccgatgcatcgagcagctccccttcacccgatttcacccaacatttaattcatacaatcaattggcatcaagaattcaagaacattgatccaagaacttcaacaacatcaacacaaacacaaaacacagagaagatggagaggatggacgacggcctccgtgaagaggatggagtggcatacgagcagcacgtcgggtcccatctcgcacagctcgtcggtggtggcgaagaaacagatctagcagcacgtcggaaggcgttgcccgtcgttgccgcctcacctcccaccatcgctagccgcacgccactaccatcgcctccccccccccccccgggtcggatctggcgaaggggagggtgctgcccgtcgttgctgcctctcctcacaccgtcgcacgtcgttgcgaccaagagagcccacagagagagagaggggggaccgagagagaggggagaggatgccgtggagattataattaagacggagaggatatggatagatggtgctgtgcggcttggctcagcttgattaaggggtgtca

SEQ ID NO: 9360 - DNA, 11372 bp, Oryza sativa
gttgaccgaaacccccccccccccaccgaactcgaaaaccagtcatttcgtaccccgaactattaaaaccggatagttaaccccccttaagcacacaatggggcggttttgactggagtcgtgcgcacgtggcagtccaacgtggcaaggcgggctgagtcagcatagtcgcgcctggtttatagacttgacccagaaaaatttcccctccctccctttctctctctccctcccaaaaatttccccttctctcgaaaaccctagctagcacaggcgatctcgttggcgactcctgcacggcggcgagggtggtgcgctccaaagcaggtgggtgtcgtggtcagaggcgacggggccggagatctccaccacggacgcggcggcgacggtctgcagtacggccacctcgacctcgttggcatgatgacgagctcaggtacgtcccggggctcaaggtcgtcttcttgggctggaggtcgtgaacgaggaaggatgcagccgccagtaccatatagggaggggcctctcgattatgagccgccagtgcggctaggtggatttcgtggagtcccagtaaccccgggagaagatatttcacatgctacaatgcgcgtgtgagtaaatttgtatttatttttgatttggctcatttgtttggtttcaaactcattcgatcttggattatacatttatttgtgtagtctggttggttgcgatttttgggagtggcatgaccctgagtcagatccatattggaagcaattcctgcttgatttgaggaatgctgtgtggactgtaagagaaaaaatcaatgggctaaaggctcatctccaggacagcaggaatgaagccttgaagaacaggtacagttgggacaagcttctatattgcagtgcaaaatagaacagtgaaatggaaatacaaagaaataagagcactagttatagttggtggagcatctggctgaacaactttcgtacagcctgctaggaatccctgtttgcaagcagccaggcaaatatatatccttttgaatataggactaggctggtcagtatctaacttgacaacaactgtactcccaggattactcctcagcaactctaactgatagtcaaagattctaaagtattcacccctggtggactcatatatcttcctgaatacaaatgctttggctctcttgcactgcccaacactaacatttgcaaacatttcctctgaaacagtggactgcatgctctgtatactccaagttggattatctgtgatcatcttctcatacttctgagcaatcctcttgtatgtcactaggtggttatccttccttggtgggcaggtgtgttcatcaactagactagctatttgccagctttctgtcctgctattctttgatagcaaacaagcccacgggcaagttgccaaatcacacttggcccttgttctgtaaccttcatcctttataaaccttatgaacctcttgctgtccagtgcaagctgcaccactgcctctttgaattctttcttgccatcaaatttcattcctagtgcaagcctagcaattggcctattcacattaaatctgggggtatttggacttctttctgaccagctgtccatcactatcctcttcataggaatcatcatctgcactgctattgtcatatgggctagcactgtcatcaccctcaatctgaaccaaagctctactatttgtctgcctagatgacccctcacatataacatcatccaaattccctacctcaccatccttcagtttcttcttgaactctttgtaagccttcctgatttgctgaacctcttcatcttcttctgatgaacatgagtctccaccaacataatcactgtcagagtcagaaatcacaggtttcttcggcctctctttacctactaccactgccttccccttatcactaggttcagctactaccattgctttttctttatcaggtgtacgaaatgctcgcacttgttgagatctctctttgtcttctctggtgtagacactatgacaagaacttccttccctatattcaactcaaacaaatcctcatcttcctcatcatcccattcatcatctgcaggagatatgtcctgcagttcatcttcaaagtcactatcctccttgctgccagactcactggacccctctgccattactgtctccacataaatatcagcaacaccaccttccccaacacagtttgacatataattgtagacctcatcatcaatcaaaaccctcagcccatctgcaagttctttgccaggaaacaaccattgcagaagcatgccagggatcacttcacaatgatctttcaaatgtccaactatctcaggcagagagaccttatcacgtttgatgtaggacatcccctcagatccaccaatataaaaggtttccctcccattgttaatgaaatccccaccaaagtgaaatctaacaggtaaatactctagaggatccattcttaacctaaaaacaacatagtaatggcagtacacaatcaatccttttgcctaaatcaattacaaaaatcaaaggaaaacaaactctcacacatccaactgattccatatgccctagtaaaaaaatcctacacttttctaggatctacatcacatacctgcaaagcctagctgcgtcgctcttacttcatcctcctcgacaagcagctggtgctggccgatgtggagagcgtggccgccacgaccgtgccgcagagatccctcctcgtcgcctttgagcgtgccaccctcgttgccttgggcgcagctcactcgccggcgtggagtgcgccgcccatcctcaccggagtcgccgacgagatcgcctgtgctagctagggttttcgagagaagggaaaatttttgggagggaggggaaatttttctgggtcaagtatataaaccaggcgcgactatgctgactcagcccgccttgccacgttggactgccacgtgcgcacgactccggtcaaaaccgccccaatgcgtgcttaactattcggttttaatagttcggggtacgaaatgaccggttttcgagttcggggggtttttcggtcaaccgcaatagtacaggggtaaaacgtactttttcgtttttttaataggtgcatattttttaaaagaaccgacacctatttttatattataggtgtaggtttttttttcctaaaattgacacctctagtgtttaaaggaaggtgtcggttctgtatatttttcatcgtgtggaggtgggaaaagatctataggtgccggttggtacctatatggccggtccttatgagaatttttgtaatagtgagtttgcaaaagtagtgtactgagtactgtacgtacgtaaaataatgtctaatcaaggccgtatacgaagatctggacggttagtttgatcagtttttctcggccaagagcagcaacggagcaaccaaacctgacttagtcgcaaacggataaataatctcataaatttataacgtacgatcggtgcatggtcttgctcgtctaacgaactcctcgtccctgctactgcaaatcatcgaaactccagttgaaaattagttgggcttgcacacaagtgctgtcctaacatatgcatcagctggaccacctccactggccataaagctcacaatggaaaatcttgcacctgttttaattagctatgatccaccatagtatgtatatggtccatacatgcatgcaagggcacataattagcttaattaattagctagtccttttcctgtgcctcaaaaagtgacaaaacatttcttatgtgcggctctagctagctaaggtaagtggacccatcaagttcgagatgatgaaaatgcatgcatgtttgtagaatgaggctgatttgtgaaggtttaggtggtgtttagattcagggaccagtcctgttacatcagatgtttgacactaatttgaagtattaaacatagactacttacgaaactaattgcataaatgaaagataattcgtgagacaaatttttaagcctaattaatttataattaatacatgtttactgtagcatcacataagctaatcatggattaattaggttcaatagattcgtctcgcaaattaggccagagttatgaaatgagttttatcaatagtctacgtttaatacttgtaattagtgtcaaacatccgatatgatagggactaagaattttagtgccatccaaacaaccccttagtttgcatgttccaagatatactttgatgatcatcgacatgcatgtgggtgtaaattggatttggatttgtcttattgatgctctaccatatcaggaaagtagtcttagacattataaatagacgtgacatttttcataaaatagggggatacactgtgatacgggtacaaattaaactatacaaatacaacaagacactagcttatttccatccaaagtcatgtatataaagcttgtttcggttagaggaaaattgtttttttactgtttaatctgcagattgaatattgcaatcagaaggatgaaaaaaaattaaaattggtgcgtcacacgaagttgctaaaattacagacatggcatgttctagatcaaaattgttgtaagattcccattggcccaatttgccttacccacaaactgaattccctttccggcatctttgtctagcaggggtaccgagtgccgagtacaacctaaacgaccaaaccgttgcaagccctgctctgaatcgatcatctccatgactcctttctggtgttttggaaagcaaagtcttgcaccttacctctttctgtcttcagtccacccggggtcaaattgtagatgcctctctgcttccgtttcttgggtaactgttcagcactcccaagttccaactccaagtgatcatgatagcaaaagaaaaggggtaaataataaggaaaagaaaaaaacaagacgcacaacaacgcaaacgtatacagatcacatgtacactttctgcatttcttaaacaaaaacagtacaaagaacattccattattccatataccttcgagcatgcttgccatataaaggtgccatgtctgagtcatcctaccaaagtagtcccaaggcaaacccaatcaacccgacctaactaacgccctccgtcttatcatagccgtccattgccacgatcgggcggccgcgcgcgtagtcaccgaccttttcgtaacaattcagttacaatgtagtactagtacaagtctattgtagcacagcttcacgttgccgaagcagaggttgcggtgcggtgccgccggtgcggctgtcacgtatatgcgcgcagcgcgcagacgatcgattcgtctgcgcatacgagctgacgcccactactaaaaacccacggaaacaacgccacgcgcggcgtgagatagatcgattcgttcgatcgaggcgcgggactcgcccggtggatcgcgttgcgtacgagcgtacgagggagaccgacgctgcagcgcacgtacacacgggacgcgacgagacgctgcagcgcagcgcagcctcgcgcgcgcacggcgaggggaagaaacacgcacgcgggggctggatcgcgcgctggctggctggggggaagcggcggttggcgagcagagcagagtgagttcccgtttctttctttgtgttcccgggcttttctcccattcatccacgcgccaccacgcggatcctattcttaggctcccgcggccggacctaaccggggcggttaagcgagggccgcacgttcgcgggaggcaggctatggccacggccgcgacgacgacgtcgtccacggcaaccaccaccaccaccacctgctcgtcaccgtcgtcgaccaccagccccatccacccggccgtcccgcaccggcggcgcctcaacgacatcgagcgcgtcgactacgcgcacggcgccgcggccgacgactgcgcggcctgcggcggcgtcgcgcccgacgccgccctcgcggacgacgacgagtgcggccacgggcaccccgtcgtcggggccgtcacgccctgcggcggcggcgggagggcggcgctgctgttggcgcggaggaagcgcgcgtgggtcgtcggggcgggcgggcaggcgtggatgaggggcgtcgtgctgtgcctgctcggcctcgtcgcggtcgtcgggttcttgggatcgcaccggcgaggcggaagcggcggcggtggcggtggcgcaggctctggcgccgttggcggcggcggcggcgacgacggcgggaggctcgtcaagaaggtggaggtggccgacgccgacgtgatggggtggacggaggagaacctgacggctctcacgcgccgcccgcccgacccgccggtgcgtacgtgcactcgccgttaatcactcgatcaactcttacttcacttgatcgacactcttttattaccaagatcatttagtcggtaataactactccgacataatcacacctgctcttggttttactctgggaattcaatgaactctctgaagtgtgtttcttttctgatcaaatgggactaatgttctaatctaaaagcattttttagtcaatgtctaatcaaaaccatttttttttgttacaaaacattggtccaaagggaaaaaaaagaagaaaaagaagatacagaggtgtgcttgcatctaggccagctgaggattgagtatatgagagaaaggatggatgataacgacaaggatatttgcttgtatttgttgctagcgtgattcattggcataaaaaaaagggaggcagagactatatgacattatgacgttagtttcagagtctagaaacaaagcatcccatttaaggcatttatctctcgactgcttttgtgcaaatgatttccttgttctttccgctgtttatttgtctctgcaaataagacgcatcgctttagttcttttttttctggtcgctgttgggcaattgcggcctcgcaagctagtagtcactcgtaatgagatgttaggacctgactgacctgcggttggtgccgttgaggttgctttcacttgtaattgtcaagtgatgcatttcaaggtgtgaaaaaggttttagtgcataaacagaaagagttttgctggtaaaatattaatcaatatcacatttctgttctctaaactaatgttaagttttattgcacaactgagtttaattgactaaaaagggacgtaattttccatcagacagcttaatattgtaatgctcttcttttggggtttgtgattgatagacttcgtaagattcatatttacccaatcggcggttctcttaggcgatcgttttgagtcagaatatatattgagaaacccttccttacctggtagtggtagggacatcaagatttatggctgtataggtttaggacagagctggcagagactgtccgaaagcaatattgtgcttatgttcagacaagaaatttcattcacgaaagcaagacatccattcaaatgccgtgctgtgcggcctgaatttactcgagtttcctttataacatcgacagatacctgagatatggatgaagccagacagtgagggttatagccaatgcattgaacgcccaaagaaccagcgcagtaatttccctctctatatctttcacttcaatctgttccagctccagttccatgctcatgttctctagttgggtgctcttattgcagggactaacaatgcaactgtcggttatctaattgttgatgcaaacggggggctaaatcagatgagaatgggtgtacgtatctatttaaacggtttaacatgcaacgcttttcagctaacccatactccttcgaaattattcttacagataagtgatatggttgcagtggcaaagatcatgaatgcatcactagtaattcccactctagatcatcagtcattctggactgatccaaggtctgtaccttttctactcaaggatcatccctcatgcccttataaaacatcaagtaaactgaccataagtccttgaatatagtgatttcaaagatatattcaatgttgagcacttcaaggaaatattaaaggaagatattgtaatcgtggattcccttccaccaacttacaaaagggtgaaaccctatatgagagcacctacctcctggtccagggtaggtgttcaaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaaaccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattttctcgatgccggggaggggtcggcagcggcaagccgcgggccgcgggccgcgggcggcggaggtggctggaggaggaggaggcaaagaaggaggttgctggcgagcgcgacagctgtggcgggttatctcctcccgccgctgctcgccgctcatcgctcttgttgacgaggtcgggcgaggattttctagatgccggggagggatcggtagttaggaggatggggggtcggcagcggtggtagaggggtagagatggcggcatcgttgccaagaacgaccttcaccgttccacccggctgacacc

SEQ ID NO: 9361 - DNA, 2292 bp, Oryza sativa
ggcaccgtgggtgggggttcgatggtgacgggcgaaggaagaggtgcgcaacggccgagcgtgtcctcaccgccgggatccaaggccgccgtcgccagtcccccggacgacctcgattcccgcgagctatccgcctgcccgccgccccgttgtcgtcacgcgccgccgctcgccactgctccttgcagactgcagagcaagggagagatagatgggggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggaggctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactaggcgaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggcgatgggcgccggcgcggcgat

SEQ ID NO: 9362 - DNA, 2863 bp, Oryza sativa
gcgcctcccccacatcgccgcgccggcgcccaccgctctccaccgcgtctccgccgcccatcgctctccaccgcgccgccattgcgcctacgccctccctctctttcaggtcgcctcccccgccgattacctcgcgattcccaaccctaacccccgccgccggcgcgtagcgccgccgccgcccctgctgcccaggatccccccgccttttctccttccgcccacctgccaccgacgccgccacccctggcagtgactcctcctccccgccgccaacgccaccgccgtcgacgcctactcctgtggcagtgtggaggactgctgcttccctgtctccatcaggtgtgtgcacgatttgtgtttgttaaaatgcttatgtgaaaaagctgtgggtatacaatgatatgctgcagattatcttttcctgttataggttgatcaataatggtttccttaattcaactttcatattgctgaatcttttggtctacattgatagctgatgcattggggtgtgattatacaaatgatttctgttggtaatgatttttccctaccttgcagacagaggaataccggacagttttttttctttcttttcttctgttggggtgggttcatttcagaaatacccaatttgttaggttgaccacatgtccccattttgatctgcaaggtcacagacaattctcttgtaatgtgtatgtgcattgtttgtcagaaacctgtcgaatgggaggcaccatcataattatatgatctaataatatgaagtaaccatcaactgatctgagtgtggaggtaatttctaaccctcacctctgatgtttgatgaatttcattttctcgtatatactttgtttgaccagatttcctgctatgtaaatacacatatatgattgtgtacatactagctagatctttcctcttagagcatggacaatataatggttcaggcgactattatctacataatctagaccacacaatagaatattttaagcagatttttcataagtgccaaccactgcctatgttttgctattaatatatagtatagttcctttcgagaatttgcacaaagtctatagaaaatcagaatataagtgcgaccacggccttcctgaaagttagaaaaatcttctcaagcatatagcatatagtctgatggtcatttcataaaaatctcttgatatgattttataagtgaacataccaaattagtttgaatgtacattgttcgttttcacgggattccgacatccgttgtcagtgatcgagatcctgttttcactgggcacttttggagtgagcttttccggttggctggtgtcaaactacatatgagctcggcatttcagaacactaggacaaataacatgttgtatacattctgggatgcctgaatatatggttgcttatgatggaatcagaaaatgataagttctgcagtattttcaaatgcggaagctgatttagaatttgagaatgttggctcatgatgacaacaactctgtacatgtacattctgcagatagagaagcttttcttgattgaagcattttaagacttgtactacaccagatgtgcccccttgagaaacaaaggttagtgttctgctatcgagtttttttttagattgtagcaaatagagattttgttaatttttaatcaaatgtgaagctaaacttctcattaatctgggattgttttccataattgtcccggtgtcagagattgacaattgatttcacaaccaaatgaaaggtagtgtttttctgggaatgccatcaggggcgcagatctgagtgtagtcaaaatccttcaatttttcaaatccgtttggtaaaagttaccactttctgaattccatgcaaggactgacttatgaaaattttactgtatattattgttctataatttgtttataaaagtaatgcagtaatgctataggaatgatgggaccctaggagttagtggcatatatcatcgacacacttgcatggccaggggaattataactcaggtgctcaccgaggatcaactgtccaggatccaggatttttagcatttgttttattgaacgctggaattacttttctcctcgtgccatctaaaggtaacttcaaagctaaatggctggccatgtataatcctaggagcataaatatttttacaaactatataaatttctttgtgaaattttaatagtgattcagtgttgcaacgggaaatgctatatacatggccagccatttatattcagtgtttaagtcgatatattgaccacagatttggtttatatcagtaaatggccatgtttttttcccaagttatgtttctaaatatgtagactgtggtacgatatttataaagttcaagttgtctttgtttcccagaaaatcttaggtctagcagacttacttagtttctgtttacaaatgaataatcgggtagtgaatactatacctgtatatttgtactactctcttatttagtaatgtatctaaaataatgtagactgtactacaatatttatttagatgcatatgctcaatttttatataagtatatgctgcttttacattacttttgtttgaatgtacatgctgatatgaaatttggagagctttcttggaatgtacgctgttaagaaaatttagataaattaaatccttatgccttatattgtttcttaaacacacctataagtttgattggagaaggggacattaaccaattgcttgaaaaaggtgttttgttagctcaagatatggtggaatatttacaactgttttagtaactcccagataatctttctctacatacatgcataactaatttctctaggataatgacacat

SEQ ID NO: 9363 - DNA, 2710 bp, Oryza sativa
tattttaatttactactctctttcacaaaaattaaaacatgcgatttttgaattattttatcttggggttttgcgtttgactacaattttatatttcaacaactttataaaatacaataaatttgtgataaaggggagttattattttaatgataaatatgggcagatcatttagcattcggataaagacatgtatatcttgcttggatatttgtattttagacatgttttgaatatgtttcttcaaaagttattttgatttgtattgttaaatattaccgtagcgttagcacgggcagattactagttcgacgaaggcaagagatgagggaggtaaaatagacttattcccactcaaaaagcttaaaatgacataagcccgatactaaactaaaggcccattattagtataaaacactgctggcccaccgcgttcttccgcctttactgtaggagtgttaggtttagggcttccgccgccgcctcctcctccaaaacctcgtcggcgcgccgccgcggccaagccgctgtgctgtacaagaaccggttcggcgacaacgtaagttccgtgcccgacgaggtatttgttcgctgccccctcctcctcctcttcagtgttccttttttttctccgagagcatcggtgatgttacatccatctaaactcatccttgcactatgaggtcaccggtgaagaaaaaattgggggaatatgtagtctgagatgctctgttgatcctctccttggatcattcttttctactgagctgatgacgcggctggagatttcagctgctgtttgttttcgttttctgaagcctgagagcaccagtgatgtttacatccacactcatccttgcactatgaggttattaccagtgaagaaatcattgggggaatatgtagtctgagttgctcctgcttttcctttctcgcgattctgctttaatttgtggatttatggttgattttttttggctttgcctttatgcttcttgattcctctcgtggatttgtggttgatttttggctttgcctttatgcttcttgggttcctctcgtgaatactgatttcagcttctttctgtggcttgatagccaccaggtagatggggaaggcaaagcgtgcgtcgatttttatcaggcttgtttcagcagctggaaccgggtttttctatgtgaagcgcaagaatcctcgtcggatcacagagaagcttgaatttaggaagtatgatccacgagttaacaagcatgttctctttacagaagcaaagatgaagtgagatggtgctgggcaaatcttctccacaatgtgcaaagctgaataacctgcaaaaaaaactcgtgtcaggattcaggaacctgtctactgttaagaatgctatgatcagtttatcaccctgttctggttccagcgttttatgcagacaatttcaacaagtatgagtttgatcttgattagcactggaattctgatgttatgcatgttggttttgttttttggaatgggctgtaagcctgcaaactaggaatgctttgattgttttaccatatccccgttaaagcaaaattctatcatggcaacttgtagataggattcaccatactgaatttgactgtatgtattcctttaaacatgtttgtcaatacctggaagttatcttgaatttggccatgatctgcattgagacaaatgattcagtgtaccttcttttttttaacattggtttggaaaacactacaaaattcctttggaaacattgtaaaattctccgatccaaatggagcctaaacatgtgtgatttgtaagattggcaggacctggtattcttcttgaatatgctgcaacctgtactgtaagttgtaacagaagtagtttagactctacaatctgaacttgtttgacaagaactcaagataaaggacttcagctgctccacaagttttacctgacctggcgatatctgctgttaagcaacactgggacttctccgggcttctcttcatcacacggatcactggacctggcttgctcattgctgcattttgatcatggattttatcgtcgatggttgctgaaagcgtttcagtgttgcaaatttacatttctttttgtgcttacgacctttcagaattgtaatattgtaatttttctcctgctctatcgaaaaaaattacagccgttcgcatctagaatttgtgtgggccgtttgctttaaagctcctgtaccgaaggcttcttgtatcgtcttgggcttgtgggacaacacaaattcgcaattgtttagctcaaaaaccttgttactccaaacaaaatgaaacatttcaatcgatcagttagacagtaacaaagaaacagaagaatttcctggagaataagcattcgtagtggtggaccaaatcgctcgtcagaatgtcagaatctggctctagcgacgggttcctagtttcaaaggagggccaaacttgggcctttccttttgccgggcgtgttacagcctggtaattgggcttggtcttagcttatgctttcttctgcaacagcaaccgctcgtgtgacctggaccactttgcctgactgaaaacacttgaacctctgctacaatttcacccaaaagaaactacaaacttctgcaaagtggatagcacataacagcattcttttgggtaccctaggttgtctttagtcctcgtagtgctcgattgacat

SEQ ID NO: 9364 - DNA, 10113 bp, Oryza sativa
tgctagcagtacagtgtatggattgttcctttgttaattattgccattgtgggacggttgacgcctaaccactgctagctaatccccttttctctttcagggcttcaaagttcaaagagagggtagcatcatgcttgctttagtcagaagaaagtcactcacatccctactgttctagctttcagttgagatcaactcaatcaaagatgccatgccttcgaactatacaagcaaatcgcatgcccctgcttatagtcactggacggagggtcctatgatctttgggccccactttcggtgacattatgtacttcagaaggatggagaaattagagaatttattagaagtaggagtattgtatatgtgtctccgggaatggaccatatatggggatatggatagctgaatggaaacagcacgaaaacataaaatattttttgaactttgccgtttggatagtagcagggttggtgatactttgcgtctttggttgttaagcagttagcatgacgttctggtcattttgctgcttctattatttcgctagattccctctactttgcctttgccggttttgccatgcttttaacagtttcctgttgtgcttccatgcatgttactgaactagttagtatcgtctaaatttgatgaacttctttctttttttcccctttttacacgaaaacatgagcttatgttcgttggatagcagcagccagcaagattatagccttggatagctggtacgtcttacgttcttaaataattgattgtttaagtttaagcttgttttatcttcaaaaaaaagtttaagcttgattgtctgtctttttttttcctgaaaaaaaattataaatgctttgttggtgctagatgggatctgcgctccgaactccttgaacttgaacagtagtacagtaccatcaagattttgttggtttaatatacaatagtagttcacaatccccttaactagtttctaaaataataatggatacgtggaacaggaggcaataacgcacacaatgaaaaatatgccactacttcaagttccgaaagcaacctttatgggatggttttagccaattttcgtatttagggcccctttaaatcgcaggattgagaaaacgtagaaataagaaaaacatagaattttgatagaaatgtaagtgtaaaacagaggattgcaaaacacaggaaaaacataggaatgaccgtttgattgaaccgcagaaaaaacaaaggaattggatgagaaagatagactcaaaggaaagttaccaagaggttaaagttcttgctaaatttttccaaaaatctctataagtttatccattccatagaaatttcaaaggattgaatatttcaaagagcttcataggaaattttcctataggattgaacctccaaaatttctatgtttttcctcctaataaaaagggtccttacttttgcagagtagaattctgaatgaattttgagatatttgttcttcaaaattcgtgtgaagttatccatgatccaaacatataaaagggttatgactgcttagcaacaagaggtaccaaaagataccaagaactctacactatcttctcttttttttccttcgagaaactctacactagttaactataggaagtatcaaagagttactgaaagctaagggcccctttgaatcttaggattgagaaaacataggattttgatagaaatgtaagtgtaaaacagaggattgcaaaacgcagaaaaaacacaggaatgaccgtttgattgaaccgcaggaaaagcacatgaattgaatgagacagaaagactcaaaaggaaagttaccaagaggttgagggcccctttgaatcgtagaaatgaaaaaacggaggaatatgaaaaacataggattagtgacaggaatgtaagtgtaaaacagaggattgcaaaacacagaaaaaacacaagaataattgccaaggagtgaacctctctagcgggaggacgtgagaaccccctttgtgagttcggccaggggaataaggcgcgatgatcaagagcgtatcttcgccgtgggattacgctaacgtggtggatggcgatcgagaaggagacagaggatttatccaggttcgggccgctgagaagcgtaacaccctacttctgtatgtggattcaagcttatgctgttgcaagagttctcaaaccctagggagatggtcggctaactttctcctaaggttcaagcttccaagagtcgttgttttgctcggtgggcaaggtcctccttttatagttcaaggggttaccacatgcaccgtctctacacatatcgtccttggaggggggcccacatcaacccgggctgagtagccaaccatgccttaggccggaagtaaggtggcagcttgtcctcaggtgggtcccagcgctatccttcgtctgacacgagggacatcccccgtcattccctcttaaattcatggagactttggcgaatgcatgcacaggagaggcaccaattgtacattggtctccgagcgttgatgggacggggcatacctgcccccacgctgcctgacacaaggcggggcgtgggtgcgctgccgcccatcccatccacctgcggccggtcttagcccggtcaaggacgattgacgcacgtcaatcgattggacgtcgcacgaccagccacgctgtattaaatgcggcggtggtggttgggacgccgcccatcaatgcgcttggcagcgccccttcctccacccactcagctgcgacgtggcagccgagcgtgggccccggggcgacgcagcccctcgggcccgaggggtgcaacgggataccccgagacccctaggcggttacgggcgcctttcggctacttactacctgcgcgcccgacccccccccctctcgatggggcccaggccgcgcagccacgtggctaggggaaaggaccctttccccttagcatgggtacccccgggcccatatcatcgataatgatcgtttgattagactacagaaaaaacataggaatcggatgagagaaatagactcaaaggattcttaccaagaggttggacctcttgctaattttcctccaaaaccaatatgcaataagccattccataggaaatttataggatttggaaaacttcaatcctttaaatcaaagggctacataggaaaatttcctataggatttcaatcctatgaaattccttcgtaatttctttgattcaaaggggccctaaagctctggctaaatttcctccaaaaatctatataggattgtcaatttcacatgaattttaaaggattggataggattcaatcatttgtgtcaaagggcttcataggaaattttcctataggtttaaaatccaccaaaatttctatgtttttcctctaaatcaaagggccctaacctaaacactgttccctgaatgatttcttctatgattacgaatgatctaccagaaactccatgcccctgacagcaacacaccaccagatagcaacatcaaattggattttaggaattaagcaacaagctactctagtatagcaacaagacctgacaagtttagccagggggccagccagcctctcccgacgaacgatcgaagccagctgctgcattattagtgtgcagtgcagagctctgtagcaactgaatcatggcggactccttcctgcctgcctcccttccaaagctagccattgcgtgctggagcgatggatcgagtactactaagtagtactccgttctagtggcgatcgaactgccgatccatcgagcaacgtatgcaactttggggcacataatgatatacgatcatgtactgatgtaccgagtaaaaccatggacaggccagtacttgacaatatgtactccttcctccaaaaaaatacctgcatcttttgttactatcttcaaccctgctaagtacaggggaatctacaattacccatgtttaaatgcatgtgttaagctgcaccctgtgaaatctgtgatgtataataacctacaaaattaagatgcagtcatgcagacaatcaatcaaagtggatgcattttgttaaaaaaaaaattcataaggctggtagcctcattatctgagaaataaggctgtcaattctgcttcgttgtttgctggtttgagtacggattgagcatgcttcactgaaatcatgaactggttcttcccgaaatgagatcatggaaggcttgccattcactcatccacaaccggagcttcttttccatgataacagtatgggtctcataaactatggctctgtgatgtattccttacaaatgagtcccagaattcgacaaacacaattgtaaatgatcttataatggaatggccatgggtcaaacatttgctcctaaaattggtgaatcattgataatctaggagggccaagacatgataggtgtcttcctttaacatctcccctttttctgttgttgcccattccctgctgttctttctcagaaattttaccctaccatgctaccagcagtttatgatttatgcttgatttttacaaaaacacgctatgaaacaaacacttaattttcacctgacaggtaattaacaggtcccatggtatatgaagccatgaacatttctttaatttcttaaaacaaaattgttattaatcgaacctttctgaagcagtcttaagaaaaatagagattttctttaaccaaaacatggacaggaaatcacgatgagatatgttccatccgtctcaaaaagaattaaacgctacgaatgtccagaactccagattcatttctaagatttgaattttttagaatgaaaggagtataaccttctaattgcacacagtatttggtagtaactggcatgagaaattgacagaacatatgattttttttctctgtttcacgaaaaaaaatatcttttttttgtttggttgagtcgttgtttgcctactccacagcatccatcatccacagctgagagatttgataatttaacactcttttcaatgggtttcgattatttgacatcctggcccattttcattcactcagatggtctcatatatcatcctcacaaatgttaattaaagtaattagacaacgaaaaaatgtcaaattattaaatttttctccacagctacaccctcctcctctcccgaaccccaatcaccatggccataagacgatgagctgagagagagagagagttccaaccatctcctctcctctcttctcttctcttctcttctctcttctctctcctctccccgacaagcacagggctcgtcttttcctttcttcccctcactcttttccccttcactcacacacagtcacactgtgcgagcctgtgtgggactgtgggtgttggccattccagtacaatccgttctctttattcctccctctcctgcttgtctcgttgcgtggccgtggccttgtgcggttttatggatcaagaaacctcacgagaaccccgacgcttcggccgtctggtggcgcggcgctagccatctctttggatcgctcctcgcgatcgcattgcggccgcgttctttgatttttggttttttttttgtccggtcaaaggttggttcttggtggtgtagattcggagtggcgtgtcgtggcggcggttttttgttgttgttgttgttgttggtagatactggttcggattgtttcttggaggaggaggaatttcgcgtcttggtgagttgggatttgatctttgggccggctgaaattgggattttgttttgttttgattgagttgcggtttgttttgtctggattaggagcaatggcgggcggcggcgggcagtcggcgatcgccgctgaggacgacgacctcgagcgcggcgcggagcgcgacgaggaggaggaggaggggagccaatacttcaccgacgcggaggaccaccagtcgtgggcgtcgcactcgcgccacaactccaccgcctacgaggactacatctccacctgcgcctccgtccgcgcgagctcctacgacggcgaggcggaggaggaggaggatgccggcggcggcggcggcggcgtcgagcaccaccgcaggaagtcgtcgtgcgtgtcggagtgctcgctggacgacgtcgacctggaggccgggctggccgaggtcatcaagggcagccccgagaaggcggagaggtgctgccgcatttgccaccttggcctcgagaccgcggcggcggagtccggcgccggcatcacgctcggctgctcctgcaagggcgacctctcctactcccacaagcagtgcgccgagacatggttcaagattagaggcaacaagtaagctccagactcactcatctaatccactctcaattactatttgattagatgcaatgttcgaagtcgaactccatatgttagctcggataaatcgatgaatcaattagtttattattattggataaggcatcacgcatcagcgtaagagcgaagtaacacaagatttatttcagatatatatatatactagggcatatgggtgtatgaacacatggttaaggaatcttgataggtgtctgtttttttttccctttgctttctttgggcggacaaaggtaaaggagcagatggggaggaaaaggcgaagtagtggattaattagtagtgttgtaggaatcgggaaggttgagatcattggagaggataaaggtaggattcgttctttcaatctgcttttctcacagattctccgtggcatctgattgttcctctggagtgttgtgttgaccaagtttgtttgttgatagattgacatggtctgatactatgatgcgccagtctatgtgacatgcctttttttttccttcgatttgatggtgcgagggaggtgtgattgtgtcatcttccattctgaaagtgtttgtttcaacacaattgtagttaggtgatccactgagtctcagtcacaaccataatgtgctccacttagccttgatccacttaataaaattgttgttaagagaatcaaccatagtgtgctccacatagtctcagactctgaagtgataaccgcttccagcgtaggaaaatggcctattatagacaggggatggttatagacaaaattggttttaaattttaataatcatggcttagttgctagtcagtgtaaaaaaggtgttgggcaatacaaactagtctgcaagtctaatttttttagtggttggtgttttctttctcataaaaatcggtagcgcaaaccgacacacaagtacctgttttgttcttgatattattttttactttatttttgcttatatattgttgccacagcttgatcactgtaagatttgctcaaactactaacaagaacatttgctgactaatgcagtttaggctaatgagattagttcaacaatataattacactaaagtttgaaccacagatattgtaattggaaactgtgaaccacggcaactcttactttataaaattatttcgattctatttctagagccaaatttctcaaatgagtctgaaatttcagaccttggtggtaataatgatttacttatgtgacatcagcttcagcaatattcattgcaccgattattgttttcacactatgagatgtaatagtgagccctgaaattcctatgctgctcccatgctgagaagaatagactgaattctgatcactgtgtttgtctgcacttggatctttttggacaattagtaatttttaagttttagctcctaccttttttccgtttgcagtacaaggctataggaaaacactgcggtaattcttgcaaatatatctatatttactgaggcttttatccttactcgcccaataatcaatgttagagtatatggtggttagagcaataatgttgttagattgatttatatcgtagtcttccttttctgtagatccctccttatctccacaccttttgtactcttaacaatcaaaattgcatcaatcatacttgtactgcttaaatcatttttttacactgcttaaatcatacttgataagttgatatccccaacattttacactcatttaatgacataacctgtcaatcaccttatcaaatttcagtaaaatagaattgaatggccctcaataatttcaatcttacttcaagtgcgaaggtgataggttttgagtacatttaaactaaatgatctatccttctgtttgccaggatatgtgaaatctgtagctctaccgcatgcaatgtggtaggcattggtgattcagaatccgttgagcaatggaatgaatcgaacagcacagcacctgcacaagcaccaccagctgaaactcagagattttggcaagggcatcggttcctgaactttcttcttgcttgcatggttttcgcctttgttatctcatggctctttcatttcaacgtcccgggctaagttttgaaacacatggtcctcaataaaagctccaatgccattactacacacctgtgggttggatttagtaaatctgaagaacaggctgaggtgaaggaaagttatgaagtggtacaaaaatgttgggtggggcatgttgatcttaactgtgtcaatggcaattgcctcctttcacaacgaccaagattccattagacaagaagctggaaggacaatttcctcctgtttcccttgtctggatggagatgaaaacaaagaatggagaatgtgtttgttccgtcaatagtgctgtcatggttttcaggaagagattgtgctgtatccattccctatcttctcaggcaatttatcatttattctgctgatttggtgtaagtgttatcttccaggagaaaaatgtgctgagttcggaagcatgtcgccagaaagaataaacaatattgtgaagttcctgggcatatcgccgcacatgaaattgtcgattttgtggagataatcctgtaatggtcctttcgacgtttgtgactccgtgttcggttgtttgttggatggagtacatgatgaaatgtcactctttgttggacgttagtactctttgttggatggagtactacagaatagtactagtagaatttttttatccatgctcattctaaacaatatatcatttcatcagtctttttcgtggtactaatgtggatatgtttgaccacgaagagaactgttgagttgaagaaattactgacttgtggcccaactctctctgtccttaaaaaagccggcctcgtactgtacgtgatacatatattatttctagattcgttatactaaaatatatcacattttaatacaggattggtttcttatattttaatacaaggttggtttcttttgggagagacagagggagtagcgggggaaacccatttggtccatgtcgaagcttgtactgctctttttgtcttaaaatataaggatctggatttgtatcacatccatctaaaatcccttatatctgggacggatggagtacaaagtacacgtggtacaatcttgcgactagagattggaactcctgtgagtgttcgattcagtgcgtgtctggcataaacacgcaataaattgcacgatacttggtggacgtatactggagtacatactaccaccaccaccgtcttttagtttacacacttagaccttgtttagttgcggaaaatttttgggtttgattgtcatatcggatatactaacacacatttgaagtattaaacgtagtctaataacaaaacaaattacagattccgccagaaaaccatgagacaaatttattaagcctaattaatctgttattagcaaatgtttactgtagcaccatattgtcaaatcatgcgtaattaggcctaaaagattcgtctcacaatttacacgcaatctgtataattagttttttttcctacatttaatactctatgcatgtgtccaaatattcgatgtgacagtgtaaaaatttttattttggaaactaaactaggcttacaccgtgctgcagccaggcccagatataaatgcaaattggttgctggaaggccacggtgccaagacacggctacaggttgatgttgaattgttgatgcaggttgaaagtatggacgcgtatgatgagatcgcgtgctgtgc

SEQ ID NO: 9365 - DNA, 2566 bp, Oryza sativa
cgaggcgttactaccaagactcaaaccaatcactcccaatcccctcgatctaattggcaatcaacagaaaatcaagatgaggaacaaaatttgatgcattctacgctcgccgaaaaattcttgcgcttccacagcccgcaatgtgtccaacaagtagccacctagatgccggatgagtcgccactcatgaacgctggcggcctgtggtacttccttccactactctccgtctaacagcaatgtactttcctattcaccgggtgacgtcgcatgttgtggccgatctctgcgccacgccctggtctgctaattcttagtgtacctataaaacccacccttcgcattacgctgtatttagtttttgaaattagagagaagttaggggaaagttggtagtttgaaaaaaaaaagttaaaagtttatatgtgtagaaaagttttagatgtgatgtgatgaaaagttgagtgggggaagtttggtgtgaactaaatagggctttagttattaagttgtgattcgatgtaatcccgtgccccgatcaatttttatcctccatccgcctctgcacacaggctctctgtcgtgcgattgttgcctccacctcgacgcggatagccgagctgcgcacaccatcgctctgcgctcccctacgtcgccgttcgcgcgacgcgctggcacgtggtctcccgctccgctcacccacgctgtcgccgtgcgcgtccgtgccacatcgcgtgagcgacacgctccaggcgaaaagcatgtgggtgggcaaccaaaaccgtcggtgagtgtgccaatacacgaatgaacaaacaattgatcagaaagattaagctggccactatgtacagcgacagctagtgactccgaagaacgtactacggcggccaagatcctgattcctgaatagcgtctaccgcccgattgattagagcaccaaatcatccattcatttcattcgttttatctgcgatcatgctatagtaccaggatggtggatgagcagaaatcgacaaggaaaccatgtgtaatgctgcctctgccgctggaatcttgttcaggatgtgcatgcactatgcagatggaccgggcggttgttctcaatccgcccccagaggattctcctcggggtcgacgcgagaagacaaactcccggtggaaagcagatgccgcggctcatgtaccaccattgacagcagcgtcggagagcgtgctgtgggcgtgattgatgtcttcatcgtgcctcccgttcatctgcgcgcgctgtcgctgaattgatagaaacagacacgtcagaaaaaaaaagtgcaatgtgacagtttgttccagtatgcctagtagatggctcctccaatcaagatcgaggtttttgttgtaatccctctcccaaaatataatactaacctaaaaccagattgaacgtatatatccagattctcatagtactagaatacaatccgatactaaactactccctccgacccaaaaaaaagacaaaccctggtttccgtgtccaacgtttgaccgtccgtcttatttgaaaaaattatgaaaaaaattaaaaagacaagtcacgcataaaatattaatcatattttatcatctaacaacaatgaaaatacgaattataaaaaaatttcatataagacggacaatcaaagttggacacggaaacccaagatttgccttttttgggacgaagggagtaagctgctactaggttacgtcaaatccagattatctaagtatattctaggaagtacttcctccgtcccaaaatgtaagcattttttaggttggcacgggtattaagaaagtaggtgagaatgattgaataaggtgtgtaattggttgaaaagagaaagtaggtgaaaaaaaatggttgtgattggttgagaggagaaggtaggtagaaaaatagcttcattttgggataaagtactgtgctagaaatagctacattttgggacggaggtagtatattattaggatggagggagtaattaaactagcaagggttgtaaacaaatttagtagtactcgctccgtctcaataaacaaatcatgagatgtgacgtattctagtataatgatctgagcaggttatcgcatctcataatatgtttgtttattttgggacggagaaagtaggatccagcatagtataaagtataggcaagttcatctaatagacaggctgactgtactaagctaggcttgttcagggagtatatagggagaagacttctacaatacccgatcagtaggatccccatggtttccgtttaatagcttatggaactcttccttcagtctgctgtctttctcctccttcaacctgccatccttttccctggtactcaatggaagcaaaggtactccatttgtacgatccggcatttctgtaaatatctcaacaaagcttgttacaaagtgtttgccatacaaatccctgtaaaggcgtaaggcaacaaatgtgacaaaaatataacctgggagtttgttgtccacgaagaatacgactaaattaacggtatacctgcatgggaaaagtatgtgaaaa

SEQ ID NO: 9366 - DNA, 1204 bp, Oryza sativa
caagagtaaaaatcatgtgagatgaaaatatcagatcaccgcagccaaaaagtactccacgaggaactgaaaaagaaaaaatgaacttgtgtgatcaggaaaaattccttgcgcagctgtcaaaccacaatagaaacttacagttaatcaggagcacttcaaatacattgttgggtggtggaagagtagccaactttgagccctataaaggtaaaagcttcggatgagtgctaaaatgagtaattgacaggtttacaagttttcacatgtccaaaagcagagcaagagtgcatgtaaaattcttggctaaaatgaaaaaggcacctcacgacaatggtagtttgggcccggaagctgggtggaatagaacgtaatgattcttaaaacctgcgaagcctgaagaagaaatattcagttacttttcagtggcatgcataaactatatcaatggaaaaataggaagaatgcactcacaactaaaaaggctagcacccggcgccagattaggacagtgtagaatcttttgctatgataaataaaaggatgaaaagtccactgcacataaatatacttgtgagacccagcttgataagttgcagtataaaaaggaatcacataaatgcatgaaaggaactataatcttcaatatgtcatgaccaggaatatgacccatctctcaacagagaatgatgatagatcacgcctattatttttttatttatgcttaggtgttgatatctgaatgatctagtttttcttggttatacaaattatcagttatcaattaaacaaacagaaataagtagagtacaaggatacatactaaaacaaaggaagcgaagatggaagcaaatatgctctcacttagataacctttgtcttgcccaaactcctaaaaacaacggtaataattggctgttacatatgcaaattaatcgatagcaaaaaggataagtgatttacttactggaagggccataaatccaaggtcctgcagaagtggaccaggtcgatgcaagtaatgcactcctcgagcagccagcccatgaatatactaattataggcaaaatattgtatgaatctccaaagtaatccattaatcaactgacaaacacagaagaataagtaatcctatataactaaatgcagaataaaaaagtagaactgaacacagaaaaactccatcacgccaaaaagaaaagg

SEQ ID NO: 9367 - DNA, 5217 bp, Oryza sativa
  unsure (1)..(5217): unsure at all n locations
gcccaactatggtcttgcttttaaagttaggcattgcgatctaaaactgcatgaacttattgaccaagattttcaaccgttatgctgtgaatgtgcaagtcacatgacttgagtgcacacacagaaatattctgtttagtgttcagagagacagcacacttatatcccaaatgtcaaaataatataggaatcagagattggatcagtgagtggtgggtcagaactcagaagacactgtctactatcagcaagactgtatcacagacaaaataagttggattgagtagcatttaaaaatagttctcatgaacttttattgtggatttatgagaaagtaatagtagttacaagaatacatctaggaaaattcacaacatgcatagtaactattatttccatgcatgacatgatagttcaggcgatatactgttaaaagaaacataaacctatattaatttttaaaacaaggcaatgaggatagatttaacatgtctcagaaaggaaaacagaagacagatgaatacaagagtatcaattgacacagatggcgacaattcacctctacaatggcatataccatgtaagagcgcggcactagctagacaaacatttgaacaaagtgtttacccgctcaattttcttatactgctcacggccaatgaatttttcatgccatgcatacagcaggactgttccttattatgacattccattgcaatttcaaaaccgaaaaggcaatctgtgcccagggcatcattcattcattccttgaaagagcagcactgaatccctaatctacacagactacaaagaatgcactccaatatacaacacagaacacttgtaaatgttactgactacagatttagtatagctatttaaggtctcgcctagcaaccaaaaaaaccccaaaggctaatcacatggctactaaaaaaccccaaaacggcaacattatcaacgataacaaagtgcaaatcgcgttgcaacaggggggggcaaatttggcaacctctcatcaactcggcattaaaattctgtaacgcactccaccactagcaataaccacatcacgcgcgaaatcagtaattccacgcacacgaccgaaaactagtactactagtaacaaactgacgagctcacctgaaacacaattccggcgaggagcaatccccacttctcgcgcagcagcgagagctccaccgacgtctccgtggtcaccttcctccatacctacacaacaagaggtgaaaaaaataaaaatcgcaaattcacacgacgcgatcgacaaagaaatccacactaaaaaaagcacaagatcgaaaaaaaaaacagagagaaaaccttggaagcctcccgcgctatgtaaatcgtcatggccgcaccccgccgcgcgacccctgctcccaccccgaccgctgcagctcctaccgtgcgacgcgatcaagtccatgctccgatccacacatcacgccacagcccgccgcatccccgcgtcgggatcgccgccccaggagtaaaagacaccgccgagaaaccagagaagcgggcggaaaactcgtttcccaacaatctggctccgcctccggcgccggcagacgaaggccgctagctccctcacctgcgcgggggcgggccacgcggtgtacggacggggggcggcggtggccggcggcggcgtgagcaccgagagagacttggactttggagagagctggagggggggggggagttgtggagagatcganaaaacgagagaggagagcgatggatggtggaaatatgggagagatgagggggttttatgaaaaaaaggggggtgttgaggatggagcacgaaggtcgtggggggttttaactgaaccttttgggaggaggccgtttgatctggatggacgacgtggagtggagcaaaacacatgacttcgtgctctaaaagttttactaccctcaaatccatccggacatccttatgtgtctcgttaagattcttaatttagggttggtttggtttgtggtctaaataggccttaccaatttttatcaatgccaaattttggtaagttttggcatgtctaatttttttgttaagataaagttgtgtttggattgaatccaaaatagcttaatttcactattgaaatgacatatttttttaggcatgccaaaatttggcttcaaaccaaatacacactaaacactattgaaaataccaaatattggtaagcctaatttaggccttaaaccgaagcccttactgaatttctctgctctgctcttctcttctactgttactctaaaaacgcaatcgttctatacttccattctcttctcatgccgtataccgtatttttgtgcatttataatggtgctactagaacttattcagtccacgtaacaaacaccgtgattgaattatgacgaaacacaagccacaaaccacaaaaacttttcgttagaccggcctttcgaaatgtagtagaagattcagatgcaactctcctggtctagtggagtcggctgttgcacgaggccccacggcgttttgttgatagaggtccagatcaaataccctgtcctagttgcggataccgacccgagcgacgggtggccggatcatgctgctacatgacaagtcagtgctaaccttctcgcaaagagacagattcgtgcttgcgtattttaatactaccgtatagtagtatctgccacatgcagtgatgcagagcaaaaaggccatcgatactgtatctcctagcagctgtagcagactgaataatgatcagtcatgcctcaattaccgattcctccctaaaaaaacctattttatctctttttattatttttctaaacaaaataaacataattgtaatctccatacatataatacttagtaaaaggttttatctttttattactactcaattgaatttttaatcggaaccgaacagacatcttaaacccacttcgaatcaaaggaaattcacatgaattttagaggattttattcctattggaattgaaaggaatcttaggccccctttttattcataggaattcataggaatactcatgggttgtctgcttgaatgtatttcttttttctttttgtctttgttacatgttgtatcgctagtatgagttaatttcttcttccttctagtaaaaaaaatagtacattcatcttagtttgatcatttttaggtcttttcaaaataatcgtcctctctaacaagtgtctcttcgtttattatttgtgcaacgagtaaatgtgttgcatggaattaaccaatattagtttttgttggtgcaacttcatgtaatatttaaaatgtaatgcaattcacaaggcataaaagcgacgtagcaccttgattgatgatgattaattttcgaatgatgaaggtcttgttgtccttagtccctaccttttttttagacgatgattatattgggatggaggaagtatgccctaaacttgcgtatagatgaattactatacattgaaaaatgattaccaataagtcttgaaaagttgaaattattggtgatttggtactggtcgttttttttttttttgctatggaggcacagggcttatttagtctggacggaagtgatgtgttgcttgcagtacatataaatgaaacgtgcatttgttgactttaagcaatggttcacttgagcgcatgatctgctagttgcgcaacacgcagatgcaaggctatgggctatgtggcgtgagagtacatgttcgatggttgcaacggcttatgccgggtgtgatgggcaatttgcacgccacgatgagatgcttgtattcgacggtttaatgaaggattatacagcaaatggagaggtgtgtattgattaattacttcgtggcttggggtataaagagcactaggaatcttggatctctcgcaagaacaagtgacatgttaggttgttctgtgacatgttagcgtccagtgggaatttagctgtgacagttaggatagaggtaggttggtcaaaattctaaatgccagagttacccatgtgatgttgaaataggaaaatattgatgccacggcaaaaggtcagctttgactggtgccatgccaacaaaacctggtggcctggccctcccaatctcctatgttgccaatgccaattgctactacaaggacaaaactgcaataatgaattttcttgagcttgtttgtgcaagaatcccagtatgtttttttttttctatcgaagtcaacaggtttttagctttgacctatcagaggataccgtgtccagtgtatttgcattatgaattttcttgagcttgtttgtgcaagaatcccagtatttgtttcagcattggtaaagggtgagatcacaagacacaggactataagccggagttgatttcaatctataaggggatgtcccatcgttatctacatgtcacttaaatagttataaattttttaaaaaaaataagtatcaaaaatgtattaacatgtgatatatcactccacaaacatgcaagtttaaattcaacttccacatctcgtaacgaaaaaaatcaaatttgactctgaatatatgttaactagctatagtttaatttgttttttcgttgcaagaacgtagaagttgaatttgaacttgcatgtttgtggagtgatatatcacattttaatacatcttctcaattttttttattttattttttcataaccatttgagtgacatgtaaataacgaggggatatcccctcccctcgagtaatcaaaatagtttcccgactataagcatatgcgtttgggtcatggatgaggcagggtgagacgaggcgtgctcacctttgagggtgtttggttcagcgaccggttgaatgagtttatatctgaggttacgtttggttaatcctttctacaagaggatctgaaagagatttattctaaacctattatagtctaagattattcaccctcaatctactccattcccttttactgccaattgaccaaacaagacctaaaagagaatactcctttaatctaggttggtcttgtctcttacaaactcatggatcgattcaaattagttttctcttactgacatatgggtcatctcttaaaaacaagactatctcatacgaaaaggataaatggttacatccaattaaaaacatatatgagtactctaacctgtttcccttcgtctccaaatcgaaca

SEQ ID NO: 9368 - DNA, 3273 bp, Oryza sativa
tgtttttttagtgtattggttagtaatatgctgataacatgtgtaacaaattgaagcatgagaaaaggtataacaaaatagttcttgatgtcacgatgacaaagtagtgttattggatagagggggaaaaatggggaaaatacaaagaaacaaaaggtcagcctcaacgaaattgtctgcctaattctgacagtccttatcagcatccaacattgcccggtcagctaagagtaacagatagcaaaagccaacgttccaacaaatggcatgttctctcgcatgataaggtggttaacgcccaatggacaaccgagtttttgctagcacaaatcctatcatgccctgtctgtaactgtaagtggaacaagtatacgctgacgggacgatttcaccggatccagattttgctgctggtgtcttagttttcaatttttctggccggtacgacggtacgctcgccacatttctgttgtttttatactttcgtaagttacaaccttattactgctttagaaaaaggagttggtgccgctggtataccgtcctctccaatctccatggctcacgtttaaccctcacgtttggccttgaaatatgctcacttcatctccaaataaacaaacaacatatcctcggctgcgttggaggtggcggcggttttgcatcggcggctgctggcgtcggtggctgatgacagcagcagcggcaacggcggccggcttgcggcggccatgactgaggaggcggcggcgacatcggcagatgcggcagtggaggcagggaaggagtcgggtgtgaggtgacggcggcgacagtgaggtggtggtgaccatgacggtggtgggaggaggcatggcggcctcggacggcttgccgagggcgtcgcagacggctacatcggaccggcgcagcatcgtttggaggaggggtcggagaccagcttgacgcagagtggcgcaaccgatggcagtggaggccgactcgacgcgagaggcgcgagtagcggagatggaggtcggcttggcgtgagaggcgcggccgatggagggaggccggattggcgcgagaggcgcgtccggtggaggaggctggcttggcgcgagaagcgcggccggcggtggaagaggcgacctcggtgcgtggtggagctactggtgggtgtggcacggtcttcggcgtacgaaggttggccagcggggggggggggcatcggtgcaggggccccacatgtcggcagagtttgagtggtggtggagcattggtgcgtcagccgtggattcgcaggtggggagcggcgggtgaaaacccagcccggcctttgccggaccgacaacgatggttaattccccctcctgaaggtgttgtcgtgctgtctcacccctcaagggtggttgccgggtgaaagcccagtcttggctcctttgagccctgacggacggtggcagcggttttccgtcgcttcttttcttgaagacgccgttttggcacccccttgctgtagggcgatctcgtatgtgttcatttgttggtctagcggcggccggtcacgcttagcagcggccggtctagtgctaaccttctcctgtcgtgtgtgttggcgctgccggtgcgtgggtggtggtatattttttttctttttcctggttacgaccctccagggttgtaatcttgtaatctttttcctgctctatcaatagaatatcgcaccgtctcgtgcgggttgttaaagaaaaatttaagcttgttctttcgtatcactatgtatcacatctcgttctagttttatttattttagaacggatagagtacgtgtgaatgtgttcaaaaatcaaaacccgtatttgtgtaagcatctgtatcttacgaacaagaaaactgacgttagtttagaatcaggttaatgcattataaaatgcacaaaaaagactgtgggttggtttggtttgtggcataaataggccttaccaatttttgtcaatgtcaaattttagcaagttttggtatgtttaattttgataaggtaaagttgtgtttggattgaagccaaaatagcctaaattcactattgaaatgacctattttcttaggcatgccaaaatttggcttcaaaccaaatacacactaaacactattgaaaataccaaatattagtaagcctaatttaggccttaaaccaaaccagtcctgtgtttcggaaacaacgtaaccttagttttttaagacaaattaccaggccagttatgtccgtgagacagtaattggtccgaacaaaattctcttatccataaaacctcatcttccgtaggccttgtgcttgggtagcagttctaaaaagaataagcccctccctccatataggtttaatcttgtttgtatttccacaataccagatattataacaccctaactattagaactagaactggtgtaatttaactccctcagcggtttacgctaacgtggcttgttgactagtccaatcaacagagtcagcatacgagcccccctcctccattctttctttctttccaccctcgccgatcatcgccgttatctccccggtccgctcctcgcgttactctctgggtgaagttctcgagctccagatggcgcccttgatctggcatgtcaaggagaagcagaagtagccaccacgggcaaggagtggtagcaccagaaacatcccgagcagcaaggagcagcagctcgcgcggagcaggtcccaccatcacgatggtgggtggagtagggagctagcagtagcgagcatcgacttctccctcgatctcaccccagcaagagctcaagccgtgaggttgacggctccttcctggcggcgcgtggggcaagcagagctcgaccttggagcagcttagagaaaggaggggccgtcgagggttggcttctgcttctccatggctcgatcaggtgggcttcccaaagcttttggaaggttctcgcccaatcgattggagacgagggagcagcaaatggctgccacggtgctcaccagcctcgccaccacgtcctgtggtgttgtccaacggtggacaccgcacaggccgtcccttcttcctcctaccacagggcaatgctcctcgctgaccacatcctccaccgctgctgcagcagatccctccctctcctccgctggcggtgatgtcagggtgaggctgcccgcccaattcttcctcataccacaggcagcgctccctacggaccgacgcctgactagcgcgtttccaccgccgcaacggatccctctccctcctc

SEQ ID NO: 9369 - DNA, 58653 bp, Oryza sativa
agcgatcccggactagttggatcggctggtgtttgatcaatgtctggttgtggctggtgttcttttagcaaaaatggaaagaaatgtgtgtatttagtaatcgatgcatgagtgcatgattagcgagttcagagtgccatgccctaatcaggctatcgcaggacttgtgaatagaagggaataatatcatacatgtatatatgtgaaccgcggttcaaccgcctaggccaccagtcaatcgggtcacccaccagttcattttttttaactatgaataatggcggcatcggtgacgacggaacggagacacagcatgaggaagagtcactgatgatggcactagtatctgggaggggggagacacggcgtgtggaagagccgctaatgctggcatcgtggagggggagaaggaagggtgtgacaaagggcttgggaaggcttgggaaggaggcattgtcgcgtcgacatcctcgaggtaaggaggaagggcagggggctgcgagcgacagtgaccccaacatctgtctaaaaatgtggccccctgagtccacactagttttaccagcggaatgggcccaaaacggaggtatatttggcctacggaccatccattcaccatttctacatttaccctcgaaaatgatttgggttggtattttacatctgtattaggcaaaaaacagagcttccaagcagactctgaggaagtcaaattagttcggttttaataggctaaggatgaagatatccggtattgcagatcaagaatacggatgagattgcaactatattggagggagtcaaggtggacttattctgttctagaatcactttacaggcccagcttaccgtacattcactcatcagagcaacacgacagccgtccaagtcgcggccatgcgtagcagagggccagagcccagacgccagccagacaggcagcgtcgtagtgcgttacggagctttgccacgaactctcgtagtcccgtgtactcccggaccggagcagtaggggttcgggagcagtatgccgtgccgtgcccgacggggaatgcatgacctgacagtaacagtacaacccactactagcttcaaatcatctatagccaatgtaatagtcaattcatacaatagttgattactacactattaatacatggtcccacatatcatacacatattacgtcttggagttcgtgctacagctggctatagatatgtagtccgctactattttctctctttttttatctctttaaaatatgtttataactggcttatagcctgttattgtagtgaagacgtgctgtgggcccgcacaccatgagccatgacaccgactactgccgtttggtgttttaccgttctgggttttcgctcgcatggtgcccacgtagagacgatagacgaaaagaatttgaaaatgtacttttatttatcatattttgcatttatatacctgtataagattattttataaaaatatatctaatccgtgcggaatggttgcgcgggagcgagggcgaaccgcagactcgagccggtcaagcggaaccgggatgcgcgactgagccggtctcgcatggctacactgcgggatcaagtcggtaccatggcgccgaagcgcgggagcgatggcgtcgggggagcgtggcggtactgcataacggcggcgcggcaccggcgcggtcccgcggttccagcgcgtggtatcgagccagtctccggctccgtgtgttattccgtgttaatcccccaattttttccaactcatctccttcattttccgcgcgcacgcttttcaaactgctaaacggtgtaatttttgcaaaaagtatctatactaaagttgctcagaaaaatcatattaatctattttttaaaaaaattaactaataattaattaatcacgtgctaatgtactgctccgttttccgtgcggacatgtattcacgagttgggaaagggcgtgcgtatggcagcggtagtccgcgcatccgccatgtgggagagaggccggtcccacgcatccaatatgcaggagcgctccggatccgtgtgttattcccctaatatttccaacccatctccttccttttccgcgcgcacgtttttcaaactactaaacggtgtattttttgcaacaaattactcacatattatggaaacgctctattaagagaatccgtttcaatttttgttgtactcatgatgttacactacgtatagatcaaatgttgcagtgaattaaaacatctcgctatttgcttaaacattttttatatatggtaaaacaatacccgattttttgaaaaccatttgtttcatacattgtagcaaaatgttccatgcaggtgatttggttgtatctcatttttttaaacgattgaacattttcgatctacttagtgaaatagattccgatctacttggtggaatagagcccgattaatcgggcgtccgattcgtagtcgcctcggaaaaactcttatacgtgcaatgcgccggctcttcaacatcagatccgaaaatgcacccttcccgaaaacttttcggcgaaagggggtaactatatttatagcgccatatttttcaccaacaaatagtcagcatgtatttacattgtaagtccctaaattacatatgtaattttagtgtatttacaatgtaaattctaaaattacatatgtaagtctctaaattacatatgtaattttagtatatttacaatgtaagttctaaaattacatatgtaagtcctaaaattatatatgtagtagtttttttcatgaaaacacatgctgacgagatgagaaatttgaattgattggcttcacgatgcaacacgaaacacgtaaagacgttccatgcacatgtgtagcgcccgttccgtcgtggcgcctagcgggaaaattaaattctaaaaaccatatttgcgaaagtcgtttctttgcttgttgtctatgtgcgtgccaatctctgatctcgaatccccgatccatcgtcgaattcaaatttcaagtccaaatctctcctaaattccatccctctgaaaaagtctagtttgcctccctcaggttcagtgggccgatttccctctcggcccatctctctctctgtctctctccctcagctttcccctcgctctgcccgtgcgcagcacgcgtgtgcgcgtgagccgacgccgagtcgagccgagcaccatctcctctctctcgttctctcgctctccctctccccgtctctctccccggcgaccccccgcccgtgaatttcgaacccgcgcaccgttgcttcgcgcgcgcgtgcccgcgcgttcgccgccgtcgtcagccgcctgctgcccgtgcctgcgccgtccggccctgcgccctgccacgctgcgcctgcgccgcgccctgccccgcgagccagcacgcgtgcccgagccgcgccgctcgcatccgtccaaaacccgaagacggagctcccgctcccatccctctcccttcccaaattggcatggcgcgcccctcctttctcccctccgtttctccctttcccctctcggcccggcccctgcttcctccgttcggttcccgcgccatggacacagaggagcagccgcccaagccgttgcccgcgtttgaccgcgcccgtgaagcctatcccttcccctcgaagctccctcgcaccctagtgtcgcccaagatcggtttccgaaccgacattgccgcctataaacccgagcccctccccaaaccaatctcccccgttttcaccctcgccattgccgctctcttgccctgtttcgtcgtcgccatccgttgttgagcgtgccggaggagccggcgcgttcgtggacgcgtgacgtggactccgggcgctcgtcttcttcctcttcctcatcccgaggccgaaacgatcacgtttcgcgccgtcggccatcgtcactacgccccttcaccccgtcgcggtagtgcactccccgttctccctcctcgttccctctcctccccttagactcgagtagtagcacgactagaccccccgtagctagctggcgtcgccctaagccttgccgccgcccgctatgtgctcgccgccgtcgccgcccgagctcggtagcgcctctcatcgccggcctccctcggtgccttttctcctaatccagcgcaaggaacggactccggtggccgcgtagatccgctggtccggagaaatcgaactcccgtcaccctttccccttttctcgccaccggatgccgccgcagcaatccgctgccgtcgagcatccctcggcgaatccgagccattggctcgtctcccctcgtcccgtgctacctcccggtgtgctcgctttcgcctgtatcaccgtggttctccccgccgttcgcagccgccgtccgtcgtccgttccggccgacgccttcttcaacctcctgccggctagcgtggcagccatgtaggcgccacgtcggcgccacctcggccgcgaccaggtcaagctaaccctggtccgccgctcccctccgccccgccctcgcgcgcggtccaccgtgatccgtaaggctgcgcgtgggcccgccgcatccgcacccaccgcgagccgcgcgcgtgcaccgcgtccctcccccaaaccctagcgcgcgccgcgtgctccctccgcgcgatgaaccgtgtcaccaacaagcgggtcccactcgggaccacgcgaggtgagcccggtccaccggttccctctctcacctcccgcgcaccctactgggccgagtcctctcgggccggccggcccattagctcggccgagccgcgcctcttctctcgggccgcgccctagccgcccgagggaagtctactcgtcctccctctttcttttcttttcaaaaggatttaaataaatcatttttcctttagatcaaaaatccaataatcttagaaattcaatatcttcttaaccgtacatccgattgactccgttcaacttccaaaaatcctcaattctcgagatctatccaatggcacgcatagaggtcaataatagagctttattttcgccgtttgttgagttgtcccgtttcgtgtgtagtttcggagcccgaagacccgcagtgcgaggatttcgaggatcaagctcaagatctcaagcaaggcaagtcacctttgatcatcttgcacctataatttaaatctaattatttcttttccgcaaatattgcatgaatatgtttaacacaagtatttcggccacggcttgcgagatagcctgccggcctcaaccctaattgctgcaattaccctccttgaattattgaacacttaaacctcctttgtcgactgttgtgcttcgatgcacgggccttcgggcacgcgcatcggaacacctcccctcaaatttaaaatatccaacgatgggtaaaacttggggttttacaaaagacttggaaaacccgacacctgggtcggtgcttgcgaactaaatgaatttccaaaatcgcggaccggggaacgtaccgggagtacggtttcccactcttgcacttaaggatcgtttccttggaatttcatccgaacataagacaagtgcgaccacatgggtgtaatgggacacccctggttgagtaattagctaatcgggggaaccatgatgccaaaagacatgtggattcaacggggtggtgccggggagaacccccggatttcctggcacagtatggtgtgggacctaacctggtgttggtctgggacccctctcgttggcatatggtgaacctgtgtcggctttcaaaatgccttgtcatgaaagcctcaaggtctctagacgtggccgttatgcatgggctgggtgatccgggttagtaatgtcgtgtgggtaaagtgtaccccctctgcagaggttattaaactgttcgaacagccgtgcccatggtcatgggcggatgtgaggtgattcctagcgtagttttgtatgactactgctttgtgaaattgttgctgtgaaatgggttcgatgtttggaaaatctgcggctgatggggtcagccaggcccgggtggccatttgaaagctgttggccgggtgccaaccttgaatcaattcaaagattgatacattgcacatactccgaccagacgagacacactgtcacatccgtgtcgtttgagaagtactcacttagttgttttaaaaaggagtttaaataaaatcaattgcaaaaacaacagcctttcctttgaagcctgcattaaacacttaattcccacggcttgctgagtactcctgtactcacccttactctataaaaataatccccccggttgctgaagaagatgaagtggatcccgctgacgaggagttcttccaggagcaagtcggctacgatgagttttagggtttcggtctagttcccaagtcgcgcctgtgatgattggtccaagtcttggcttccgttttcccttttgtaatgcagttatgagctcgggatctgtccgcaacccaacatgactgtactcctactctgtaataaagagacctctgttgttgtgatattctgttttcctgtgataccaacaatgttttctgggactggtatcgattaacaggttaatttggagcgtcacgagctagttccgttcgggactagttcggggcgtgacaacatggtattgcaatcgtacacgaatctcaagggagatcaattgaacaagaaatctactgtgattactcacaaaatgtgtcgatataattatagcaacaccgcggcgaaaagcgacgtcgccttctatcgatcgtaatgtacgcacgacgcttccagcaaattaacaacgggacaagccaatccatgcagcacgccatactcgatcgatcacaacttcgcagggaatcgaggatagccgaggcgtgaagcagacgcgacccgggccgcatccatccatctgcccccgcgcgccgattcctcgtgctcgtgcgcgcgacatgcggggcgcgtgtcctctgccacccgtcccgtcccgtccgtgcgcgcgcgcgatttcttaaagccggcgacatgccgtcggcgggtgcacgacagcgaccgccgaccggggccaatccgtggcttgtactcttgcgccaccgttggccccgccggccggcatggccgcgagaggaggccatttatcagttgcgtcttggcaatatatggtgtgttttcttgctttctgcattaatgagagcaagtttaatagtatagccaactactagctccaattcatctatagtcaatctaatagctcattcatataatagttatatactgcactattaatatctggtctcacctatcatatatacattgcgtcttggagtccgtgctacagctggctataaatctgtagcccgctgctattctctctccttatttatcttcttaaaatatgtttgtagctgacttatagcctactattgtacctgctctgatgatcaatccagcaccgaaatggaagccatctttaaataagcagattgctggatggagcccatccgtgcaccgtgccatggtccatgcgtcgcgttgattagcgctagctgctggtcgagccgacttgtgttgcttgcagcgtccgtcgacggcagcttagcgcgcgctggcacgtagagttgccttattaatgtcgggggtggctcgccatgttctgcgacagcagatcgaaatgagaagttaagaaacccatgttcggaaaatggattgccgcgtgctcgagatcacactggccgacaggtgggcctctcagttgcattcctcagctatgctctggacagcagtgcctgccaattgtgtcaaacggtcaaaccccatcctgaagaaagcttaaaacaaaccctttttgcacagtagaccatacataggcacatagctacagtctgtgagtagattagatcattagagtactttgttactgcactagtgaccactgtcctagcttaagaaatcaccctccctctagtacgcacagctgtctttcttgacaatatctgtactactatgtgttaaaaatacagagagaacatgaacacttgtccttaacatagagtaacccatttcggcaagttcggtaatatatccaaccactctacataaatccgtttggttacatgtgttactctatctcatatctgatgctttcttaggtggttaagctatcaacaagctacctgctcacttgaatcaacagttcctcgacgccaatgagtaggcggttgtgaagagccaattttatcatgtttttcagccacacatgaagtagaatccaccgattcataatcatctataatcgtttttacgcgctttgcaactagacaaaaatcggtattggagagcaatgcaattccccttacattctcgtccaataatctaatttgacgatccaaaagaaaccaaatccatggggaggagatataaaacatagttcacccccataatgcaatgcccctcctgtagatattttttggtcaccaaagacaatagtgtggacccctgcagggtcctcaaagggaaaggcaccagagttaattaactggttgtcttactagatcctagctgttcctctgctgacagtggttgtgtttgtgtatctcggtcccctctgcatccttcctcggtttagtcctgacgaggaggggaaaaaaaataacccagccactacacacctgctggtccaacagctagaaacagctaaccgctgccccagcaagccggtgaactgtcatcacgcccagatccagggacattctcttttcgctttgtcggcgtctactccatcgatctaccacaccctgttcatacgcatttgtctcggttgccgccatccgccaccaacgtgatacctgaaaattttcattcatacgatgaacagagccatctgccatctactaatctagttgctgaacaaagtctaaggccagtcacaatggctagtgtcattgcacggctacccaaaatattataccatcttctctcaaatgaaatcttttatgaaacaatccccacagtggaggggtttcactttgacgtttccaagactaagcaaagcatttaattgatacaagttgctgggatcatttgtacccaaaatccggcgcggcgcgggagaatgcggaggtcgcacggcggaggcggacgcaagagatccggtgaatgaaacgaatcggcctcaacgggggtttcactctgttaccgaggacttggaaacgacgctgacgagtttcaccaggatgaaactctttccttctctctcatccccatttcatgcaaataatcattttttattcagtcttacccctattaaatgtgcatgacacaccagtgaaacccccattgtgactggcctaacagatcctcctcctctcccaagatggagaattagttgccgacaaaattattaaggattagttacgacttcttagaggaggtacaatagcatgctataagccagctgcaaacatatttaaagcagataaatgaggagagagaaaagcagcgggctacagatttatagccagctgtagcacggactccaagacgcaatgtgtgtatgacaggtggggccatgtattaatagtgtagtatgtaactattatatgaataagctattagattgactataaatgaattggagctagtagttggctatactattaaacttgctcttaccggtgtgtgcaaccatatactccacttatcatatatatatatgcgcgtcggagcgaaattttgcagggtggttgtgatctctccggtgtttgttgttatacagacgtatgtatgttcatacataatgttgccaaacggcaaccgaatttcacacatgctttcaagtttcagcagatgttggttatcgagggattggtgggtgaacaacacagagcagaagagagctgtacgttccaacaaaccattgaacaagtcactgtatgtatctgaacaacgccatactatgggggtgtttagatggggctaaacctttttagcctatgtcacatcggatgtttagacgctaacttggagtattaaatatagactaataaaaaaactaatttcataaatgagagctaatccacgagacgaattttttaagcctaattaatccataattatcaaaagtttattgtagcattacattgtcaaaattatagcgtaattagactcaaaagatttgtctcacgaattagtccaaggttatgaaaataggttttgtaattagtgtatgtttaatacttcaaattagtatccaaacattcaataagacagtgacttattctaagtctctcgaaacgaaataggccctatacattttctttttctgcaaaagaaaatgaaaacgtaggccggttgcgagtgcgtgctgaggcaatcaatcatacattcgagttcattcaactgagcacaatcagtggcaaagcttgctgcaaaacgggggtcccagtcgtactaccttcctatgatttgttaaggccctaattatagaatctagtaagagacagcggagaccaaaagagtgcaggctgagcactctgccctccatttgctagcagaggcaaggctctgtgtagatgattactccttttaacaattcgattatacagattactgaaacttcaccttcgatttaacaattcgatggttgccacagctatattcatccatgtgacgacctaggcttagagcagatagataatgaacgcccaccatcagcctgaccaacggagcagcactatacattcgtgatacggagaactactcctttatttatgtgcccctatagccggaacatttgattacgtccgcacaaagcacggttcatgtacatgaaaattgcaggataaattgcaccggacggcagcgacatgtatcctcctctcatgtcaattcgctctggaagctcgccaattggatttgggcccctacgtgagtctccgaaagtttttacttccactcgttcaaggagtgtgtagttcgcatccgatgtccatagtgaaggtgcaacaaggcgtagggatactaataatctgtgattactcaacttgtggtttgagatgtagaatatgtgcaagtgaccagtatgcaagtagtactagcaccatacaggctagtaatacgctcgagagaataggagtacatcttaagctaggcaggcagcaagcatttctaaactgattggtcggagctgattaaaacggattacagggtggtggccccacaacactagtccagtttaggttgccaacccagtatcgccattggttcattggctagtactagtagcaagccgagaccggccggtggtggtggccctcctcaccagcgcctcacctcggctctttttgcccctccccccgccgtctcgtccccaacgtgacggccacatgggtgccggttgccccccacaccgatcgatcgatcgatcaatccaccagctcactcctcacccccatcaggtgcgcgcaaccacctttccaccgatcacgacgctcccccatccccgtctgctcggctcggcgcagcgcacccacacccacgccgtcgtgcgcgccacccgagcccgcaaggcggaggtaaaaactgggatgggataccgtgcggtttaccccagcgggaaaaagggacaagatcatcgtaacacggcccgaggcgaggaagagagggggtctactttcgggggtcgagtcggtggaacccgagggcgctttctcttggaaacacgcctggtgcgccatgcgacgcaacgcaatggtgagagacggacggacggacggaaacatcgagcaaaaagagaggagggctttgggcctttgaccgggtcaagagaggagaggacgcatgcaaaacacagagagcagaatataaaccggccgaactcatgcgcccatgaatacgcatgccagggccagtccaagaggaagacgggggatgatgacatgatccaatccaaaattgcttttatggcgggcattggagcggagcggagcggagcaagcagaggctctcccgccaaaactcttcaaggccattaaaatcggcagaggcagagagctactatgacggaacggacggacggatggtgatggctccagcggctgagccacccattccagctagacccacgctggatcctgcgatcgagctagccgagccaagcctgggactctctttggggatgcgtcgttttctcggcgagcacgcaggggactaccggagatctagtcagatgctgacccacagccaggcagattcctaggcggttagtcgccggacaaactgttcatcctccattgtgcaagtgtactacaccatccactctataatcatgtatttattgtcaactagtaagaaatactcaccatcattcatatattaaggctttgatggtacaaatacaactgttgtttaacaacacccagcccaactttgctgctgctgcggctaagcaccgaactactacacccctaaataagaatcttattgtaccgaaccaaaacagaaggttagggcacctataagctagtacaagaaaaatggcaattaaattcatagtttccttttcttttttttccttaagaaaggaacgcccttattcacggagcccacggcaagcttcttttgcaagtaaaagactgcaaaaaggagggaggagggagagagaccttatagctgggtgtgcgctggtacttcacttcttggcaagcacccaaagcaagcaaagccatggatgatgtagaaatgggtttatttttggctcccccaagatgacccatccataaaccactttgatgataccttgtcacttcttgcttgcaagctgcacaagccgctaacatttctctctcgccctccaaaagaaccacttattattattccttccaaaccactctgccaaaccaccaaaccgaagacatggatttcctctactgcacgtcgtctccgtctccatctccgccgctttccgtccacaccaaaaaaccaatatatcaccaatcaaacaaacaaacctaacgctgatgatactactgcctcctactaccctctttggctaatactaccacctaacagacgaagtactgttactaactttaattaatatgattaaacttgacgcaaagccagaagggggccgccggaatcttggtgcatcatccttcgtctgctccggccgacacaaaaaagttcacgaactgtggcagagcgcaggcgccggcgccggcgacggcacggctggagacgcgcgccgcttctggctggccagcatggcgttgctccggttaatcaaagcgtctgcataaaaaaaaacaactcgacataagcttttgcttgccatttccgtcgagaaaagaggatttcgccgcatgtggtggttaccgtgatcgagaacgaaaccgccggggtagcgaggctgggcgccgaggtcgtcgaggttgagattgagcgcttgcacgacacgggcggggacaagaacagtcgagcagcctgcagggtcgcggaaaacaccaaaggggaagaatattgagccaaaagaacaggggaatacgccggcaaaagcaaacggccaaaaatggcggacactgcacctgtctttctcttgggctccgccggtgcgccggccgggcgagggaggaagacgccggtgccgttgcgctcgcgcttggcgccgggcggggtgaggaacacggcgcgcatgccgccgccgccgccacccccgactccgggtgccggcgcgtgctgctgcttctgcaagggaggccacgccgcagggttcatgtcgacaggcgacgcggcgactccgcacccggcggtcttcgccgctgccgtctgcctcgcgccccacgcggcggccgcggcgagatgccgatccctctgcaacttcagcagctgctgctgcttgaggagatgaaactgaaacaggagaaaaatgtcggggagaaaaaaccgcggaaaacgacggtgcaactgaagaatctctgcatgaaccaagtacctgtgcggcttgaatctggcgctgtgtaagcaactgggcgagcggatggtagtaggcggcgggagcgacctttgttgccggtggagaaacgggaggcggcggcgaggccttgcgcgccggagcggcaaagccaccgtgggcggggaagccgtagggattgttcggcaccgggatgctgttggtgacccgcatgcgcgccacctgacctgccgcctcatagagcatgtcccacgggtccgccggcttctgctccaacggcgacgacggcggcgagctcacctgagacgccccgccgttcgggctctcctggccggacttgggcagcccacacagcgtcgactgcggcgaaccaaccgtcacctccgcctgcacacgaaaaaccaatcaaaaaccacgacacatcatccccctttgaaagaaccaagaaaaatcaaaccaccttgggaggcgcgtcgcgctcgccgtcgtcaccaagaagcccggcgaggcggcgggagaggccggccaagcaatcctcctcgtcgctgctatcgctcctcgcggccacggcggccttctcctcctcggagaagaagtcgtcgtcgaggaactcatccggcagcaagaactcctcgccaccgtcggaccactccgtcgccatttccctccaattccccaccacaacaatcctgacctccttcccccccgagagttatggcgtgccggtttggtgggcgagaacctctgcccgcccgaggacgacgagaagaactagtgacagcttcgaaccgtacggacagcggccacaaccagctatccggccggtcccccccacacacaaaggaggcggagaacgaagggcgcgaagccgagcgcgacgcaagcggcggcgagtagagaggttcttgtcgccgaaaagaagcgggcggagaaggagatggggggcgtgagaatgtcgctggacggcggcaccgcgagtcaaaatgctgctcggcctcgccgcgacgggggctataaaagaggcgagcgagaggagagagaaagggaagccggattatcatctctcagtgttttttttttgcgtaaattaagcggtttaaatcaaatgtttttttctttttttttttggagtggtgagcaagtgggagttgagtgacggccggtgaaccgtagcgcccccaaatgcctctcccctgttcagcgtcagcgagggggatttcgagtactcttgcgcgtattttttgggccgtgcaatgcaagaccgagggagttattatggggtcagtacgtagttgtggtacgaattcatctcggatctactcctatatttttgccggatgtttgtgtgcgtggggcgatcatgtcaagcgcatttcacccactacaccgtttgctaaatggtggttcaaccgattttagagaagatcacaccacccaaatggacccaaaatggagcagaagcaaaagcttaatttcttttacatcggcgatacaacacccactctaccctggccgctgtacgcaccacctctcgtcaatccccagttgtgaaaatctcacaccgaacagtgcccaatcacggcgtattcacggcgtgtttcgtgcgtgtacctagtgagattgttattgctccattgaatgcacgccacgtcggcgggggtaaagggatgggttagcgccatacggtcacgagaattgcatattctcaggacgatttttttttacagcgcattaaagtcgtgagcgctttaaagcggggagttttggtactacggtgagtggaaaagagaaagaggcagtggtatgatgtgtgtgtggtgtcgggcacatgtcacgtagcagcagtagtaggcaaatgctgcgcaccgtaacgcaccactgcatcattgcatttttcacatcgcccgataacccgccataaatcgagtgaaaagcggtgaaactgaaccgggaccgggtggcccgttcggcgacgagccagatgaaacgacgccgacggcgacgaaccgctgcatcggtaactgaccacgggacccacccgaggcgtcccttctggtgatcgggatggtgcttcgtgtggcgggaggggagtttgatttctggggagaccgtttttttgcccctacgcatgcaccgtttcgaaaaaataatttctcattttttgtttgaatttgaagccttgcctttaaaatcaagtactgatcgaaactgcagcaggttttccagtggcgtgtcagaatcccttccgtggaagtggtggcaatgcggataagggcgaggcaagcaaacggcaaactgctgccatgtagtcctcgcttagcccacctgtcgctctctccgtgggcccacatgtcagtgagccgcaccccagtgcgtgggtcccaccgaggagagcggcctctcggattcctgtgaatctccgcgcgcctggctgacgcgcgccacgccggagattcccgatacggcttggcgcccacgtcgctgtcgggcgggccccgcgccacgcacgtcaccctccctctccgtcaattataacggcggcgcggttgtcgcggtcggtggggtccacggcaaccgctgtggccgacgtggtgggacccttttggtcctgcgaactcgccgaaaccatcgtacccagagttttttcgcgtcctttcgttcaagtttttcacgtttccctctcaataaaaagctttttctgtagttctttttcccataaaatttctttacaagaaaaagtgtttgttgcgtaggccgctgttattatcgtgtccaatgaaattcgggaggccacgaaaaaaactacgctagcgtttgcccctcttttttcaagtgtttacgcattttttttctcgggtttttttctggaaaaaaaacgctatccggatcaggagggtgaggcgttgaggcggtggacgtggggacgtgttcacccaccagaaaatgactggtttcatctggtatataaaaaagaaagaaaaaacgaaagaataaaagataaccagaacgattgattgcatggttgaataggaaaagagagccccatgcacacaggggaatacggttgtgacatgatttccaccgtttgcgtggtgctaatgttgcttttagcgatgattactgacgatgacaacggatgatattattacctcaatgtatatttactaagtgggtagtaagatgagacccacaaaactggatagtaggtgttttgattctcacaatgtataggtaagctgggtcccacatttaagaggagtggatgggtgaggtagagagaaagaatgagagataatagagttttaatatttgtttattacttgttacatgatagtagtgctactacccagatgatactattgctcactttattacatgcctcataatagtaaactaggtagtaggatttcttactacctactttttagcacattgtagatgccctactctatacgagcgaaatgaaaacatgaacctgcagtgatgcaagcccggggtgtcctgtgtcggatcccgattgggtgagcccgctatttcgtgacgtgcccggagagcgacgtgatcctttttattcaagagcggccgatgagttgctgattacggtagcggtagtagtacttgcacttaggacacccacaatggttatctataggctctctacaagagatccatgtcagcatatttttctacttgaaagatattaaatgaagagagagagcaaaactatctactaacttagagatagtctatagagaaaaacgaggcaatacatgagagagctatagatactgttgtagacatactattgaggtggtttactattaatctagtctattgctgagatgtacatgttttatagagagcaccttactttaccattgcgggtgctcttatagcatttacaatagcatgctataagttagctgtaaacatattttaagaagataaatgaagagagagaagagcagtgggctacagatttatagccagctatagcacggactccaagacacaatgtgtgtatgacaggtggaaccagttattaataatgtagtatgcactgtaattattatatgaattagctattagatttggctgtagatgaattagagccagtagttagcttatactattagacttgcttacaactacaagttctttgcttttttttccttttgaatcggatgggcgtcatgcacggttgccttcttttttgaaaaacgaaatgttggtgtgtgcattggatgctctctgctgcgagaaagacgcaactttttccaaaagcgatcttgtttcgagtggaggaagagagcagcgaggggcccgagtgttcttcccgaccgattcaagcgagcacagttcataaaagatggacatcagtagtagtactagtactataaccatacattactccctccgtctcaaaaaaaaaaagacaaatctggtttccgtgtccaatatttgaccatccgtcttatttaaaaaaattataaaaaaaattaaaaagataagtcacgcataaagtattaatcatgttttattatctaacaacaataaaaatactaattataaaaaaatttcatataagacggacagttaaacattagcatggaaatctaaggtttgtctttttttaggacggagggagtactctctaaccctgtctctacattgccaagacatgcaagaacaccaaccaggagacaggcgaaaaaacaacgataaagaacgcgcaaacaaagactcgacggtttgacgagcattttgaacctcagtagctcgagtagtagagtgttttttttcctcttcttgttttggcgtttgtctccagaccggcctgcacgctcccacagcacgcggcacggcagcgcagcgcagccgtagctcctcccctttctgggagtcgctccggccaacctttcgccactcgcctgcgccgccgcagcgacacgcccgtcgcaacagcgcaccgcttcggtgaaagaaacgcactctgcctctgctgctgctgctactgcctggctgcctggctcgtgagtagtagtagctgttgcgtctacactgcatcgcatgcgcgtgccgtgcgaacaggtcagaaaatgcagctgcagcggcgcccgctagcgtccatggatcgatataattttcacgtagctacagtgtaatgaagtacagtactcctgctagtagtgtgtttttattagacggataattagtgccggactgccggtggtcgtaccaaatggacgttgttaagaggggttttaccgaagaaaacagagctccaaagctggcgaagtttggtgataggacgatcagaggagacggagaccgtacggttttcaagataaccgagagcatttcttggcttggagcttgtgaccgaattgaccgaggcagcagtcagtgaaagatcgattatttgtatttagagcgaggtcaatagtgcaacacactacttgctccaaatcatctatagtcaatgtaatagttaattcatacaatagttgtttactatactattaatacctgatctcacctatcatacacatattacgtcttgaagtccgtgctgcagctggctagcccactgttcttctctctctttctttatctttttaaaatatatttatagatggcttatagcctgctatcgtacctgctcttatggccagggcctgcgcctgcctgggtggcgtctgcaactcgtgtcactgcggctcgcgtttgctgcggtcgcagggccagctgttcccggtcaaacccagtttggcgcctctgtagctggctttcccgccatttgtggacaggccggagctttcccgcgcaaatagaggcgcctgctcgccgctcccggttgcaggggcacgggctaacatggacatggcgcgtattgtcgtgtttttgtttgacttttggcaagtttgaaaagagtatactaatattatctactatatatactaaaagtctattaaacatcttataaacacccttaagataccgcgtgatgttctaataaattaggaaaaatctaacgaaacttataagaaaaaaaataaaaatatatagccattaatttacacttaaatcagtggatacattattagtaatatcgttcctacactcttataaactcttctaagatggcatatgacgttgtaatatattagagaaaatctaagaaaaattataagaaaaaaaaacacctaaccattgatttacacttaaactgatgatctattattttaattattagattatatctatcaagtaatcattcattgttaaaaaccggctaatccctccgtttgtatgtaagtacagaaagatatgtcaaaaagaaaagaagaagaagaagaagaagaagaagaagaagaagaagaagtagtgtgtgtacgcgatcaatcccatcgaatagttctctctctttctttgaaagctctacgcttttttctcgaattgtgcatatatagcaactattcctgatgatgttgtcaaagaagccacatcaacaatgcttcaaaccatcccgccaattctcttgaaagtattttttttactagtgatataaaagacaatcacaagtgatcatataaacgcgtgcacactcgtcatataagtacacatatgcacacctaccctatgagagaaaagtatgtcccaggaagaggtaaaattatgtacgtatggaacactactattcgccaaaaaacatacatgtgtacaataaaaaatatcacataaaccacattatatcttttaattgtgtcataatcatctagatagtgtttataattagcataaataattttaacaatattgtcagggttacggataaggtatacctcctatcctacgacttatggaatatctcgataaggtatatcttaacatatacggattgtacccataaatatcacgtggaaaccgtttcggatggaacgaaatatctctacgagtcaagtaattccgaagtcctactcgcaagagatagaatttctgttataccgtaccaggtcctatcccctcaaacctttcttgagggtcaagaagatccatggtataaaagggaccccctaggaggggtttcgggaatcgaattccatctccgacacacccaccaaagtttacgaagccggagtacgcggagccaagtcgccgggagatctcgtcgagtccatcgactatgatctcgtcggtatcgtctgtttcgactactctctttgtaatctgttctcatcatcatcaatcccatataaactggactagggctattacctgataaggggcctgaaccagtataatccttatcttttgtctgcttgatgtcatactacgtagaccctcgttccaacgtaccccaatactctactcatccggtctacgagcatcactcgtcgacaaatgtatattttttccatcatatacctacaaatttacaataaaacaaaaaaaaatcaaaacccatattaactcgtatgtttgcgaaggatggtgtgataggttcacatataaccagaaaaaagtgatttttgtttatgtcaaaagctatggtatattttatgatataattttttttcttgtatgattataagataatctattgttcttatagtaaatatggtgagatatgactagttttctttttacaaacaataataaattgctcgcatagatgcgtgggttttgttcctagttttatgtagagttacccaatagctttggaaaaaatatataagcaatactgacgaagtaagtttttggactaatatttttacaagctgaaatgtaaaaataagctcaatattccataacggatttcctataaaattttcgcaagttttttgcctccaaaacttccagatctgtgaccatcagatcaccttaagatttgtgcatgaagagaaaaacattgctagaaagaatttttttcacacgcatcaggcgtaagatcctagtgctacctaatcaaagcattgttgaatgcaagttttaataaattatattgtagtcagtagttataatacaattacaatgtagttacaatgcagctataatataattataaatcaattatactgtagatacatcttaatgttttagaaaaaaaaacttactacggtttttttattctctcattccataatttggttttagctaaagaaaaacatacccttacgttattgttatggtttatggttcaccagtccgaatcaggggcggagatagagtatattagagggtgcccaggaacccggtcaagaaaattttttagctatacctcgtctatttttaccatatatgcacccccttaatacgaatttaggcacccacatcagcttaaatttgatctacaatagagtgaattaagtaagtgacaccaccctctatttcggtccagctccgtcccactccgaatggatagccctgataattaattgagagcaatgagaactttcaacttgtacgttcaagggtgacgagtactaaatagaaacaaagggaatacaacttttttgagaaaaagacatgaacccagtattgatcaaatgggtataacacccaaggtgatgtgtatgatacttttcaccaacaaacaagggctgcgtaatgcagttatttgcagtagatttggccaatatgcaatttgctgttccaaatgtcgtagacttgtaaatacgctgagtgttcgtattgaggtagtattgtactatagcgatagttctgccatacggtagctagctcacgctacttgcgactaaattgaagttgaatgtaagaacaggttgaaatgtgcatcatccttgtttccaacaaagggccgtatatcaccttctaaaatacgagtactgctcttatctactccaactatttgttgacctacaactcctaatttcgtacggaagactctcatgaacattacgaatcagtgcggatctgcgatgccatcaatctccatgtataatcaatactacatccatttcatgttacaagatgttttggctttgttaaagttaaattgctttaagtttgataaagtttatttaaaaaaatagtaatattttcgtagaactactattgggagcgttgcgcgctcccatattccaagcgcacgtgtatcagccaggcccacctcaccccacgttccatcatcccgctcccaccgttatcggagtaaacgattaacttcgataaaaacaacttactggttacgatcccaccccacgtcctatcatcccactcctactgttatcggagtaaacgatttacttcgataataaaaacaacttccctttcgatcccaccccacgtcccgtatcgtgctcccaccatttttgatttactccgataaaaacaacttctctacttctggtatatattctatttttcccgtacccaaccaaccactctcgccccctactttattttttcttttttttcggatctgaatcgatccaccatcccagcccacagatcggcgacgcaccatggaggaggacgacaacaccgtggcggttgatggcggtgaccggcaagcggtggccggcggcgcttgaggcgaaggcattgcttcaggactcgccgccgcagcatctgcttcagatcaatgttgaagagacgtctggcccatggcgaacgaggtggacgtcatggggacggttagttctctcagcaattcctaatgagattcttgatttcttgcaagaattgtatacaatctatgattaattaaattctttatctttcttgattctatgcagtctaacttcgattgggttgagcgctcatcttgacgtgcttctctattatcccttgcatggcggagatcatgtttgtgatggtcaatcgatttggtaacatcggcaagaaactgtgatttgtttcatcacctctgtcgttgcccagtttatgacagtgaggcggtgaaaacagcgatggcgacctctatctttggctccgtcgccggatccggctcctactgaggtcgcagcggccagacttggtgttgcattggctccagcctgcatctccaccactttgtcttcttgctctctctagcaggacagaaacttcatttagccgtcacgaggaactggcgatggcgtgtattgttgtatttgtgtgtaaaatttttattcttgtgcttttaccatgatgtgcatgtaaaatctttattttttgtcccatgatttaggatggagtgattcaatatataaggaaaaaaaaattcacgtattatttggggtaaactaattagaccccagtaattccctccttatttattttttcccttttttcttgcttgatgcactcactataagaaatcatcaaccaaggctggcaataatgcaattactacaagttaatgcaccatcaattttcatttacatcgatagtaatacgaatactacaagatttgatcaaccaatgttgttcataatccaactactacaagcacatgtaccatctattttcatttaggtcgacaataactcgattactacaagattttacttagcatggttgtcgttaatccaattactacaggcacatgcaccatcaattttcatttacattgatagtaatttgattactacaagatttggtctcagtttattgcacaccatatcgtaactacctcgattggaaatagagataaaccaattacaatgattattttcaaccgaccaccgattttacgaatctgtaattgatttaccccgaattcaaatagaactaatctagacagatcgaacatgggcaaccgaacaccagtttttgcggactctaggcgcgatgtgtggtgctcggaataatattccgcgctctagcgctcggaatagcgctaccgatattttcgacccaagataaatttattataaaaatatatttagttattaatttaataaaactaattcggtaatgtaaatattactatatttgtctataaacttagttaaactttaagcagtttgattttgaccaaagtcaaaacatcttataacctgaaacagatggattataacctgaaacagatggagtatttgtttgtcgttgtcaacattagacataaggaattttgtcaatataatcacagggtcatcagaatcttttatatcataagatgaagatagtagtataaatcccagagatgatgattggaggtaggccgaccaaccccaaagctaattcatcactgttgtgaatgaaaacaggaccaataaatagactcgcaatacaatggaatgaagtgcacataaaaaataaaaggtcaactactgcatatatagagaaaagatagcatgataaataactgcagagtgtagaaaaatggatcctagagaagaagattaactactataaggccctctttggactttggtttagctagtgatgtaagattttttttttagagttgggtattttcacctccacaaatctatgcaaataaataattttgttcctattttagatgatatttgattttttttaaccgctacagttttgcatataaactttaaatttaccgtggatgtggtatctagaattgtgctaaacagtatctaaatatttggtagcatgaggaatttgtaagtgacgtctttgtgaaaaattggaggtctcgtgtacttttccttgaagagaaacttgtagtataatcaatttaacaagttatcaattggtagaaattactcctaattggttagtcgaagcaaagtgggaattcaccagggttttatatgaaaatattcaactgttcaactaaaaaaaatcaatatttcaattaaaattcaaaaacctttcacctgttgaacgtggcatccactctccacaacctctctcaccaaaagagtgccaacctacatacttacatagaaaagctttttccccttttactattagcacgtttttcaaaccgctaaatgtcgtgtttttcttttaaaatacatatatcaaagtttctttgaaaagttgaataaaaagtaggttgtgttcattttagcaattaggttgggctacttcgtcgttttccataagcacactaaccgatatgctaaacgacacatttcgtgcaaaagttttctatatagaaatttctttaaaaagtcaaataaatatgtttttcaagcttgtgataattagtactagattaagcatgcgctaattcttgtcttcttctatgggccatcgaatacttcagccgatgtacacttagaacgcagttgaattgaagggataagatcgctcaaatgggaaaagataagggaaggttctccttattttaccaaaagaatatgagtgacacctacatgatagcaagctcaaacaggaaaaacgaaaaaacataaggaaggggcaaggttctttctattttgcctgaaaatataactctcgaagcctttaacactactcaagaatcgatttttcgaacaacactcctctaggttgcaggcgaactataattgcctccctatacagaaatcgctccctcgaggacaattcaagacccgcatgcaaaaaatcatttttgttaggcgagcctattaacagaccacatgtaaaaagaaacctattttcgcaggcaggcctgctaaaagacccgcctgccaccaacccaccattgcctgctatcatcctaaaatatctaatttcccctctcctctcctcccccggcgcccctctcctatcccctccacacccgaggccgacggcagggagcggcggcaaactgcgactccgatagcggcgggcgaggaggctagcggaggaggcacgcatcgacggtgacaacggcttagcctcataggcttcctctctctctcttcctcctcggattcctttctcccccttcctcctacgacgatgacaagaagaggtggcgacggcgttagatgtgacatatctagcgcgccggcctcaggagcggttggccgcgcctctccccctcatgcgcgaattcagcggcaaggatgatggaggtgcctcgatgcgcagatttggtgttggcagcaacgtggtgggaaaggagcaacgatggagtcactggatctggcgcgccggccatcgaaagaagtcaacccccctcgcctcttcccctcgttcacagatccgacgatgacggaagtggaggcatcccgactggcggattcggtggtggtggaggggtgacaacgatgatgacgacaatgggaggggtggggtgtccacaatgatgacggcgaggaggggtttccacaacgatgaatggtgacctgaaggacggcaggtccagcggcggaagcctttcaacgatggtggactacggcggcaacgatgttaggtgttggttttggggatttttcttttcacatgtgtggggcttaactaaccaaccgcaaaagttgatttttcttttttatacagttgtgctactggcatgcaaaaatagttgatttttacatatatctccggacagacggtagtccaaccgcatgaaaaaaaaaatcagtttttatggcgagaaaagatattttctctagtattctacagaaaatattatccttcgtacacttttgtgtacactgtacctagctagttcgcttcaggccttctgctagtcaaccactcctacgaaaggcactgtggttttctcgcggcatgtcaaactaccaatcaaacgccaacaccggccgtccgaataataatccgtaggcactagccacgagcccaccaacgacgtcaaccacatgaattgtcccttgaagctcgtacaacctcgcgaggccgcgaaattctcgagtgtcaaaggcctcaatttgcaagcatgatcgacgcgcgccgtcggcgtcgtacgccgaactctcgtgctcgcaagcgaccacacggacgtggcaggtatagagaggccaatagaccatgcgtgctacatagtttgcccccaggtgcgtgtacgagcgttgtttgctaataacgtaacgacgattgctagcaattactgcatgcgtatgattgtgttttgcgtattccattgggcagatgatggaggcatggattgttcctcgattactctcaactgaagtgatcgggctacaggaacggcaatccagtgtgcttgattaaatcatcacatatataattgtaggtacatgcatgatgcatgccgatattacaagtcttacgtgctaaaagcacgagcagatgctctggtcagctagattttaattgttgagtagaagcgaagagtttttaggatggaggtgattggagatgaatgggtcactacatttaattgttcatcttcggagacgtgtgcagttactagtacggatgtcttcgcgcttcccgaccatgtgcaatgtacggtgccaacttacgaggaatgggaaccaaaatctgttaaagtgtaattaaacaagctgaacataagcatcaagccatcaacttgacctaaaacatgagcacccatggagaaattagagaaactctgaaactggcgtggtggcattgttgggaaattttatttctcggcatggaaatctagagaattcccgcacagcaatttttcacccgttgtctacaggattaacatgatttaatttgtgattatttccataattacatgactatgcgcattgatcggtagcaccaaacatttccatgttttcaattgcccccgatctccctcagcgccatattaatagcggagaccggtgtcgtggaaagatgacaatctctccacgatcgtcttctccctgagaaaaccaaaaccgactgttccaggagtgtaggtggcgaccggaaggccaccgctaccctgctagtgatcattggcaaccccttcgggatcaaaccggcgtcctcactgctacgactacttcccctacgccgatgctcaccggagcagttcgaggacgtcctctacttccactcaggttgacgacattgcagagggaacaaggagaaccacatcattggcttcaaacaacggtcagtaactctaaaaattccgcattaggatgatcatgtttacgctaagcactcatgttagtagatcacaaaatctacagtcatgtgtagattgcgcgactattatattgcaaatttctctagtaatagttaaatttcatatgtgacatcaatacagtgccactcattcactagtcataggataattctacctttagacatgaacgagtaaccgtgcacgtgcaatgcacgtagtaacaaatgtaaattaaaactattgtgggagaaaaataagaataacaccaagcaagttatacatgcatggtagcaccaaagaatccatcaccagaataaatatatactgtatataaataagtgaaagtgctaagcctccgcattaatttgcattggatttatactcttatgcccgttaactgggtctttgcgaggaacatggacagaggatcagggcatgtacaatggtctttattagcggtctctctttattgtcatgtaagtatatttggtgatgtggaagagagagaaagaagaaaagagaaagatggttgctacgcatgacaacagcatagaatcgactgttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtctctacctttgtacttgccctcatacccgcctccgctagacccgatggccaatggggactttccccctccattttagttccatgtgaagaaccaactacaaccgtcatcatctcctaatggtagagtttcctgcgggaaaagagagaatgggaccattatattgacatatctactattgcttctttgccggtactcttcggccacacaactctttttatgcatttccatattgttagaataagtatcgaatatactagttctatttgattatagttagatttggagttgtaaattacaaaatcatgtggttatcatttgccataaccttcttagtttttaaaaccatgataaacctcgcagtaaccgcacggttttcacggtaaccacgtggttatcgcgataaccgacttaccacagggtggcggtaccacgcccaaaatgatttggtgaaccatagtcgtataataggtggtagggggtagagttagattcggccactgtaacccggtgttaacaccaaaatttggtaggtctctttggtggatttggttaaggaaagaaatcgattagtagatgaaagtttatctagataaggccaagttcaaggatgaatcatgaataccatgacaagacatttttatattttcttagtatatcttttaaataggcaggattagtcatttttattttcttgttatgaatttttatctcgtattcgatttgaacttgcacaaattcaaaggtataaatatgtacactcgatatctttgtaatcatctccttatatcaatacaataatattttggcgcatcatcacccttgtagtttcgacatgttcttgccctcaagcggggttgtatcggttaagttcaatttttggcgaagtggtaagtcctgtaaacccagcaaagcacaattaagactttctcaagttccgcttgatattctaactagtttttatggttatcgatttattggttatcgatttatcttgatatatggctttgactagttcgatctagtatatccatcatatgtgtatagatctattggttaaatagatttttcttattattttcgatcttatactatctcggtttgatttgatcgattagattgctgctaataagtttatttctactaagtcggtaggtttttatacaacattcgtcggagttgtagccaatgagatatcattattctaaacatcaattgtcagatgtatcggttaatttgtcgatatatattttaatgtacctgcaccaggccttcaaccgatgaatgctaaaaccatcggatctacatttaccacactatatcagtattggtcgattggttcattagttcaattcttccaatttatcttgttagttgtaagatccaattaattaacatgcctgaacctcgtcaaaattaaggatatgcactagagttaaatagatctctcatgccttcgtatgttagaaaaattttatagcaacacctggtaaccctttaaatacagaggggacacaccacacaatgtaactatggtgattgcaatatagcgtagatacacaggaagataatggcaacaagatcattgactcgtagcaattaggttgtatatacgttgattggggaggagcgtccataatcaaagccccgaaaattaggttaggattgaacttcattaacaaagatcgtgtgctcatacgttgtcatctggcatgtatttgagtgatcaatgacataaacaatcgggaaggctagtcgtcgttccactatattaactatcttttataacacacattttataagttttttttttctgaaatggttcccaataaacctttgtgtaccgcaggtccaagaatgatccctacatatgtgttactgtaggaacatgctactggcaaatgtgcacagccgagaaaatcaccaaccgcagccaatccgtatatatttgtgcgccgaatgtatttgcatggtctagcactagtagtagtagggttttttttttcatcagttactgtgctagctactgcggatctaaagcaaagatacgcggagatatggccatgccgggacggacaagatcttgcattcaaggtgggtcggaaccactgcggatggatgaactctacgttaccccgtcgcccgtgcacgcctgttactgtcacgcgcctgcgcctgcgtgcatatgcacgcgcgaccctctagtgacaagtgagtaatgggtcggaagggacggcacgccgtcggccagtcgcgcacagcgccatatctcttgagggtcgtaaaggtgatcagtctccctccacagattttcctccgtgcaaaggcccccttttgttcgaccacttttgtgcgaccccttttgtgcgatcggtttcgctcgtttctacttcgtactcggcttgaacaggagatggaactactcgccgtcagtccgcggagaagctagtactacttctgtttctcttgtcatcgactggcttgcacaattgcaccaccgacccagtgtcgggcagtgaatgagcaattgagcgtgtgtggctacaatttactgccaccggttcgactaaaaattcactccgcacagcatatgtccccgcgtcactccagcctcaggggcgacgcggggcctggccgccgccgtcctccacctcctccccttcgcctcgctgccacccgaccagcccatggcaaacggctgcctacaaggacggtggcgacggggcttcttccaccggtggcatcgtggttagagtacctatgtgtcgaggtgaagatgtttcagatttggatcaagcgaggagaagttgggaggcgctgcgccaaccatgataggaggttgcgaggcaataggagcggctggacgacaggcggcgaaggagaccgtggctagccatagctgccaagatcggatccttccaaatttgcacggtgggtgcctggcggttgcggggatggcgtctagatccggcgtgctcctgaccaaagctgcggtggggtggtcggcgtcaaggcggcgtgacgactggcgatggcatgcggccagggaggatacagtgaccgcctacatttggcgtcccctagtgaggtggctctcgacaaacgggcgatggcggcggtgccgtggtctatgcagaaggggagagaggccatgtgatggcaactttcttcctctgcagcaataggctacagcacagctggcgcggtgctggcgctttggctagagtttcagtggcggcaggagacaataggacaaggtggcggcgatgcggatgggcagcctatggcgacatggtagtctggccaaggcagcgatgacggggtcctgatccaaacgcctgtcctattttgatggcaccttacctccacaagatgactacgttggcatgctagtgtgggggagaggggatgcattcttctctctcaccctctccctcttcaacttaaccatatgcatggattaatttggagtgcattggatgtcgagctcctacttaatggccgtccggcgacgagacaccggtgcggtgattgtgcatcaaaggggtgtggttggtggtggtctctatgtccagcaggagacctcgacacaagagtgcaggaagattatgagtgaaagcctagcatctttgtctctttgggccagcaatggcgacgcatgtctgcgccatttttctccttgggggtgttgttgagtgatttctcttatcccctgatggattcctctaggtgaaaaccatgtcctgcaccctatgatagacggcggtggcacactcgaatgaaggcgtcgtttagatgattctttttcttcaggatgtcatgtttctatttttttagcgagtttctggttaagacacgtggtgtggttatcttttcttttcctgcttatagcattttagagctgtagtcttatttttttttctgttcaatcgatatacacaacgtcgcactcttatgtgctatgaaaaaaaagtcgctccgtttctcgtttccgaacctctcaaagccttgagctcgacgaaaacatcgcacgcttgcgcagcacgaggcggaatggtgcaattgctagcttattcacggtgaaatattgctgccgagccggcccccgaccgaccacgcgacggatggcgacagcgagggggcggcgcaacaccacaaccacaaactggacggcgccgtgcgtgcgtgcgtgtcgcgtcgcgtcggcgggtgaaagttcgatcgaccggacgcgcaccgaactatcgatcgcaacgagagataataggggattcgcttggtattactgctgctactagcccactatgcgttccattatcgatctccttttgcattagaggacgagagcgaacgaagccgaggggtgtttttgcctttccggcgttggtttttccgggggctcgaaacgattgtaaccacaagctcaaggtaaggctgggatcacgctgtgtgactcggaccatgggtgggcactagccgaaatagcctacctgacctgtcgatcgtactcgtgattgcctctggctgcacaccctcgttcgcaaagtcggtccctttcttgggctgttgctactagtacagtagtacggtcacggtagcaacaagtgctctgatgtgaatgtgaatatgtgatgcgaccctttcggaaagccggattagaaaaggaacaaattcgtgccagttacttccggattacgttcggcaaccacgaaggattaatcaaggaggagagacggttaagacggcaatgcttttccgtcacctctattttcccaaagtgcgatccaactccaagtcttgcgcggctgtcacgttcgttctgacggcactatcactcacgaacgaacccaaaaaaaggtgaaaaacgacgagccccgatcggtcgccgtcgcatgaactcagagacgtcgttttccacccgcgtcacaccgcagcgataaataatttggcccgttgcgtctgttgtttgctccgcggttgcatgttaggtgagtgaatccgagacgggaactgctcagctcaaccacgaaacgaaacctgtttcatcattcgataaagcacctcgtcttgccggatcagctggggtggcaggaaaaccgaaacgtgttcgttgatttttcccatcggctttggctttgtccatccgctgctagagaggggaaaccgttgctgcagtgtgctcgacgccactatcatctgaactttgcctgtacaagaaatcaagattgaagaatgcataggggggcatcactgtcaggtataattgctacgcagccatggacgtgtactagtatgtagtgaagctttcgcggcgtgtttacgtgttggggaaaggtgtcgtggctgcgggtgcgaatgttcactgacagcgagacggctgttcccggatcagctgttccagtcgtgcaggtaggcaggcaggcaggcaggtgtggctggtgagagctcgctcgctgcgacctaacgctgatgccaagcgcgagctcaaatagtcgggagattcagatccccgccgacacggtggtggcagcgacggcggccggaaatattcgtagtatatttcttgacactcccaggtcccaactgcgcggtctataaagctcgtggttcaggtatctgaatctttcggactgcttcagtgttctgaagatttgcaggttaaaagcaaaactgcccgggcgatggccgacaagtcaaaaatcgtgaacacgattgcgcggcttcagagtttaagatatttggggctggtttggtttgagaactaaattaggtttatcaatatttggcaatttcaatagtgtttagtgtctatttagtttgaagccaaattttggcatacctaataaaataggccatttcaatagtgaacttaggctattttggtttcaatccaaacacaactttgccttatcaaaattagtcatgccaaaacttgtcaaaatttggtaaggcctatttaggccacaaaccaaaccaaaccttggttccatctgcccgtatctttgtaggggtcatggctggttaaagatcattacttgcaagttaaatcactagcgagaatttggatattcgatacgaggaacgggtgggaaacatctggaataataatggagtttattcagcaaaggcgtatatgatctcaactgcttgcgcattgtgaagtttgtggttcagatatctattaatagagaagggataagggcagtggatgaccgacaagtctgaactttggacacaacttaaagcatgtactactagcttcagcgttcagattctccaagctaaagctatgaccgacaagtctaaatttttggacacaggtgcgttgtgccgattcgcgtgtacttccttcagagttcagactatatggttccacgcgcagtagttcagaatgaattttggagggttttgtcctcctttcttctgttttaggtgtgtttagttcctgaaaaaagatagaaagtttgaagaaagttgggaatttgaaaaaaaaaagttagaagtttatatataggaaagtttttgatgtgatatgatgtaatggaaaattgggaataggggaaactaaacacggccttggtgcatgtttctctaatgcaagttcaatagatataggccaagtttagttccaaaaattttcttcaaacttccaacttttctatcacatcaaaattttcctacacacataaacttttaacttttccgttacatcgttccaatttcaaccaaactttcaattttagcgtgaactaaacacacccatacgcgggcaacatcccttcttacattgcattaagaatcattcagagaaaggcaggcgagcacgcgagatggtttggaatttacagaagaggattcagggagtaggatacacatggccacagatgcaaggatatatgtacatatgatacatctctgtccggctataacggtatgacttttgctcgctacagaagctgctcttgcttacaagagtagttcctgcgcagcattgttgctgctgcctgctgcgtcctttgcagcttcagtgtgatgagccatgagctaacaaacctaactgggtacttcactagctcacagttcctatagctgtaagaatgatcttgaactacatacatgacttaacagatgacaatcataactacagtggcatgtacaacgtatatacacatggaaccagggagttgaggttttcacaaggagcccaccaggagtttacgtgagagcttcattccaatttttccagttaaagaaacctgcaaaacaccatgcaaatcaatgcttaaattattggcttgtgaactatgctcaaacgagtactcagtaagtgggctgggattgcattaacatgttatgtgaactgcatccataaatagcgaaacgtgcaatatgctcaatggtaagactagaagttaatgtaaactcaagagtgacaagtatatgcaagatttaaatatgaacaatagcagattgaaacaggcacctagtattattcctaccaaaataatatcctcatcagttccaaaggacttgcgggcctgatctaagctcttcattgacaccctttcacgctgtctgaaagaatcaacaaacaactgtaactaagttaaatcttgtcaatagggacatgctgtcatgcacataaagttaagcggaaaacttttttcttctagcgaaggaaattaagcagaaaaccgtacagcgataggtttctcagtcaaatatggcgccattacttgataatcatacatagctataaatggaccctgacatgtagcatataaatatgttcaaagcagaaggtgaatgttctcggttactggtcgttacaagaaactaaatgatccttgcttctagtgagtgttatgcccatatcagcatgacgctattaaagaagcacagtttatccatctgaaaactcaagtgtccgctattaaaagatgtcattaacaaaaggtgaatattaggtacctcgaactggcagggtcccttatctcaaattcgcaagcatcagcatcatacccacatattacaacataatgccctgcaatggaagacagtattaaccatcagaatgaatccttttttatgggcacttttgcagacagcaaatggattcatggaaaaccaatccatcaacgagcttggccactcacccatgtaatctgaatcctcactgaactgttgcatatcttgtagatcattgctccatgaggaactgcattccaaaaatcaagttactgacacactattattgcccatttcaaatgatatgcagccacttcaaaaatgaaatcaaggaacaatggttattgtttgtagaaaaattatgcatataaaaatccatggatacatccatgaaccattttgttccgaactgtaatcttctccgagatattctctcaattaccaagtaactttgggaacagaaagggtagtgccaactgtatattactcaactgcttcatcaacattatcagtttgttactacataatgttggcacggttgcaaaatattaaactaataatcaccttatgatcgttaaatcaaaagaatttgagatattaaaatgagacaagtacagcaagtaacattgtccacccattgcatttaccattggacaacttgcttatgaggcgatgtctgaatgccgaagacaaatgtaagactgtcttaaaggagtaaaagtattgacagaaatacagaacaaagtatacttcatctcacttgctatgaccaaaaaaatcccttacttcaattttgttttgtccactagtgcgatagcaatgcagtgcccagataacagtagaaaagctatatcatacgcactgatggatctgcactgagaataaccacaaattgaaaaattaaaaaaaattgaaagtgagaagtacatcaaatagacaatttttatgatgtgcgctgtgatcttacttgaatactaattccagcttcaagggctctgccaaagagctcatccactcgatcaatgtcttcttgcaattgctcctatcgacattgttatttttgaaactgttactacagtgaacttcagaggaatcggtaacattaaattacaattcataccctataaaaggtttcagcagaatattgcggatttgctcctagagtcacagtgaagaaggaaaaacaaactgaaaacctgtttaacagatatgccaagtcaactgtccatatgctgcacaacccagaaatgtcagattgttaatacaccagacgtgctattaaaatttttaataggccaaaattaaagagaattaaatattatgtccagctcatctagggaatgattgtattgcaatataatatatccacgaatatttctcacgtctaagctactttatgtcctcataaataattgtcatattacaattgaaatgcacaattttttattctcttccaaattaattttcacctaagatggaattatttgcaaagagcattttaactacaccggataaaagtgattatgcagtgcaaaatgtgggaacaatcaagtggtcaaagtagtaacaagcattcatgaactgacagagtaatcactgttcgttatccacgcaatctcataaagaaaagaagaataattatccatgaataaacaaatgattcggggtatcaatttttttcattaactaaggagaattgcgccccccgtgtttagttgtaaactcaaatttgaagtaataatctagtccaagagaggaacctcgtggtgcggcagagcttctcgagatcggcaatgccgtcgcagcaatccatcccgagtgtcctgagcaccatgagcacgcaagcgaggccgcagtcccacgtgaaggcctgctggacatgcggaacctagcaagcatccatcaccagcgccacgaacccaaaaaaattcgtcagatttaacagcagcagtaaacacgacgattattacacagccacacgacaccgccgcggaaacacaggatcagcaaccgacaccaccccgagagacaataattgatcgcaaccatagagcgagcgcgcgagcgcgcgcgagagagagagatagggaaggagggaggaactgacatcgacgtagtacgagcggcgggctagagggacacggccgtcaggggccggcggcgagtcgtccgccccctcgccgccgtccccttcccccgcgaccttgaacagcctctcggagaagaaccccaggggccacatggcaccatcaaccgaccccctcgcccgccgcgcgcggcgccaggcgactgacctcgaaccgcaagagccagccgagccaagcagtgctctgctcggtagcgcgggtgggaaggagaaaggagggaaagcggaggaggaggttgggattctcgcgggttcgcgacgagacgacggtgggaggaagggagggaaatgattgggttcttcttcttctcgctccggtgcgtggtgggattattaaaaaaacgggggtccgcgtcaccagaagaatcggtggagggatgtggagcgccggagcgcggcgcctttaaaaaaaaaaacgggggccctcgtcgcctcgccttccagaagccgccgtaatttttaggtgtcgttgggctgtatggcctttgccggtgggaggaggagcagcagcgcagccagcgtgtgtttgcgtcggggaaaagagaggatagggattggcagaggatttttgctctatccatcggccaccgggcggggtggggattgatgtcgatctagtataacccgagaggctcgcggaggggccgggattggtcaggggggtcaggacctggtaccgatttggttagggaacaggaggagatttgtcctataattcttgccttttgttgtggtgttctcttttttctttcgatgataaggatgacgcaggacataactaatcgctatctaccgacaccgagagtctgttttcacaagttttaggccacatttgaatcgcaggattaaaaaatagagaaataaaaaaaacatatgatatagaatgtacacttaagatccctttgaaacacaggattgagaaaacagataaatgagaaaaacgtaggaatagaatgccacacgggcccctttgaaacataggattgagaaaacacaggaaaaagaaaaacataggaatagagggcctgttcactttggtgtcattttcaatcatactatttttttgggtaaagttgctaaaaaatgtctacgttattctgttgccaaatttagtcaatacataagaaatcataccaaaattttgataatagtaccatcttaccaaaattttggcattgccaaaacttgataaggtttattttagctatagtatgaacatgcccagaatgtcatacttattagaatcctataggattttgaaatacaggaaagtccccaaactgtcgtttgattagcaaaaaaaacacataaattttgagacacatgaagaggaaaacatgaggtgagagacctcatgcttattttcctccaaaattgctcaagcaaggtccattccataggaatttcaaatgaattggtaggaaacaatcttttgtttcaaagggctctagaggattatttttcataggataaaatcctctagaattcctatgatgtttcctttatttcaaagggggccgaactatgggattttgaaacacaggaaagtttccaaactatcgtttgattagcacacaggaaaaatacatgaatcctgtttggggagcttaatattctgataaacagctggttggtagccagcttctgagaatctggaaaagctgggtttaccagtttctggcttctgagaatctggaaaagctgggtttaccagtaaaatacattccataggaatttcaaatgaactcataagaaacaatcctttgtttcaaaggattataggattatttcccataggataaaatcctctagaattcctatgatttttcctttgattcaaatggggcctagtagctgcatcttcatacataatttccaattcctcgaaacagttcaaatttaggttagcactctaagggccactttgaatcacagggttgaaaaaataaaggaataagaaaacacaggattccgacaggaattgaagtgtaaaatagaggattgcgatacacaggaaaaatacaggaatgatcgtttgattggaccgcaggaaaaaacgtaggaatcggatgagagagatagactcaaaggaaattttttaaaaggttggaggtctttctaagtttcctccaaaatccgcatgcaatgtgtcattccataggaatcataggatttgaaaaacttcaatcctttgaatcaaatggccaaatagaaaattttcctataggattttaatcctatgaaattcctcataaatcctttgattcaaaggggcccaggttgaatatgtagttgtataagcaataaaattttgctatctatttatcaacaaattttctaaaaaaatcgacagatgtaaatatagtataattacttcgtaatttgcatgtaactaaaatataacttaacttgtatgtaaccttaaaaaaatttgtgataacatgtttttttcgtgaagcggaggttacaacaccaaatcctctcacttctgtgtgcgttgtgttgttttcttcctcgcttacatgaatcttaaagcaaatttaatggtttcataattacatgaaagttacgtaccagttacaatgtaattacactactattgtattatatttacatttacaattttttaggagaaaatttgtggataaatttgtagatagtcccgaagcaataagttaggaaagtcatatctcaaaaactaaataccaaccaatagatttttagaatcttaatcccccaaaacctcttcagatgtgcataatctcccccaacctcttcagatgtggatcgtgtgtttgtcgaattggatagggcattaggacgagtatccttttctttaggtattgtacaaggtggcgttactatgcaccggcatttatttaaaccttatctggtttgttggtttttatcaaaatttagtattttttctaaaaagaaaagtattggtatggttgagacatgcttggtctcaagccttactgaatcttggtggtgttagaatggaacacgtattattttggttgctcatgacacgtataaccgtttataagtcagattaaaaaaatagggaaaaaatagccaccatctatgtatatggcgtgtagatttgtgtaataactagaaaaaaatgttcgcgtgttgtaacaggtaaaaatgtttttccagtgatgcaatagctattaggagctgagcagtaaattaaaacattcgaatagctatacgttataatttgaaaagattaatgaaaaatattccttggttttcagttgaaagcctttttttttcttcattttcaacatcagcccagaccgctatctccccgtgctcggcctatctcttcagcccagcccacaagttgagccacatgcccaacttgtatagtagactatcgtcttcaacctccggaagatagtctcgttactgcatgccgaagcgaccctcccaatcaaatttggcagaatctttctcgatctcctaaaattgattgaaggcttttgatccacttgatctcctctttatgtttttcctaaaatccgagcgaatatgcaaaactcggataaaaacagccgaggaagctcaccggctggccatcatcagcgactgagattaaatccagcgaattaaaactgaaatgaaaggtaaatcatgacgaaaatgatgagggaagagtgataattgatttttgctattaattggaggagaaaacacatgggtaaacatatcgatgtggcagcggtactagggtttgggccagtggtagtgggaggcaaaaaaaatgaagattgaacatctagtgctaccttgcgcatttttaattaggtatagatacatctaatgttaccttgacatgtcaaggcgacgggtccaataggataaagtcttgtgttaatttattctcgtgaacaagtagtatcatatatgatgcatcgatggaccatcttatatatataaataccacaacgcgaccttgctcttctatgtgtatcccacttcactgctacgttacatatagtttctaataatagaatcacataagagcgtgtatgataaggtgatataaatgggttataatggttgccaccttaagtgttgagttagaggagagaggggacgagcgaagagaagttgtatccacatctataaccacatgcacatggttgtttttaacaaactttatgagaatgagatgagttaggtattaacatagtaacatgttgggagagccaacgtcaggatcatgtccccattgcctacacaatatgtattccttctattcaactccccctcccggaaagaaaaacccctcctgcacgctaacctcccacataaggcatgcacccttcttgaactgtgatccctcttttgcgccgcaccatctatattgaatcatcctggcacaccatgtcttttactaagctgcaatctgactatctaggttaagtgaaataagaaagaggatatggagtaatatatatctaatgaaggtatcgggttgatatcttcggataccgcaactccttcatgtattatgatttgatgatactttctgacattattttttttaggaacacagtatatgtgctcagaacacacgtatactcatccttacgagcgtagacatgcacaccatatccctttgaatatcttccgaataccggatcgacatatcacgattatcttttaagtatcatgaaggtattataaatgtatcatgtatcatcgtattttaaggtgtcacgtaggtttcagataataataccacttgattttattattattcttactctaacagcgatgcatagacacgcatcctcttttgcattctgccgttgtcgtttggtggtgcatgttggtcaaaacgtccgactcgagacgtacgtagaagctgtgatggataaggccggagttcttatttttgtcgtgatgccacatttcagcgttcggtgtgacccactttaggtgcgtccaccacaccatgtgacaggctaaagtggcccaaacatggcccagtccaaagagctcgatctgggtggaagagttgaaagcgacccggcagatattttgctcttgatattttcacagcagatactttgctttttgggtaggagcagatacatttttcttgtgttcaaagaaaaaaaaaggaaaattagcatgttcttgatgttagcaatggacttgaagtgggcaccaggcagttaggtattctggcccaaacatgttgggccgtactagattctgtacttagtggaataagttcatttagggtcccttaacttgtcaacgaatccgattttcgttcttcaactgaaaaaacacagatataacgaatccctcaactatcaaaaccagtgcaaagtatgtccctcaacggttttgatggtagttttggctgatgtggtgcctacatggccggtttaacttggtcctcgtcctacgtggcggtgatgaggcactgcaagcaaaatataaaaataaaaaataaaaacaaaaatgtgggacccacatgttaatcagacaaaaggaaaaaaacaatgggacccaccatcctctctatccacagacgacgggagtatagatggccaaaaggcccgaccggcatggcctggcccaggcacggcccaccagccatcgggctggcacggcccgatcggcacttcgtgccgggccgtgtcgacccatgggctgcacctcccgcccaggcacggcccactagctgtcgggccgtgctgtgcgggcccgaaggcacgggtgcccccatcgggtcttttttaaaataagtctatttttttgtccctcctctttgggctgttacatatgtatatcaaaataagtctattttccgcctctcctctttgggctgacatatgtatagctaaaataagtctattttccgtccctcctctttgggctgacatatgtatagataaaataagtatattttacatccctattctttcgtccatggcatataatatgtgtatttttactcccctatttttttttgtgtgtatcaggcctgactgccggcccatcgtgccatgccggtccggtcgtgctggcccagcccaacgtgccggtggagggcccaggcataacctggtggttgggccgggccggcacgggcccgacctccgtcgggccgtaccatgcttgggccgggccaaaatatcgtgccatggtccggaccgtcgggccttgggccttttggccatctatacgggagaggagcgatcgacgcgttcttctctctctccctccggcgatccttcctcgccggcgagcgcacacggagagagaaaaaggttgcggccggcgaggagggcagagacggtcgctgtccaccgcccgctgcgcgcctcttcctccggcccccaacttgcgattctggaagcagcagaacatgatctgcaaggaacaaaacaagaaagaaaaaggaaataaatcaaaggatgcacacgcacgccaattagttagcaagaatgatcaaccaagcaaccaaaactaatcaaacaattagttggagtagatggcggagccgagccggcaaatgaaaggcaggattaattgaaaaaggaattttgtttgggttagctagtactacacacctggtgaggaactcggtgatggggtgggaggagatgatgttcgagcggtcgccgttggcggtgcgctcgatctccgggcggaggtcctcgtaggtgacgatggggacgcgcgccttgaacacctcccggtcggtgcgtccttccatgccgtggcggcggaggtactcggtgccgttgttccgcgccaggatcgccgccagcacccgctcctggaccgcgtagaaccccctcgtcatctcctcgatgaactccagcttctccgcgtcacgctcccacgccgccacaacatcccccccccctcctgccaccttcgaccccgcctccgccgcagccaccgcagccggagccatgaagcactcagacggcgcacggatccaatccgaacaccaacggagggcggcgaccaacggatccgccgcctttttccctctccgtgcgctctcgccggcgaggaaggatggccgggagggagagagaaggacgcgccggtcgctcctctcccgtcgtccgtggatagggaggatggtgggtcccactattttttccttttgtctaactgacatgtgggccccacattttgtttttattttttatttttatatttttcttccagtgccacatcaccaccacgtaggacgaggaccaagtcaaaccggtcacgtaggcgccacatcagccaaaaccaccatcaaaaccgttaagggacctgcttttgctgatgcgaaaaacacgaggcgtgagagatctgcttaactccagtgctggtccaaaaatcttgcctttaggttcgtgagcgtgccagttgatttgatcctgccatcaacaagaaataaaaacagaaaagtagtagttaaatccacaaacgatagtcgatcggttagctgccgatgacgtttcatttatctttgagccgatgtcatatatgaatcgatcggcaatcataaataagcataaaagaattaaatctattcgatcggctgtagatatcaatggtatataatacttctgtcgatatatacttaaatcaagtgattgggatagatcggtcgccatgccgagacagtataaatcacttagatcaaaatatatattaacaaaaagattataaacatttatagcatagccgatcagataaatctagcatgtatcggctaatactccgatactactctatattaagatattaaagcaagtaaaatatatatcaaacagaagcctaatatactttgttgtagtaagatcttaacataaagggcagatctagcatatcaattaagcacgtaagatttaaagctaaatcaggtaagatcggctgaaaccccaacactaccctaatcggcaaccaaaagcaggctagagattgagattctaagcacgacttaatagatcaaactcaactgatgcagcattaagtatgaaaaaaagaacaatatcttgacaatcaagctgttggatgtttcatagagtggtggataccctatataatctaagtcaacgttggtatttaacctgatcggctgccttctagcgataaatgttagccgactaagggttaaataacaatattgccagagattatataggatatatgataactcgacaaattacataaacaagattagagtatcataaaaatgaaagcactaatcccgagaacgcaagccgccataacaagttttacctctagttgaagatcgaaatcgatgcagctcaacccgaaagaaagaactcgtcgaaacaaaacgaaagtaaagggtggcgatgcgccaagattgtattgaacgtgtgttaaattgattatatggggctcggggtctatttatactcgagattacaaaatatgtcaatgtcgaacacgactcttatctctaacaaactctaagataccataagtctttgcggctgacttttactcaaacctatctctaaggaaattacataaaatatcctaattaatagatacaattgtcttttcaggactcaatctgtgcatggcaatctatatgaagcactttaacctaacccgatgtcgtgtaacgagtcatattgtcggaatcggcttaatcggctaaccttgtccgactcgcactctgccgatcctgatcgcggccgattcggactttagccgattcttgctctgtttccgaaacgatctccatcttggattccgcttcagttttaccttaacctccgatagttgaattaccaaatttggttattaagagctttgcaccggttttagtagttgagggacccgttatatctggttttccagttgaaggacgaaaatcggattcgttgataagttaagggacctcaattgaacttattccgtacttagcagccagatcgatgggagagcagtgtgcagtgcatgggcctggcctttcagagatgttgaaagccctcgacacatgctttacactccatggatcaggtgatcaggtcctgtagttgtctgaaacgctgcaggctgcggctgacacaccctacccgtgcaggcacgtggctgagaaaaaaaaaaggttatcgcaaagcttttgacaatgccgacttgtccagtgcttgttgcgtggtgcgtagcgactggagtagcgatggcactcggtgctacgagtaaacgaaaagatggcactcgtccatctgttacagcactacagtaacgtacgtggtttgagtgtaagcaacctcagcctattgaataagcacactgagaaggtgcgcttatctcgttctgctctaaagcaagcaagcaatgtccatcgagccaacatcacatgaccagaaaggaaaccgagagaaatccgggagacccgccagggcaagagaacgttctcccgcacgcgaacccgaaacagctaaaccttttcccacgcctcacgcggaaacctcgtggatatcgacgtcgtcgtcgtggcgactctaccgcgaccggctgcgactcccgcggtgcaaatcctaagtccaaaccaacgcgcccatccacagaccaaaccccacccaccgatccgccgcgccgcaccgtgccgcggcgtcacgcacagcgtgcgaagattcgcctcgcgctgctgtgcacgctgctcccccacggcgcgcaggcgcagcggcttgggcgcgacacgcctccctgatgagtcgtgagtcgtgacgccaccccgcgtctcgtgccccgcgccccgccctttccctttttataccacgctgatcgtctactccaatgtctccatctcgccacattcgccgcgcgcgtcacacgagcaagggagcaagcgaggagagaggagaggcttagcgagagaggtgaggagaggagaggatttggaacttttgatctttgggatcgcgagacgacggagatggccggtggcggcagggccgatgacgagcgaaggatcggggtggcgatggactactcggcgagcagcaagagggcgctggactgggccatcgccaacctgctccgccggggcgaccacctcgtcgtcctccacgtcctgcatcacggcggggaggaggccaagcacgccctgtggggcaagtccggatcccgtaagatccgcgaaccaaatctcctccccctttctgcttcttgcttttgctcgatcgatctcggctcaaactaatgtagtggattccattcctccagcgctgatccctctctccgagttccgggatccgacggcgatgcagcagtacggcgtgcactgcgacgccgaggtgctcgacatgctcgacacggcggcgcgccagttggaggtacgtgcgctctcgtgtagtactagtagcgtcacggttttggggctggatcggagacgaaaatgaccgctgttttgttgctgttctgatcagcttaccgtagtggcgaagctgtactggggcgacgccagggagaagctctgcgacgccgtcgaggagcagaagatcgacacgctcgtcatgggcagccgcggcctcggctcgatccagaggtataactcctacttctgtttgcaatgttgttgcctcatcaatcaagaatcaaaattgcaggcattgaccatagaacttgcctttgggccagttgctaatattcctgttcagatagacaagctctgtcgagaacgatgcactgcttaaatcgataattaaactacatactgtgtccagttccgtggtacggtagtttttaatctcaacacataattgcattgcactggaaatttgggggccaaatgcgtatctgacttggccttgcaacttgaatcattacagccaatgagattggattatcgagcatttcagttgcacttgttttttctgtgggaccgccaaggcatcaacttgttgccttcacgattaataaattgtaagagcaagtacaatagctggctataaaccagctgtaaatatattttaagaagataaatgaggagagagaagggtagtgggctacagatttgtagccaactatagcacgaactccaagacgcagtgtgtgtatgacaggcgggaccaaatattaatagtgtagtatgtaattattgtataaatgagctattagattggctatagatgaattggagctagtagttggctatactattaaacttgctctaaagtcgcatgttcatccttgagacatgtatatcctgattcttggtcggcgcgttgttttatgttctcatgtgaaactccttttcatattcaaatgtttcccatgtacagtttgagcataagaatgatgtatatatatagagttagttcaacaactagaatgcttgtgctatttcaatatccaaatacagaagtttatatacaggaacgtgattatcttggttttagcctcttaggttagtgtccacgtccaaagactataactatttagtctataacatattgagtggatgatatgcattgttagcttgaaacttactattgtcatcttgattcagaacagaaaattgtgaagtttgaagatgcgatgtctaatgaacgtttgggagtatacgctttgcgcatatggcagtatttgtttagggctggtttggttcgatgcctaaattagtcttaccaatatttggcaatttcaatagtgtttagtgtctatttggtttgaagccaaattttgttatgcctaagaaaataggtcatttcaataatgaacttattagactattttggcttcaatctaaacacaactttgtcttaccaaaattagtcataccaaaaattaccaaattttggtactgatagaatttggtaaggcctatttagaccacaaaccaaaccaactctttagtgattctctagcttctgaattgaatccagcacaccatataatagtctcatcgactttttagctcgttatgatttcatctgcaactttcctgtctgccaacattttacaggattcttctggggagtgtgacaaactacgtgctgtcaaacgcatcatgccctgtaacagtcgtcaaggggaagtgatcgatgattcgacttgagtggatatactgttactgttgctactgtatctgaataaagcgtgtatggaacttcttttgtgtttgtaatgttgcagccttcccaggttcttctagacagttcactttgcaaacagtccatgcttgtgtgctcaaccatgtgaatcactttatatatatagaccgaatttgaggttttactttcatatgcctagttttgttggacctaactctgtgaagtccaaattctgtacaagtaaaagaaaaataaacatacaagggatgtttaaattgtagccaagataaactttaccaaattttggcaatgcctaatttttggcaatttagcaatattgctaaaattttgataggatttcttatgtgtttgttaaagtttgactaaaaaattaaatggatgcacatatttgataactctaaaaaaaaaggaatatttaaaatgacatcaatctgagcaaagcccacataccacaacggctgcaagtttgcaacaaagaaccaactacttaccagaacaaaaacagaaaagatcaacaagtgcacagagagagtgctgaaacaaaattgagaggttttttttatgggaaaatttactgaacttgccgtagtattggagtattggtccgttccatttagcggcacaccgtacaaaaccatccagctatttagcaaaaaaaaaaaggaaggataattcattgcttatggcaaatcaatccgttgggcctggaaaagaagaattggggaaatgaataagtccactatacatccctcatcttttagccgagtttaactcatatccctgaacgtaataacggaaatctctaacccctcaacttacaaacctgggttaaattagatctcatgatagtatcaatagttagttttgtcagcgtgccaccctagtcagcaaaactaaaataaaaagaaagcgtgtgggtcccaccttttttactccttgctagctaggatgtcacgtcagtaaaatcaaccatttatactgttatgacctaatttaaactagtcgtgcatgtgtgtgtgtgttggggggaggtgttcaaaatttctgataatgatagaaagacatgagacaacaaaaccgttcacttaaggttcttaggtggttttcaccccggttttgtctgacgtggtggctaagtcagcgtgggacccatgtgtcagggtgtccacgtcacccctctatctctctttcccctcttctctccttcctctctcattttttcccctgggtggcggcgtcttcgatgcggcggggaggagggccggcgtggccggcggtgggggaggagcgcagcgaagaggagggccgatgtgacgggcagcgccgccgatggctgtcgtcgcgcggtggccgcggcggtcgtccctttcaaccgtcggccttaacgtagcccagcaatccaagccaaatcaaaaatcggtgctcgtcgtgatactcgacctcgcgctcccgttcgtgctcctctccgcgtacctccgcgccagggacgcgtcgttcgtggaggccgtcgtcgcgcaggtgtgggttttcgacttccggtcgtcgctcgtcgacctcctcgccgtctccgtcgcgcgcttctgatactctgcgtaggaggaagagagaggaaagtgggcggatgatgacgtggccaccctagcatgtggggcccacgtgggtcccacgctaattcagccgcctcagaggataaaatcggagtcgaaaccactgagaaacattatttgcactggttttataagttaggggatgcgttgtatccggttttgcggttcaagatcgattttgtaactcgatgataagttgagggtccttcggtgtactttttccaaaaaaaaatatcactagacataccagcccaaaaggcctactagatataacgcctcctacggtcctaccaattaacccaacccatcccgagcatggctccacctcactggcccatcgaccaactttggcccatcgagcatggttccccaatttttttttcgaaaacttcacatcgaatctttggacatatgcattgagcattaaatatatagattataaaaactaattatatagttaggtgggaaatcacgagacaaaccttttgagtctaattagtccatgattagccatatgtgctacagtaattcacatatgctaatgacggattaattatgctcaagagattcatctcgtgctttccaggcgagttatgaaattagttttttttcgtgtccgaaaaccccttccgatattcggttaaacatctgatgtgacacccaaaaaatttcttttcgtgaactaaacaggccctttcacgagcatcggcactacctcctccaccgctcccagctagtcgtagctaggaaaaagtacacggaaatctttcaccgaattacaaaactgttatttgaaccataaaattggatataatgcatccgtcaacttataaaatcagtgaaaaaaaatccctcaggagaataatccccggttttcattggtctatgtggctcttttaactaggtgttcgtcccatgttgacattaatgtggcactaacgtgataattcgataaaaaaaataaaaaacaaaacgcctagtactccctccgtcccagaatatagcaacctaggatgggataaggtcaggacaacgaatctggacatagtctcaccccatcctaagttgctactaaatccgtcctaaaatagaacaacttttagctatatagttgttcaaattcatagctaaaaatgcttatattttggaatggagggagtattagaaatgagggagcctatatgggacctacatgtcatcctcattctcatcttttctcctatctacttttcccgtcggagccagtcacgcccgaccgggtgtcgggcggggccccgttaccaacccgccaccttccacctcccctcccttcagccgtacactcccgcctcccaaatttcctcgaaaatttttcccgcgcggccgcaccaaaaattccccttccactccgccccgcaccgccccctagcacggcggcgccccccgtccaccgccagccgcgcgtgcccgccgcccgcttctcgtgcttctccccgccgtggcagatccggccctgcgctttagcgccattccgtcgaacacctcgagcgcgtcggaggctggaggaggatgtacgggcggcgcgcgtcgcagctgctgaaggaggtcgactcctgcgaggccggacagctcgtgccgttcaacgtaagtttctacccccccccccccctaagcgctcgcgtttcttagctctggggatctgagtggccggtgattaggtttcgtttgtggctatttttagggcggaattatggttggtctagctgcatagttgaaattgagttcataaatgtgcattttcaatcctacggggggaatgttatctgcatggtgtataactatcaggcgacagtttaaatttaaacgatttggcttttcggtctggtttgcaaaattgtatgtaatttgtgagctttcatttgtctatcttgatgatgaaatctagttctgaaatatactgagcttgcaaattgcaatcacatgaaagcacataaagtctggggctggtggtctggtgggggttaatgtaagttaagattaccgttcctgtgatgtgactgtggcagcatagtttaattagttcggttagttattatgcttggtccctaacttctttttcttatggatgtgcagagcgatgtgtttgatcaggttattagagagtgcaatgaacacaatacacagtttcagtcattgataaggtaaattgcttcctatcagaaaattgatcatcttcatctagttctgcaataagagttatgatcaattaatcaatttctaggatgtatttcacaggaaaaacagcacagaactatatcaaactaataaaactcttacttgacttcttcaccattacagtttacttaattttgattgcctgatttgcattgtgtttatgacaggaaaatggtggagcagaacttagacattgaaacaaccagaaatgacgaccactatggggcagccgtccatcatctttcgctgcttcgtaacaaaagatgtctcatggcttacatgtacaagactgaaatctcacagctgaacaaactttttactttctatgttttatgctgattttacatgcacgcactaattttgagtatggaactgaaagcactgagttcaatcaggtataaccgagcagaggttattcagagctttagatggaaaatcggcccagtgcttcctcatgaaatacaagaaaagctccatttttctgagaaagagtacttcaagaaccactcagcagccattaaatcatatatgtcagagatggatatagatttaacagtggtacagcatttttctgttttatttactttcttttggatgaaatacagttagcagattttctgtaccacttctataggacatggtgcctcccaaggatccctacatccaggttcgggtgcttgaggacattggtgaagtatctcttggtgaccattccatatcattgacaaagaactcacttcatttcctaaggcgcactgatactgaacaatttatatcacaggtttgctatcttacttttgtgatattctcagtgtgtttattccatctgctaataatgttctatcaaacttacaatagggtcttatggaagagtttctggagtagagatcacatatggtgtacaataggtattactcactaccttacaatatatgtacacgtttcatgatgacagttgacagatgaccagagctagcatgtcctatatcagaaaaggctttgatggtcaattggttactgatgaatatttttcattttacacatataaatagttaaatatcacatttttttaagaaagaaaattcaactatcaccacaacatgcatatattgaatttaccagttctaatagacacctattctgaaacactgtttgtgtttttgatctgatttctcaaaccatacatctctggcctgcagattgtaactgaggatatgactctactacagcatttattcgtcattgctatccaatggattaaacactactgaaattctgacagagcctatgtgaaaatcaaagaacatatgctgtctcagctgtgaaggtatgatgcaacatatatgaggggattgtgtaccggggtgctcctaacttatccatttcagtgatgtctagctttagatgaatgaatttaagtttgttctacactgtgaccattctttgcatgttgtattatttggtgataaaatcgaaacttcgtacactgtacaaaaatcttcctaaatttactggagtaggaaggtaacaagctctgttttagtgtttactggtgatgaagacctggagaagcctcatgcgttctgataaatgcagtttgattgactgctgtgttcgttttgctaaaactacagttctggatctcggatatggaattagtcagaaaacataaccaagctgattccaagcaagaatggtgaacacggttcctgctttcatgcaaaggcgtagtacaccatacatcacctagttaagtttggtatcttcttttactcactacaagtttcttgagatgctcttcttcttgctaacttaacttgcacactggcattactttcatcagactaactgagctctaaaagttgcagtcttttacgtctataatatctgcatgacaccttgaaggttcacttgtttataatgcagcgctagccgctagctgtctagctcctgttgaacatattacatattcatgttagttgtgtcattctatgattcgaaatcattatattcatgagggcatggttaatgctaactacctcacaggaccataaatcattccaaatctaaccggtacccaattcttcttaaaaatgaaaatgcccaaacgtgtttcactgctatctctttatctaatcttcgcatggatgatgctttgtacaattactttgtcgagtggttttatggcgactaataaattaatgctggtgacttgagaagctaatccctagttgtgtggtccatgaacattatcactacttcatttcaaccttgaaaatccaccaaccaagtaccctgtacccaacgccaaaatcctacatatacgctcaaacaagcaatcaactttactccgtgttcttttctctctgttgttttggtattcttgggcacaactaacttgtggtcttgtgggccatgatacttatgtatctgttgtcccagttgtagacgaacctaaggttggtcaccggctaccaaatgacatgacatgatgtctacatagttttgacactactgcggtagtgctaaactagccaaacaatgacaaagcctaggtgctaaacctatatataatctgcatccgagacttccaagtgaagaatgtcttttcctacccttgttaggtccacggactcctgaatcattagaaaaccagtacgttaaaaaatatcacgctcagaaaaaaaaaagagcttggttatcttacttctagaactaatcagtaatcatcagctcttatttccaaagatcacattaatcatattgcagcttggcaactactactacttgagttcaaaactttatattttggggacaagccattgcttcgacggatagcaaccgatcctgtgaaaaattccccataaaacccaaatcaagaaattttcaactgctatgattttattttttaaatcactattgatgatgaatagtgattgtgggatcatg

SEQ ID NO: 9370 - DNA, 2310 bp, Oryza sativa
tgtgcataagtatcggtagcgtgtatttgacattatattaactaattgatttacaattgctaatgcaggtacttcaaccgctccgagtcagagctcatgcccccccagtgttcgacgataggtacatcccgtacctaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacgggggcatgccgtgacgggcaggacagatactcctggatggcatgcacaagtgcagcagctgtttggcattccactgaacattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggagaggttctgtttcctgatgctgggggtgacattgcttcggcgatatggattcctttggtcgccaaccttggtgatctgggccgtttcagttgggggtcagcagtgttggcgtggacatatagacagctctgtgaggcctgttgtcgtcaggcaccatcatccaacatgagtggttgtgtgctattgattcagatgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaatagccggaaggaacgataggtacatcgaaactatacaccaaaatcatcttttctcagagtaccttcgttggctgcataggacatatagactgttcctccgccctacttggacggaagccgacatagaggatgaccgcgactccgatgaggggcggaatccctatgatgtccggactagagttggatatcaaatggagcacgccccacttagagacagagtcgtaagttttcttgcatttgtcaaagttacttacatttgcaccctagaccctaacatatatcttttcacgctttcagtcgagagagctcctcaggagtgtgaatgaaatggggcatgccctccaagctccgaggggtggtgaggacacggagaacacgctccgcaatgttttagaggtaaaatttatttagcactttgcattacttgagttatgcctaacaaacttttttttttttgaaatgcagaaagttcgtcaaaggtgccggaaacttgcagcaagattaggttgcaggtcggttggattggacgacgtgtaccaaccggggagactaccaccaccactacctcaatccgcgcgtccaagtactgctcgacactccatcaggatagaagagcgtgacggagttggtggctcgtcgtcgtcacgcattaagcaagggaggggaaaggggaaggcgccggctccacctagcgacgacgatgacgatgaggacgaggaggatgaggactacgtcgcaccagacgccgaggagatagacatgtcacagcttcccgacgcgcctcaggggacgcaacccacgcaatacaacttgcgatccactcgggcagcgaaaaagaggtaaaatgagcttaccattctcaaatgttatttgatttcccttattttgcttttaaaatgttttaaacattg

SEQ ID NO: 9371 - DNA, 22098 bp, Oryza sativa
cataggcaagctggcaaacggtgttctgtacacgtttaatgttgatactctaataatgaagtatttctgttcacccgtagtaaggttagaatgaagagtctcccttggaggaaatttttatataaaattacaggaatagagaaaacacacataactctgtcccaaaatataacaacttttagcgtcagaatttatcccaaaatataataacttcttcaccacattatcttcccaaccaatcacaaccctccaccattcactttttctatatacctccactactcatccaatcacaaccctccaccattcacttctacctactttattaataaccgtatcaaactctaaaacttattatattatgggacggagggagtagaattttaaagtttgattttctaagaatgaagtagggagtttaattgtcctctcataatcatgaaaaaaaagaaatagacaaggaagtaacacagaaaaccccaaagggcctattcattttggaggaatttcaacgcataggaataggaaaaataaacgaataggattgcatacacgctttaatccataggaatttttccatgaggtttgtgtggatgaaaaattccctttgttttctgtataggaaaggaaaacttcctttggttttcctatatttacattcctatgaccccaatgacattcatatgaattagtatttaggaatctaaatgctttgaaattcctccaaaacgaataggcctaaaattaattatcaaaccaaatgcacccagaacataccgttcaagacgccctgagtgtaggtgcactgccggtagggcccaacctcgtggtgtccaaccaccagcggcttctgatcctcggggatcttctgcagagacgacggcctcctcggcggcaggaggtactgcgagctcttccggccatcttcgtgctgctgttgccggcggtcaccttcgtcgtcggccgccgccgtcgtcggcagcagtggcttgatgagcccggagatgatctccggcggctttccccggaacgaggcggtcaggaatgagtttgatagacggctcagcgtcggagtgcccaggaagctcaggttcggggattgcacgctactgtacatgtcaatcgactgcctgttgatgcatagaaagaaaaaaacatgatcaaattcttgtgattcaacgttgcttattaattctgagattgagctatgatggaaactgcatttgaacatttagtgaagaaattatgcgtgcttgttctggttcatataaacggaaccagagtttggaatttcggtttggaatttcggatctacttctgtttaattcttggtaggaatttactctggtctaaattttttgattttgtttcactgcaacgaaatttgcgcatacacagcaaaaactaatttcactgaaaattccattttgatatttctgaaaattttcggaaatttcagtcgccgtgtttcgttttcttaatttctttccaaaatgtaaaatactatatattcagaacagataaaaaattggcaaaggcgccgataatattgatctgaaattctgaatattcagattgcacaacgccccactgattctctctccttctctcagacaaaattattttggaagaacagatggggaccaactgaagctgccaagtcagcaccagggaccacaggaacagtgacacgtagcaccaattccagtactagccgtgacacgtcactatcgtgggcccacatgtcaatggcttctgcaatccacctataggttcaccaacacgtgtcctcacaccccgatgccatcccaaatggctactgcatatcctgaatattctggccatcataggcctatcaggatcagaaggcatctgaaatataatcaactaaaattttcgaagaatatgtcatgtggtatgtctatgccaaataaaaatgtataaatcattgttcttagtttcaaactgttcttgcagagactcttttagtgtgtttggataatgggataagaatagtgggattggaatagggaaatggataaagggctatgataaaacgagggagggataatggatggctaggattagaagaaactctttgtttccccaacccattagccaaacaggcctttgtgtgctagtaaaaagaagttagaatctaaatttgtattttgcttttctacctaccagatgttcattatccaagaaacgtaccaaatgagttgttgagaaacaacagaaaaactgccatactttctttttttttttgaaaaaagtgttgcattgcaaaattcacagttaaaaaaagtaagactagtggtgattaattagtacgggatggcaaactgaactctccagaaaagaatggaaaagactgaaattattcgactgtaaacagaaaagtttggacttttattgacgcgtggcactgcgaaagaaaagaaaaaaatataaagaagaaatgaacttgcgtcggcgaacctgtagctctgaggccactgctgcgtataggagctgggctggctgccgcggccgccaccgccaccgccggcggcggcgacccgcggggtaccgcacgaagacgacgagtccgacccgtcgtccgactcatcgccgccgtggccgcgacgcttcccatcctcgacggcggcggcggcgtcgtcctcctcgtcgctgtcgatgaggaagctccggtccgacaccgaattgtccatctctcgcagtagacctcgtgctgaatgcaaatgcaaatgcagcaacgatggatcggggggagagagagggagagagagacactctgtgtgtgtgtgtgtgtgtgatgaggacgggtttatattgcggcggtgtgggcgctagccgcttagcaagcggccgggatgcattcagtggcggcgacagcggtcgaacgtactagaggtgaaacgaaacaaacaataagatgagcatgtggtgtttattaaccgaggccattatccttagtagcaatgatgtcgaattaacctattactctccctctgtcccaaaataagtgcagctatgagtttccgtatctaactttaatcgttcgtcttatttaaatttttttaaaaaaactaaaaaaaatatgtcacgagtaaagtactattcatcttttatcatctcataacaataaaaatactactcataaaaaatttcaaataagacgaacgatgaaagttggacgcgaaaacttatggctgtacttattttgggacggagatagtaccaaatagaagacacgatactatggatttggatagtagacacgtctactccctccgtcccaaaaaaaaggcaaaccctgggtttgcgtgtccaactttgactgtccgttttatatgaaatttttttataattcgtatttttattgttgttagatgataaaacatgattaatactttgtgcgtgacttgtctttttaatttttttcataattttttcaaataagacgaacggtcaaacattgcgcacggaaaccagggtttgtctttttttgggacggagggagtagattgatatgtcctcaccacaataatttgtagttttcttgatgaccacatgatatcattggcagtcaaaaatagtcatcaagtttagtcattgtcttagcggttaaaagtttgttactctcttcgtcccattttaaatacattcatcagtttccgtgtctgattttgatcgtccgtcatttttttatgattagtatttttttctttttagatgataaaactttatgagtgatttatgtttttattttttttttcaaataagacgaatgattaaggttggatatggaaactcatgactacacttaaaatgtgacggagggaatatattttaagatggatgtactatttatcatcgctgatctgcacttggataactaacaatctagaattattagattaattatgatgaatgaaagcctactacttgtgttaatatttagtatgtaatacgctttaataatatgacatgtatttcaatattttgtaaaattttgaagagaaatataaatggttaaagtacaaatataaatagcgctagttgaagaagcatccacgtgagtagtgtcctaatgatattccgttggagtagcatggaagggtgagggtgagtagcatggaagggtgagggttgcttataatttgagtctcatgatgcccatcctttatactcaagtttcatgaatttttaagataaaaaaagtttcatgaattactttgatttttctctatttcccactaaaaatcatgaattctgctactcgatcccttcattttaaattacatgtcggcctaattctagagttcattttttttctaactaaaatacttttcattttcatattccaattaaacactttaaatgtgaatttccttttatatcctttattaatgcagtcacacgtcaatgtagtcacagctctaatggacttatttcaactaataaaagttaacgactactgcagaaaattcaattgcgtaatctacttaaggaatgggtaacaatgtaatttgtcatattttttttgtggaatttgctagaacaataagtaattttaaatcaaaggggtaaataaaataaaatcccttgccaatgtgtagttttactggtgtacatggtctcctcacaaagtccttgcccctatttcacgcgagccaacattattctgtcgatttagatttcgctggtgctatatatatattttgtagaattagtcaattcgaagtaatttataatgtattttttttctctctctctctcatgtggagcaaaccaagggcatgtgactttgtaacatgtgtggtctgccaccggccggttgcaatgggtgttgtttggttgcaaacttgcaagtgcaatacgcccgagattgcaatagctacttgttcttggcctcatttgggtggcttacgttgcgttcatttttcgaatgagatgattgcaatatgcatggattctccagctcttgtgcattggctttaacttgccctttgcagttgattagggccgcaaaatacaggagtgtgcgcccctgtgaatgtgaggttttgaggtgttgggctgtcccggttgcaataggtatttacgtttctttttctcatcgagagtaatcagaaacaccacggtcatactcacactgcacaacaccacacatctacatatgtggacgccctcggcatttagtgcaattgcaaaatattaaggaataattgctcttttgccactgctgggcgtcctatttggcaatatgccactgaaaaagagctaattgctccaatgccactagaacgagaaaaaaatcatttgagatgccactgccgttttgttccgtcgatggccgttaactgctcggtaaaaaaatagggccaactgttccaaaaaaaatattaagcatttactatatggggttaaaagttctattgaccattcaaatacttcatccgtcccattttaagtgtaaccataagttttcgcgcccaattttgatcgtccgtcttatttgaaaattttttataattagtatttttgttgttatgtgatgataaaacatgaatagtgctttactcgtgacttatgtttttaatttttttttcaaataagatgttggtcaaagttaggcgcagaaaaccattgctgcacttaaaatgggacggagggagtagttaaatttcctctcatttctacttcatccgtcctaaaatgtaagaaagtaggtgagactgattggaggaagtttccttcgtcccaaaatataagaaattaggtgagaatgataggaggaaatgtgtgattggttgaaaagaaaaagtaggtggaggagaatggttgtgattggtcgagatgaggaggtaggtggataaatagtttcattttgggacaaggtattgtgctagaaatagctacattttgagacagagtaatatgaaccctagatcgatccattcatgggcgtcgacggcggtttctgatgagtagggagttgtagctgcgtcctagagaacaagggcagaatggtaattaccccagtcaaacgtgttgactaacagaattatttgatcctaacgacagagtgccattttggcgtgcccaactgtgaaaccagtggcattctaccaattgaccaaaaaccagtggcagaatgacaaatacggtaaaccctagtggcatttgtgtaattggccctattattaaaggtatagaaaacttggaaagtcgactcatgatacccacaccaagggtcggttcactacaaccgctctttgatagtttcctgtctatttatatatattttaaaaaaaaacacagtacaaacgtgatgttgtttatatgccagaggaaacccaccgtctcttgtccgagtgcgtcaaatttgtacaatttctttcaagcaacatgtttaaaagatatggatccatattatttacttttgtgcatgtctgagttggttagctctgcggctgtactactcatctactcgtatctcctgcggtaatccaagatacagtgcatcttatttttctttttgctgatagatatttaatttcttttttcattgtaacaatggggtctcgcaaaaaaaatgtcgaaatacctaattggtgctgcctcgcaaaaaaaaaagtcaaagttaattacataaaaccactcaggatcgaacaaatgcatatcccgctgaattttaattttttaaaatgatttttcttctgatattattttccataattttggggattttatttttttcaacccccatttctcttctttcttcttgtttatccccaattcgaaaatcctacgcgcgcgggtcttttggacgagcaggccttcggaactacatcctctagagtatctgcacggggtagggaagcgtgtttctttgcacgactactctttgtttcgacaaatttgactacttcatctactttgtgttcatgttcgagatgtcgacgaaatagaatggcaacacagacactggcaatgctaatgccaacaccaaccactagtgcacctggatcaaatgtttctggtttattctctgggtatcactactacagaaacacaaaaaggatacggcactataggtgctagaatagctaaaccagcacctatagtgctttttacctctaacgcacgcccacagagcgccatcggctagaaccgacatctttgtgaagaaataggtgtcgtttctagagaaaaaccaaaacaaatactacatgtgctgatttatcaagaaaaaccaacacctataatttattaatctacatgtgctgagttaaataggtgctatttaattaaaaaacagacacccgtaataaccaagctgagccgagccggctaatcgcgagcggatatggagagggaagggcagagtgggtgtccttatccactctagtcacctccgccatctctctctctccactcatcacctggccacgagggcaccgcgaccagcgtcgatctgcccagaggcggtacgagccactgaggccaccgcgcacgaggtgctactatgggtggcgcccacagaggaggcggagcggcgccgacaatttggatctggcgtagatcacggatgggcgttagcggcttcccacggccgatccgacagcgaccacgtcggcggcggctttcccacggccgcggtggtggatgttcttgatgtgttcaatattgtattgttcttcaatgttgttgacgtgttcatgtgtttttggatgttgttgatgttcttggatgccaattattaatattgatggaatctgatcgagctgaagggatctgctcgtcaagccgctttttttattattatttttttgcatttctagaaactaaaggtgtcagtttaggaaccaacacctttgagtcctcctcaaaggtgccgcctactaggtgccggttagaaaattcggcacctatggacggttcccaaccggcacctattccattttctgtagtagtgctcactctagtgttgaacatgttacttgatgctataatctctgctggtaaggttgtgattaacaatagcttactcttttccatagttttcatatttattctcacgttattctcgattaaattatgccgaaatatagatcttcaatatactcgagtacggtcagtgtctcactatatctatcatatgcgaagtgagcatagctcaactggttaggttccttgtggtggaactagccaacccgggttcaaatcctagatttgccacggtactcgcatttacggctaattattcttttagtggtaggtgatgtaaccgttaacagcatggcacccatggtggcttcgtcattctcaagatatgccagcaagtcttccggaagtgctcaaaggggtagggtgtgcgtatgtgcgtccataggagttagtgtgcgtgcgttgtgagtgcttgcgtttgtactatgtttctaaaaaatatatatatatactttatagaatttgagaaacttcatccttttctttaccacttactagaacacaaaataaatagcaacctgtcggcgggcgtaaatggcaccttctgtcaacaagatttaatgcatcatgtgctgactcagatgattaatcatcctttaattagatagtactaatgtactgagattcctccgtttagcatgcatcttgttgaaatatagataccacccacgatgatgaatgtattcttttaattttatacaagaagtcatatggccatatttaaaacactgccagttatcaatgtgattataataaaaagctacaaagttaatacatgcatagatctacaaagctacaaagttaatactccctacgttctatattataacacgttttggcttgtttatctcttataatataatttccaatatacatatgaatttggacacatatatataaagcaaatacatgaattcgatcaaaacacataacgtctatagtgtgtaatgtgaaacgcagggtacaccgaaaggatcttgaatttgcctagaggggagggtaaataggcgttcctaaaaaattatcacaacttcatagcgtactagagagatgagaactttcggttcaaatcggaacttctggtatgggattggaagttctggtcttaacataaaagttcggcggataatggaataaaatactagctatgaacttgtagctcgaataaacaaaatgtatatgaatcaaaaggtggcaaataaggtatctaagcaagatataaggtcaccaactatattaattaagcatgcaagtagatcgggtaaaaacaagctcaagcacaatatgagagatggcaagaacgagcaaaccaagagaggagacacgttgatttgtttcccgaagttcggatccacggatcctacgtctccgtgataggttaaagcttgtcatatttcactcaaatgataggttaaagctttggtttgtctcaaggtagcactacgataggtcacttttagcaccgagacatacacaaacacatcaacgttgcatccctcttaatagtacggcattcctaaactcaaatgtaaatacgaagagaattataccaataggaatgctttctttccatctttctttccttatcttaagggatgccaatgccgaaaccgtttcaccatatattcttcaaattattgatgcggttacttctagtttcaaatggccttgcacggtccatcatgacaaagccgtcgctcgcccttcaccgctggatttggttcttcggcgccaagctccctgcttgcccttcaccgccacatggtccatcactaccgagcatctcttgcccttcaccatcttgccatagtagccactttgtatcccacatcttcaatatccccacttggtattttaggtgtaatcatatcacttgagtgtcaacaccttttcaatccttggaacctatttttctcattcaactcaatgaaatcattagtctcaaatatccggttgtcaacctctacatgttgaccaaccgatcacatgtataaaaggatataaataaatgaggagtattaaattaacaccacaagtgtcatatactcaaatatatgctcaaatgtaaagatcccaattaaatgaaagtgaatagcatggatcgattacatgcataactaaagtatagatttgctccccctaaatgtatgcatacaaaatgtttgtgtgaagcaagagtatgcataaaaagaatgaaacactaggagcctatcctatacaagaatataagtcatttatcaaatataggcattaaaataaatgtataccttaatcatcttcatgttctcaatgtaaagagactaaacaagagaaaaaggctcaaacaaaacattagtctcacatatatatcattattcacatggaaatattatatatgaacatatcaatatgtacatggagagaaagattgatacatgtagcttgatctccatgcttttcatccttgtgatttaggtccaccatcaatgaacatttctatctcaactcatagaagtccgggaatcacctttcacacactccactttcatatccacatgagactaggcgaagaaatgcttataaaaaaattagtctcacataattggatttatcattaatcaccaaaaccaaattaatggcacatgaactttcgtacacaaatacattggtagttgtcctttgcataatatctctattcagagaaaataacgacatgctgtcagtagttaaaccggacaatatatactctactggagaagtgatctttgctaggtcatgcaaaaattacattagacccggttcgaatagaaaccgggactaaagaataggtttagtcccggttcaaaagcccagcggcactttttgatctttagtcccagttggcaagtcccggttcaatagccacaggtcatgtcaagccctcgaacaaacattagtcccggttggtaataccaaccggggctaaatatcactcttccaagcatctcacgcgctctctctcttccttgtctccttggcatccgcacaagcttttcactccttgtcttcctatcttatcccctctcctcctccactccttctcctcctcctccactcctccgatccactcctcctcttcccctctcccggcaacaggccactcctcttcccctctcccggcaacaggcggtggccttggagggccatagcaggcggcggccgggcggagggcagctaggcggtggcaacggcccggaggggtcatcggtggcgcttatgagcgggctgacgcggcgccggagacgacgatgcgaggacttgtgttgtttttctgatgccattgtatatgtgtggtgctattgtggatgattaattttgttgagtatgtgaatttgtgatgctaatgatttgtgaatttgtgttgtcattttgatctgtgatgtttatttgatttgtgaatttgtgatgtttgtgagtttggcatgaaatcaatatgcaaacagcaaaaaaaaaagagacctttagtccaccaaccgggactaaagatgagcatctttagtcctggattgggcatcccggttgcatacccgggattaaaggggttgcaaataggaagtattgtgggtttctccagtagttatataattgaacaagtgaactgtgatagcgcataagtaatttaggagttggtgtgaaatgattatcaacatggaagtgataaaaaaaatttaaacatggaaaatatatgctatgtcatcgagttggcatgtatgcctctaagattttaccatggattttgtatctttttcttcaatgcatatgattttgcagattttacttcgaaatataaggcactattaatcattggttctaaggccgagggctacactagcatgagataggtcatctcaatcgggcggaaaccatcatctgcgtcgggaagggctcccgtcacaaaccaaaagtcacagatgtgagaagtcatctgtatcgggcatttagtcgtcacagatgacagttatctcaaacgggccaaaaatggtgcccgtcacggataggtttgacccagcagatgagtcaaaccaggaccaaactagggcccatcactgatgagatcatctatgacgggctcatacttcaatcacgggattggtatgattcccatcacagatgactcactcaatcgggcttgtttttaaccccgtcacggatgactcatctatattgggttttaatttaggctcgtcacggatgatatcatctctatcggtcttttatttaagtccatcacggatgagtattttacaaaaaaaaattattttttggctagcctcaggcctttgctagccatgcccgctgaaaatgacagaagaagctatatatattccttttcccaacaaccccgttcgcacatccattcacaaatcaaacattcagtgatcacatcgacattcacacacccattcacatatatatgtctgagacatatattcaatgatcacacatccacattcacatatccattcacatatgtcattcacatccattcagcgacatgcatattcaagagtcaagcatcaaaaacctgcaaaaccgagttataaattggaacaaatttataagtgattagcattgcaagtatatatagaaacgtcagaccgcattgtattacataatatatatatatatatatatatatataaatgtttaaccattgtaaaatcacatgtatttgatcgagagcgttcaacccgtcttttgtctttccaggaatatttagcagtaaccattataaaatgaatggccaaggattgatgctgaatgtagcaccctcccgtagctctagaggatcccgctactcctgaatccccttggtgtgccttaactgacaagtggccctatgagtcgataagaaataaggaagttactggagtatttgccatcttttaaaataaaatgtgtatacgcttctagttttgaacatttttactgctcaagaaaagaatcaattatgtttgagccactcatttgtactagctcggccagtgacaaaacaaaattcaaatggcaaaacgaaatatatatcaaaatcgagagtagaaaaaaaaacccatctctgttttcgtgtgctcagtggatgttcatgttgttgtatggttaacaccatgtgccaatatgcacacgctgatcggcaactatttcttgtatgaaaatgacacagcaagagcgtctctctcgttttatggcaatgttggcttcatgtttcaataattgaggtgattgcgatagatgcaagctagattcttctattcttgtgtgcctcatctgctattcccggtggatagggccgcctgctatgcacactctgatgaatgcggggttgaggaattgatgatgacagctcaagggactgtggaggattccagttgcaataggtgtaaagttagatggcttttgagtaatagtgaagaaattgggccaaatgatttggttcgagaatttatctgggcatgtattgcgttcagcattatattgagctaggatgacttcatattcaactgcagcttgatttggaaaaaagatcctacccaaatacctataaatctcacaacaatttaactaaatgaggatatcgtaatcacaaatggatggcatcacttttttctaaaagcaaacattttgaaatgtgattttaagattaattttagtcaagttatttagtcgtcatctttgcaaccatgaaaaataaaagtggcaaataaccccccccccttccaaaaaaaaaataattctaaaaccaaattctataattcaaaatgagatgtggctttttaggggaaaacaatgccaagtgggattgtttaattagtgttattaatcaggagaaaaacatgtgtagtttatcttaagaactagaagcacaccgtgatttagaactatctagagttaaaaattctcttgaaatacttgttcttcaacctacaccatgatttgctcttataaaataaatttcataaactcctagatattgggtcgtccgtaacataaaaccccaattgttgtgttttattttaagtaacctcatattttggggaaaattgtttcaagaaacatatttgtgtaaactactcatattttaatataatttattattagttttaaaaaattcacatttgttgactcaaagtacatatacctctactttatatttttttctcaattttgcactgcacaattttagtgcagtgcacatcttaagtttttgtgcagtgcaaaattcttttggcaaagtttcgtttggcatgtgtaccagcagccttgggagagtcaggttctcaggttgcagagaatggaagtaaagcatagtgttagttatctgtggaaaataccctggcttcttctggacagttgtttaagaacttgattacatctgttagtgaacttggcttacgtccggttggatgtagaggtcggatttatccccttttgttaaaaaaaaaatatgtcggtgaacttacgatcagacgcacattcctgaggtccattggaatcctgatctcaaattacatggtggactcgccacctggcacagtgtaacatgtgcctggaagggttccaaaatgccgaagataactactatctccatctcataatataagggattttggaggaatatgacacatcataatagtacgaatctagacttgtcacattcctttaatatcccttatattatgggacagagtgagtatttggttattgtggttattggccttgttgagtcgtatccacatttattttttttgaaagtaaagagagatttcattaatgagaaaacagagggttacattcctggttcaagagatcaagaatttctgcaggggaacacaatctccagaccgtattagttcctgatcccattaccagttgggctaaagcataagctatcttattagaatctctctttatcctgtgcacttgcacctgagctaaacataacattgccgctttaacatctgaaattatgccactccaatctgctcttgagacattggtcgcgtttaactcagcgacaacacttgtattatctgattctaagataagtggcatattcacccattcagtagcaagccggataccttccagacacaccaaggcttcagcttgcattgctgagctgcaccgtggtagtttcttacaggaagccagtagcacgaggcctcgacaatccctgattattatcccagcgcctgcttcacctgtgtcctatttgaaacctgcatcaacattcaacttggctacacctttggtggagtttgccacttgcttttcgttcagctgttgttgtatgtatgtctcaacaaacattggtccttttcctttcacatcatcaggttgttgccgagtcattagagtgcaatcttcgtagttcttcaaaaagtcgtatccacatttagaagcgcttgaacaaacaagtcaagttgaaaaaagagtaaaaaaaagtttagaaaaattttgttcaactggtttccgatggcaaccgctcggttcaaactgaacttatcatatttactttgcaatctatcaaaacattgttaggatatgttttgccatcgatccagaacaaccctcatacactataactactgtctcagtaacacgtttattacattccaaacacacaaaaaagaagtctcctactacgtttgtcatcttctattttctcttctcatttccaaaatatggattaaaagatattcattgtattattcgatgaattattttagaagctataattctactaggaaatattagttgaatgtatagctataattcctttttttattacataacagatatagataatatctagctcaaagagatggaccagttgtgtatcccactcaattatagctacacatgggagatctaaaagttgctacagtacaatgccaaattaataactatttgccttctgaatatagctaaagctattcaccaaatgcttattgttttgacgcatatgaaaacttatttgaccatgcaagagatactatggaagtgagctgatgaaggaacagggatcaggaggactggggattgcaactgcaccatcaagcatttgtgtcacctttagcatgttaggtcgcatgcttgggtcctcctgaaggcaccacaatgccactgtcacaaatctttccaccttcttaatattgtagatcgcctcatcatcgccctctaccagcaaatcaatcctcccagaccggtagcagtcattggcccagtaagtcactatcgtctgttcctcatcgacaacctctagctcgacattcctcctacagcaaacaagctctagtagtatcactccgaagctataaacatcaaccttggtagagatcccaatgttcttgaaccactcaggtgcaacataacctcgagtaccccgaataccggtgtttgtccttgtttggtttgtcaaaagaagctttgctaggccaaagtctgaaatcttggccacaaggttgtcatcaagaaggatattctgcggctttatgtcacaatggatgatttgcttgctacattcgtcatgtaagtagagcaaacctcttgccaccccaagcgcgatatgaactcgggtgttccaatgtgggcgactattgtcgaacaaaagacggttgagagggccattggtcatgaactcataaactagcagtctttcggctccttcattacagaaaccaagcaatctaaccaaattcttgtggaatgtctgcccaatggtctcgacttctaccatgaactccttctcggtttctggttggagcttgtcaatctttttcactgcaatgttggtcttgagttcatcctccaactggcccttgtacacaacaccagaggcaccggcacctagaatctcatggaagccagccgttgccttctccagctctttgtaagtgaaggtcttcaagggtagttgggatttacttgatgcttgtgacaatgggatattcttttttgtggctattctacagtaagtaccaaaaaggaaaatggagatgagtgcaaagttcaccaatatggaggttccaagaatcaaagaactccctaggacccagtgcttcctgttcctcttccatttgttggagcttgtactgatcatggattgcgaactattgctacttggcaccttgagaagaacggtcctctggacatagtcagccatattcccatttgacaaagggagcttcttcttccagcaagtgctggtgctctgattgtacaccgccatggcgcagaagcagtcgatcacacacagccttccacaatcatcttgtcctatgggctcatatttctcatagtcagacagtggccaatccacaccataaattggtctcagctcaaactgagcaagtgccgttgcctcatccaagtcgcagctatgcggttgaaagtcttgcttacaccctttgtacttcttctgctcatcgaagaacttgtaccatggtgggcattggcagcttgcaatctgattcctggtgccatcaaaggtgcagtaactgttgaacccacagacgccactgccaacatctgaaactatggcatggcagatattctggggctgcatgctcactgctgtccatgtctcaccacctaggatgcctgcattcgctttcttcgggtacacatattgccggaaaacaccgtcagggtccagtgtggcgcgatggaagtagtctgccattgatccaattcctgcacctgatgagatgttgatctgtgtaccatctgtcagtgcaaagtataccttcccagtctcactgaataccaactctgagccatttccagtcgtgtcagtggaccaatattgctggtatttggatccagagggaacagcaacaagatacagggcaaggtttccatcagtttgcacatcaaggagaaaccgaccactggagtagtcattgatgtcgagtcgggcacggagtgacttgttgcgagtcttgttgcaaggtatcacctgagtaggcaagatggtgtctgacggcatgtcaaaggtctgccactttgtcgtgccgtctgcaccaaggagcacaaaattgccggtgtcgcgcatgctagcatatgccacactggtaacctggggattccagccctcctgaccagaccggtctttcagtgagagtgcaccatcattagtgagttggagaaaagaatcagatggcacttctactatcgatggatcttggtcagtatttttggcataccagacaactgtcttatcgctaatcttgttgaaccagacggcgatgaggtagaaggaggtgttgccctctacaggtcggaagccaaatgcgaagtcgccagagggtgatagccatgaagaggcaggactctggggtgccaaagtggagcccaatgtgatgttcttctgagtttgtgcacaagttggggacagtagctgcaacagcatgggaaagagtagcagagcaaccattgttctttgcttcaggctcttgcttcctacccctgataacagctggtgagctgccaaacttgtgtagttatagagctatcctaacacttgtcatggaaaggtcttcgtcaccatggaattctacatatacttgactaatcaagcacttactggaatttgccacgcagaaagcagcaatagggaattcgtgtcacgatagcagtaaatccgtagaaattcttgtccagacaaaaacaacaggtaacagctagtgagaccaaatagaccaaggcatcaagctagtcaattctggccattagtagcaccacggggaggatttgctgtcgtcgacattcttgctgaagtagacaggcttgacaggtgttaactagctatagattgccgagaaaatgtttttctaccctacacttcagggcagaagaaatgtttgcatacattgaactcctctaaaaaaaaatgaagcagaaaaaatgtgtgacatgtgtctctgaatcttttgccaattgcataatgactatcagtatcaggtctgagtaacaaatgtttgtactaaaacagcttagtatgcgataaatttcaggcatgcttttgcatagattatgtcaaatacagtgtaaagagtaatattttggtccgattttataagttcggaagttccctaggtcacttcaattctacatgatgaacaataagtagctgtatttggactcactagtcctgggatatttctatcatataacgaacttgaactgaatcacagtttactgaactgaactgaaaacagtaacgaatcgaagtgtcaaactattgggctctacaagcaattcatcaaacaaatcgtatgcattctcgacctaacgactccactgttggcatccaattcactgagtaaattaacaggagggaatcaggaatcaccactgaaccagtactctttgcagaccagttggcagttgccggcttgctgccgctgcgagttgaagcccctcgcccgtggcctccctccccttgccgtcgccgcggccggcggctccgttccgccggatcggcgcgcgccgccggcgatgccatgcatgctacaggctacggccgctcggctaggggttggtttttcgctctcgctctccctctccctctcgagacgccgtgcctgccgcctgccgccgacttgacgagtctggccatcggcgttgggctgcctgagcgagtgagcgggttgaggattagctaggcagttaacagctcattcgcccttcgctctctagctcactaattaccagtttaccacatctttagttagatattctctccgacccataatataagatattttaggtgtatttaatgggaataccctggatcggtccctcggaggagggagaaatatcgggcgctccctccccaccccctcccccgacgcgcgctgcctgcccctgggcccaccacatctctgccctcacctgccacttatctccatcatatactccattgcaacaaattacccacatattttggaaatattctattaaggaaatttagtttatttttgttccaccgataatgtttcatccagtgcactcacaatgtttcactatgtatatatctaatgttgcagtgaactgaaatactctattgcaacaaatcacccacatattttggaaaccctctattaagggaattcgttttattttttgttcgactaaaaatgtttcacctagtgtactcacaatgtttcactatgtatagatctaatgttgtagtaaactaaaacattctttcgctatttgttgaaacattgtttttatataaggtgaaacaacacccgatttaaacgggtgaaacattttcgatctacgtagtgaaacaatttcgatatacctggtggaacatcgtgtaacatttaaaaataattcaataataagctaatttttttatcgaaatatatccatgtgtggtcttgtttttaagatttaattgcaacaaatttaatggtgtaatcggatcatgatttggataagtagtttaagagaaaaatcaatttaaagttgttttgcacgtatacgtggcgttgacggcgctgacgtcgtgctgacgtcagtgcccgattttaaccccccatcgggcgcccgtgccgaagtcattcccgtatgtaacacatactagtataataaatctggatagacatatatgacacatacaaactagaacaataaatcttgacatatgtgtcacatcttcccaaaatcccttatattatgggtctgtctagattcattgtattaatatgtgtcatatctaccaaaaatctcttatattatgggtctgtccagattcagattcattgtactaatatgtgtctgtcgcgtcctaaaacgaccctaaaatacatcctctaaatgatgcctagaataattaaaatacttgtgaaagccttcaaaaattaaaatgtgcaaagttaaaagtcaattaaggcttggaggatttttgtatatttcctaaaagcctaaaatgtgtaaataaattttagtggaattttcagagcataaataataattattaagaaataaacaaagttaaaaaggttttataaaaagaaaaccctaaaaatcccccttccctctcttgggccgaatccggcccatctcccccccctctctcctctcccccgcggcccatccggcctctccccgcgcgcgcgccgctgacgagcgggcccgcccgccaccctcgctgacgggtggggcccacccatcatccccttcctcccgctgctcccgccgcctcgcccgcgcctagcgccgccgccgccgcgaattccgccgcctcccgtcgtccccgcgtgaaatcaataggagggaattactccccgtgatcccctctccctttccccccattttcccctctctctccctcattcaaacgggcggatttgcccccgcaaatttcgccggcgccattgatggcggccggacctcccggccggtttccttccatccccggccgccctctctcccttccaaccccatttaaaccctccctgcacctccttcgcccgtttccaccctttgccgtgccctctcctcgccggaatcgagctcgcgccgtcgccctctctctcctctgtcgccgacgaccttcggccggctctctccgctcgccgggaccgtctcccgccccagtgtcgccttctccggcttcgccgcaccgccgccgtccccgtccgcccccccgtcgagctcgccgaccgccggagtgccgccgtccccgtccgcccgagccgcgccgccgccttcctttttcgtcgtcgccgtcgacctagggtgagccgtggaccgccgtctcgtttccccctttccctcccctctctcggccgccgctccaccgtgcctatggccgccgccggcgaccataggggcgcgggcgcgccgcctcccgcaggccgcgccgatgtggccgccttcgggcgcgccgagcggctgccgcgtggggcccggccgtcagccgcccgcgccctcgggtacggctgacgcgtggggcccacggcgccggccggtgtgagcccgggtgcacccggtccaccgtggaccgtgaggctgccgcgtgggccccactcccgtggacccggt

SEQ ID NO: 9372 - DNA, 3231 bp, Oryza sativa
cctgcaccccgcctttttcttttccgttggtcgtgtagacgctgcagcttcggaagatccgctcttcgtggaggttgaagccgacgtttgggaaagcgagcaaggcaagtcatatcatctttgaacatattggatcccactttatgaaattattttgatttaaattaatgcattatcgctttatttaaattctcgcgttatcactgttttatttagccatgcctatttacctttgttatgaccttatttttgttattgttattattactttgttcaccctagaataaacaaaaccccaactagtgggcgctctactcatggttcccctagtatgaatttagatagatgcttcgctgattaataagacaacattaggtggtttttataactttagactttgggaatattcatatctcttggactttatggaatggttggactattgtggaattggatgcacacctctccctctattcaaaactctcaaaatggttataggctgggcttggggtgcatggttttgatagtagcacctcggccacataaggaccggtcttcgggcctctgttgcaaagcactaccgtacttccacatgtatagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacaaggctggtgtcctgctgctaggggctcagtcctacctacctgtcccggaggttccggctgtaggtggggttgggtcggtactcttgtctatggctaggatgggttggaaactatgtcatgtcttccgtccatatgccgtggtggtatgtggcacgtggttgcacatgaggaagacgtgtcttgtgggtaaagatgtacacctctgatcagagtaaaacctattcgaatagccgcgccctcggttatgggcaagcctagcaatgtacccaagttagtgtttttaattcttaaaacctgcttaataactaaaatgtggaatggttggcctgggttggcttgggacgagctgggacccagggtcgggttgccggttcggtctgaatcatcgtaggccttgggttaaggcaggttcgtgtgggttcacggccttgtttaataatattaaatagttctaggatcgtgttttaaatttggctttgagcaactaagagtcttttaaatgctgtttattgcaaaacctaacccctatactataactccattgtactcctttgcatttatgttgcacttgtgagtgtgtcttgttgagtacggtggttgtactcagtcttgctcaatttttcccaaacccagaagaggagctcctggatgatgaaggctttggtgtttagctcgtgcctgccgtcaagcgcctgtggtcgtcgccctagtcttccgctgtttttcgttgtcttcgtgtgtgctgggccctcgttgcccatgtaataattaactatttacgcttccgcttgattaaactctgaattgtatcaacttttggtgtaccttgcctcctaggacaaggaataatacacgcacatatggaacacccgttgggttatttccggtcgtgacatgtgtcatatctaccaaaaatctcttatattatgggtctgtccagattcattgtactagtatgtgtcacatttatattatgggccggagagagtagatatatatggacggttggtttaaagtttatataaatttaaaatttgaaatatttatgatcgtacggacagttgatttaaattttatatggatttaaaattttagatatttaaagtttattgagatatttaaattttgaaatcttttactaccttactatcatgtctatctatatatacgtgagattcttaactggacccaccattcccttccattcctcttcaccacatagctgaatcttttggcgcatcatagtgtccggctcgagtggaacaaaaaaaaacagtaactgagctgaagaatattaatccatgggaaactgaggtgatgttgcaacaaaattcattgaacaaaacaatgcttttggcttgtacatgtcaccttttttttctacaaaatttgatttatagtctaccagctcagttgcaaaattaagtccatattgatctagctacaaatgttcgggtggttgcatttcctgatttacatttcctgatttattttattttgcattgatgcaatgctttcctagctctgacactgcttctcctttccttgggcggttgaaaggcagaacaacaattagagcaccaatcaccaaatctttattcaacttttattctgaaagttttcagatgattttgcaaaacaaagctaagttcctcaaatgattcactcaatctctctaagtatatcaatataaattcctcaccattttttgccctttttattcctattctaaggtttgatatgtggagtttggtagagataaaacatggcttacttgcattcatatttattactaaatcaaaaacccagactaaagcagataactaaacatactcaagatcaagatcgtgcaaagtgtgtgtgatatatggtggacatgatatataaagaaaatgcttctcctttatgcttattttcttctcccaaaaatcgtttttttattgattaggagagagcatgcaagtacatattagtattatcactttttttccattgtgtgtgtgtttcgaacaatagttataatttcagttcatattaattgtggtcagttccagtacatattagtattaaattcgcatcccaatcaatttctattacaatttagttgtcatgctaatagtgcctattatctcagttatttatttagcactccagcagccacatggatattgtgagcaatatttatagcacattaactcttgcgttccgtaggagaagctgttgtgcctaatggaggaaagaaagaaaaatatagtgtcattacactttactctttgaacgtatctggttgagaacttctatttttaaatgactatagttaattatgttatttgctttattccgcacccatgccacttcgggttacactcagaagcccaaggctgtaaccaagaaagaaaagtaattcactgcatccctctgttggtatagtgggtgctttatacatagtttttttttaaaaaaacggtccatttttacagctatagt

SEQ ID NO: 9373 - DNA, 1220 bp, Oryza sativa
cacaatatattttgatgctattcattccaaaagcttgttatttgtcagatttcttctaaaaatcatgttcccctcatcccttttattttacctaggccagagtcatgaaccgtgtgtgtatttctgtataagtgagggaattgttgtgccagaggtccccccatccagttgtcttcccaaaacaggatgttggccccatttcctgctttttttttttccaagcaatggataaagaaagtgtctttgatctccatgagcccttgccagaaatgtgatgcccctgttttagttttctgggctgttaggatttttcttgataaatatttgtctctaagtaattgttgccacagaccctcggttttttcaagattccaaagccacttgcctaatggggctttattcatagcctccagatctatgatacccaacccaccttattccttaggcgtgtgtttggttctgggactaggtgggatgggatgaaaccatccctgatttgaggattgggatgattccattcggatgtttggtttgtagaataggacgatcccagttttttgtttggttcaaggaacgagggagggatgggatgagcgccatttgcaaccaccgacaacgccgtttgcaacaaccatggccgacgccgcctctgccctcacctccggacgtggtcgccaccagcctccttgatggcgtcgatgagcggctgcggggggctcggcgacggcggcggtagacggctcgggcgacagcggcggcggcgggctcgggcgacattgacggcggtgggctcggcgacgacgacggacgggatgacccaaccgagcgctgacggcgatggtgtcggccttcgcgcagagcagccgcggctcggcgatgacgacggcggcgaggtccgcgcgggagagggagagggagaggccggtggagaggagggcgagcacgaccaccatcgcggtcgggcgggcatagaagcgcgacgacgcacggtcggccttcgcgcagagcagccgcggcttagcgacgacgacgacggcggcgaggtccgcgcgggagagggagagggagaggccggtggagaggagggtgagcacggccaccatcgtggtcgggcgggcggagaagctcgacgacacacggtcggcccgccgccgagttccccgtctccggatccgtcgccacaaccttccccatcgccggatccgccgccgccgccctcc

SEQ ID NO: 9374 - DNA, 113 bp, Oryza sativa
gttaaacatttatatatatatatatatatatatatatatatatatatatatatatatatatatatatatatatatatatatatatatatatatatatatatatatatatatat

SEQ ID NO: 9375 - DNA, 1000 bp, Oryza sativa
  unsure (1)..(1000): unsure at all n locations
nnnnnnnnnnnnnnnnnnnnnnnnnnnnnnnnnnnnnnnnntcgagctgctgcatgaggcgacgtagatagcgagcacgaaggttgcaaggaagagaagatccgacgtcaagaggaatgagaaaacgtcgagccatcttatccttagagttacctgtgagttcttcacctttcttgctcagctggttagagctgcgtgctaatgacgtgttagaaatgtagatagtgaatagtgaaatagttgtcatttctcattgatctcaaggtccatttagtgtaatacatcaattctcattctaaatgtagcaataaggttgattcatttcctgtcaataatgtggtttgattgctttaaacatggttgttaaaaaggattcataaccatgatggttgcattgacaaggtcaaataatggccttttgtaaaaaccttaataaactcatgcctaagtagtacccctgtacatgtaatctttttatagaatacccaaagggattagaaagaaaattgactttgtgaggagaaggtttctttggcaagaaatcaggatttagaaagtaacacttgtccacttggttcaatggtgtgtggtttgctctcctaggtagtgtttggttgctgggatgggatgggatgggatgggatgaacccatttttaggggtgtttggttcaggggtagtgggataggttggtccctacagaggaatattcctctcagatccgggaccaatcggtccggccaaaactggcggacgaactcgtcctacctgggacgagcgacggcgtgaaaccgccgctttgctcgtgcgctcttcctcgggagacggcggcgggctcggcgacggcggcggtgggctcggcaacggcggcggtggggggctcggctaccgcggcggtagatggcttggtcgacggtggcggcggcggtaggctcgaccacggcggcggcggcgggctctaccacagccgcggcggggggctcggtggtggcggatccatt

SEQ ID NO: 9376 - DNA, 7131 bp, Oryza sativa
  unsure (1)..(7131): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatacttagatgcaataagatcttgacataaagggcagatttaacatgtcaataaaacacataaagcaaatgtagttaaatcaggtaagattggctaaaaccccgatgctaccctaatcggcaaccagaaggcaggctagagttgatattctaagcacgacttaatagatcaaactcaattgatgcagcattaagtatgaaaagaagaacaatatctagacaatcaagccgctagaagtttcatagagtggtagatatcttatataatctaaatcaacgtcgatgtctaacctaatcggttgtcctctactgaaagatgttagccgattgtaggttagatagcgatattgccagagattatgtaagatatatgataactcgacgaattacataaacaagattagagtgtcataaaaatggaagcactaatcccgagaacgcaagccgtcataacaagttttacctcttgttgaagatcgaaaccgatgcagctcaacccgaaagcaagaactcgtcgaaataaaactaaagaaaaagggtggcgatgcgccgagattgtatcgaacgtgtgtgttaaataattacaaggggttcggggtcaatttatacccgagaattacaaactatctccatatcggacacgactcttatctctaacaaactctaagatatcataagtctttgcggcagacatttgcccaaacatatctctaaggaaattacataaaatatcctaattaatagatacaattgccttctcaagactctacccacgtgtggcaatcatcttgaagcatatcaactcaacccgatgacgtacaccgagttgtattgacggattcaactcaatcggctaacctcgtccgactcgaactctgccgatcttagccgtagccgactcggacttcagccgattcttactctgttcccgaattgatctttgcctttgactccgcttcgatctaatcctcttttctgatggtgatattaccaaattcggtcgttaacaccacaaaaataaattttccatgcttccatgtgctttcttctcagaaaaaaagctccttttgaaaaaaaaagaaaggggagggaaaggcatggttatgaaatgaaaaaaaaataaataaagttatactccatcaagcatgagcatgatgttaaaagaaatttttgtagccatgcccacttccaataaaagaaggatttttgggagaaagaaagtaaatcaaaaaggagaagcattaagaaagtaaatcaaaaaggagaagcattttctttattttcttcatgcaccatttacaccatatatcacacactttatgcacgatcttgatcttgagtatgtttagttatctgctttagtctaagtttttgacttagtaataaatgtgaatgcaagtataccatgattgatccctaccgagcgccacatatcaaaaccttagagtaggaatcaacaaggcaacatttggtgaggaattcattttgatacacttagagagactgagtgaatcacttgaggaacttggttttgtttttcaaaatcatttgaaaacttccggaacaagagttgaataaagatcgggtgattggtgctttaattgctgttctgtctttcaaccgctcaaggcaaggagaagcagtgtctcgtgggaatcaggggtaagggtaagccaccgtgccaaaaattatttaatctaagagagagtacatataccttgcacctgtatctttgagatatgcagcatagtagcaactcctgatcaacaaccaagtcattgtttcctttcgtccttcactcgggacgagcaaaggttcaagcttgggggttttgttgacggtcattaacgatcagtttcgaccatcaatattactaaaacatgagagaactagtgatgcttgcaatgcataaatatgttagaataataatattccactagtattaggtctactaaccttttgcagagaatgacaataaagtgaaggagaatcgacatcaagtcagacgataaatcaatcggacgatgtcgagaaccagacttgtgtatgaatgggccaagaacgcagacttgacacgatgaatcaggccaaaattcacaagtctacgaagtgaagcagcagaggaggccgccagccaaagttgggctggattgggccagccccatgttcggacgaaccttgtggttcggccgaacctgcctcgcctccgttggatctaggttttggttgtacggtgtagatgaagcccctatgacggttggagggtattaccgaccattccaatcgtcacaaccgtcatagttcagctagaaaaggacttcaccttctcacttcacccacacacttcaagcaagagctctctcattcctctcaagtttagtttagtagtatctagctggtggaatagaattagaataggaagcaggagtctggaagccttcggaagagttcgggtacggctctagtagcttttctttcctcttttgtaagctttgtacttttattaaatactcttctatatacatttatggtattgaaatactttccgagtatatgagtaccaactttacattatgttcatgttatactaactgtacggctagcttatctgggagatgctttggtgcgggtatagtgtttgcatatgcaattactctatgtcatgacgatgatattagagtagtatctggtaagttagacgtggtgtctagattatgggatatcattatttggggttatatattgcggatgagaggtgggccgctgatggtgacagctcagtacgggtattcctccgcgcctatatataatcctaagttaatttcatggggcgggtattcctccgtatttagccctggttggatggtcatgacaggctgtcgtaaggaactcggcaatcaggggtggcttctcgaagtactaggagggcatcggatagagggtaagccaccgtgccaaagattatttaatctgagagagagtacatataccttgcacctgtatctttgagatatgcagcaaaatagcaactcctaatcaacaaccaagtctttgtttcctttcgtccttcactcgggacgagcaaaggttctagcttggggggttttgttgacggtcgttatcaatcagtttcgaccgtcaatattaccaaaatagaggagaactagtgatgcttgcaatgcatatatctgttagaataataaacttccactagtattaggtatactaaccatttgcagagaatgacaataaagtggaggagaatcgacatcaactcagacgataaatcaatcggacgatatcgagaaccagacttgtgtatgaaaagggccaagaactcataattgacatgatgaattgggccaaaattcacatgtctgtggagaagagaagtccaggaggccacagccaaattgtgggctggttgggccggccccaggttcggccgaacccatttctcgaccgttggatgaggggtttggtagggacgcgccagatctactccagatggcggttgcggggtacatcggaaaattccccttccacaaccatcataactacctatatataaggagctcactctcttcacttcaacacacacctcaagcaatagctctctcatttctctcaagtttagtttagtagtatctagctagtggaatagtaatagagtagaaatcaggagtccggaagccttcggaagagttcgggtatggctctagttgcttttctcttctcttttgtaagctttgtacttttattagaatactcttctatatacatttatggtattgaaatactttccgagtatatgagtaccaattttacattatgttcatgttatactgaatataccgctagcttatctgggagatgctttggtacgggtataatgtttgcttatgcaattactttatgtcatgaaaatgatattagagtagtatttggtagtttagacgtggtgtctagattaggggatattatttgggattacatattgcggatgagaggtgggccactgatggtgatataatcctaagttaatttcctggggagggtattcctccgtatttagccctggttgtatggtcatcacgggctgtcgtaaggaactcggcagtcaggggtggcttctcgaagtaccaagagggcatcggatagagggtattagctagtatatcagttaactagaatgtatgtatacgtatcatggttcaagaaggcgctaggcgctagttgggcggatagggggcgcctagcgcctaattggcgcctaggccccgcctaggcggcgcctagcgggcgcctaggtcgggtcaaatagttaaattcaagaaattagtaggcatattgcatagaaattagactatataacactaaaatagcaataaaacacaacctaagtaatttaaccgcctaatgcaccattgaatgcctaatcgcggcggctacccggcgcctagcgcctaatgggcgcctaggcggcgcctagggccgatttttagaacactgatacgtatattaaaagtataggaatatattatctttctcttttctttctacttagctcacataatatattacgagaatgagtagtaatgcttgtgtcactctacccttggattatcttaacctttgcttagaatatgattatcacaagtaatatataaattattagttgagttctctctacatgatctttccacgggataaaataaatacgatacccttggaatattctcaggtaaaatgctacaatggtatatccgtgtgcttgcggatgaactctgtaaccataatataccaggagtatttctgcgccattgctgggaattatatttctagtaatatcgttaagaaataccaacaaccatcatcttgagggcagcctcctcgcaagcatgatcaactatgcctgcacaagctgtcaccaccatgttgggtaggtaggagggaataccatggacctcacaacggacctggtgtgggaacttgctactgagaggacaaatcctggtgcactccagctctgctgggaaaccaaccacaaatgccatgcagacgagctcagcaacgaaaccttccatgtcctgaccatggtgcgtgttggggcggctggccatctatagaagacaaaggagagagaatcaatgcatgctcaaatccaaatataagcgaaacgataaaggactcaagtaaaacaaacaaataagagcaaaattttgtacatatattattttgcatgaacgaataaatataactgacataactgagcaataaagtaatgcggaaattagatacataataataatcacaacataaataaactttgcaaccaatacacctcagctaggacctaatgcattcctcccattaaatctcgactgactgtcaaataagtcccaaataattttactaaaacccttgactgacctctttaataaatttcaattgaacgagcgatcaagatttttcccataaaccgaaggaacgaatcccaattttcctgaaacaaatccaattgcacagaacaaatgcaataaaaaggattcggagggctcttaggtttccatttggcttgtcctacgatcaaggtcggctctaagaccagcttgtcatgcccagaaattcccgaatagaactccaagcagaatgtgcattaaaacccattcccaggaccggccagggtacacaaacgacaatattgacatacagatccacgtcttacaaacattataaaagtcttacataaatgcagtggaaaagaaaaggtaaaataaaactaattcttgtcttggatagtgagcggcgctattccacaagcatcctcgacggcacggaccaagcctactcctctgagtagccaccatcaaaagcgtactcgaactctagggttgggagatagagcaagactgagtactacccactgtactcagcaagtcataccggaatagagggtatgatacaggatataaccaaggatagctaaaggggttcatttgcataaagctagcatttaagaataatagttgaaagcagtaaaacagttgtagttaattaatcaatattaaatcatcactgctcaacgctacaccacgttgagacaaacccaaaccaccacctgaactaaccagttcattaagccaatttattaagtgggattaatcacagtgaatctggtcaaccgcccataaccgtgggcacggctattcgaatagttctactctgatcagaggtgtacaatggtacacacaagatagccccacgacacgttttcgtgcgccgacatgccaccacggcatatcggaaagaggccgtgacaggaccattcgcataatcccctctaaccaatcgcaccgcaccctagcaggcaacgggcagcttcttcttgtgccacggtgaatccggaagctgcatagacgtcgcatggcccatccaaactccatcacgctcaccctagcctgggtacgtcagctagaggaaagctacactacaatctcagccgttgccaacgctggcttgtggtaagtacactaaattcttccagggtttcccgcgaaacggtccttaacctccatgggtgcgactagcaaaaccatgcacccacagcccaccatttagtgtattttagttgattaacaccatcatggtggtacatgtccaaagttatgctaaaccaatgtctaagcatttagcgagaatcccccattgtgtgctagttcgactaagcaaggctaagcaagtcctaatccaacatctaatcatattacaacccaagatagcggggtgcaggaa

SEQ ID NO: 9377 - DNA, 11912 bp, Oryza sativa
ccgtgtttatataggggcggggagctcggacgtggccgggaggagcacgaaatggccggcgaagtgggggaggtgtgagaggagagagaggcgggattcagatttcgaatcccgggcatctcgtgggcgcgggcgagtggggaagggggtagtggggcgcgggggaaggcggggcatgctcgttcgttggcgacgtggctcgggaggggcgaagaaggtgggagaggcggttgcagcatgggcgtcgacggcgtccggaggttgtgggaggacctgacaagtgggccctacctgttggtgaccccgggagagaaaggagggggcacgtgggctgcgggcttggcctcgggccagcccagcaaggcgcgcgggcggaggggaaatgggctgacggcccaacaaggggaaaaaagagagaaaaaggggaaaaagagagaaaggatttccaggggattatttaatgcttgtgcttaattttaattgattaaaattatctccaaggctctgaaaattccactaaaatttttgttagtatattttgacatgtagaactcaagaaaaatttcacatgccattttacggtttctctcttgacttaaaaattttcttgagatgatttattaattttaatttctgcttaggaagaacttcaggttgtggcatgctgtaactcccgtaatctgaaactccctcctctaactcctcctttcgtgatcgtgatcgctgtaactcctctaactcctcctttatgtcccgtactctgtaacgtaattgctgtaactctgactccccctcttggctactcccacgtaagcgctgtaactcctctaactcctcctctcggtgtcgcgcctgctttaactcctcctctagcttactcgctaacactggtggagaaaccatcttttatcggtcagccaaattccacaataatcctggttctaataaaaactgggactaaaaagcatctttagtcccggtttaaaagttgaggggtacttattaccaaccgggactaaagatcatttttagtcccggttcaagaagttgaggggttcaagacagaccccgattatttttactaccggttggtataaacaaccgggactaaaaacagatctttagtcccggttgtttatatcaaccgggagtaaagagtaccccgaaccgcgcgccagatattatccgtgcgccacaaaaataattgtttataccaattgtttttacttccggttggtataaacaaccgggactaaagatatctcccccttcatccccttcctctcccctttcccctcccgtacctccccttcctctccccttcccccttcatcccgggcgggctggcgcggcggccagctggccgggcgggcgcggcgggcgcggcgctcgggcaggctggcgtggcggccggccggccgagctcgcgcggaggccgcaaggacggtggccgggaggccggcggcgccctcctctctgctgctgattttttttgaatttttgattcattggatttgatctgtgatttatgtgatattagatctgatgtgggagttgtgatgtatttcttttaggatttgtgatgtattttttgtttgagattttgtgatgtgatgtattgtgatctgtgatgcatttctttccaatatgtgatgtatttctttccagatctgtgatgctactttgatttggggatgatttgggaatatgatcggggatatttagggagcagatcgatttgagaaaaaaaaataaccggaactgctcctgatggatttttagtcccggttattttacccgggagcgtaactcctctgactctttcaataggtgtgtctgcgcaattcccgttccagttgctcatccacttgctgcagtagaagcaagcgccctcgttcccgttccagttgctcatgctccacttgcagctcctctattgtctggcgttttccctgacgcccgcgttccagttgctgcacgatttcctgatcctgctgcggcacatccactccaagcttcaatcgtaacttccgaagactttctcgcccctccttgatctccttctgtaggcgcccacgttccacttcttccttctttttctcttcttctatttgacgcaggtccatgcgcagaggcgacgcccggtaaacgcggacgccctgcctgcgcatgctatcatagaacctctcgggattccagacggcgacgtaaacgccgatggcgtccgtgaagttgccactccggccgcagaagccgacgatggaccccgagtgctccatggagacctcgaaccgcgtccatccagctctgtcttctccaagattgccgtatggtccgaacgtcctgttccggttgctcctgaactgcaaccaccggatgaggtggttgtcatggtagccgcacatgtgcgtcaacacctccccatggaagtcgagctcctcctgtgtgcgtccatgcatcaggttatttgtcagtcagtgattaattagtacaaagcatctctctgcaagctgtttgttttaacggaaaggctatatggctgttgacagaaaaaggatggatggatcattcgttttttgggccatccattcatctttgagattagtgctgattatgttcgggctttgatagacatgcagtttttagtcctttgactgaccttcgtgggacccacattaactattgaattttgaaattcgcgcctgcattatctctgtttgagagagagaaacgtagagatttttctatccctgagacagaaatcgagaggggaggacacaagagaacagatttttgatatttgacttgttctttcggatattgcactacgattcgtcctagaacagtgcgagatgaggatgagggcccgtgtttcgacatgcctcgtggtatcgtggtagtcaacgtgactcgatctccgtgcgaaatttctgattttgcgcgacgtgactcgatctctgttcaaaattttcgatttttcacgctgtgtctatagagtggtttttttttctattgtatttaacgttttcttagccgtaggattatgcgctaagattagtgcagaaaattacagtgctatataactaaaattacattcgtaaattcagttgatacgatatgtaagtgcactgtaattttgataaaaatactgtgtaaataaatatgtatttattatttcctttaaaatataaaattacaattctatagacctaatattacatttgtaagttaagttgatatgacatgtaagtgtattgtaatttcactatagttatactgtaattacaatgtaactataatagaattacactgtaacttttagtgtaattgcagtgtaactatagtgaaatttatcttctatgcattagcatatacctaattgagtatatgtctatgggtaattcaatatggaagtttgctagttttatggatatgggcattttagtagatctgaaagtttgttcttggatatttgacatgtttttgtttagcttatttgagctttaaattgtgcttcctgttttttttctcgctatatttttgggccagtgattgctcctctaggtttatttgggcatgtgatttattagatattgaatttgggctttagaatcagtttgttgtactttctggtttgggctcaagaaatttgggccttcgtatgggcatgtgtttgggctcaggaaaaaaaattgggcctccaataaaatcatatatgaaatttgctcttttattttttcagtttgttttttatgtcaaatatttccagcggttagatctttatcctaaggctataaaatctgcatgatttgagcataaaaattctgtcaaataattttctcccaaattaaaccgttcaatcgacgactgagtatttgtctgtgtttttacataattaaaacagtggaaaaattaatacaactccacgattaaagaagagtccctactgattctataatacaactagttgataagttctattagatcatgattaaatgaactagtcaccggctcaccgctcatgaaaacctttatgagattgtcagaagcaagaagcagaggccttgggctttaataaattggtcatgatctgtgcccatcgtcgttaccaggagttgttttacgatacacggtacaagtgacaaggggcactggtgtgagtaaattctaaccattcatttgcgtgggcatttctttaaatggtatattaattgtaaaatttacccacctttccaccgaaggtaattaagtcaatagtttctttctctacagctacagtactgaacccttagcgcatcattactgcaaaagcctcataggtgtgagttcatttaaaaccggcacatataaacctttccctaaatccacaggatgaaaaaggatacaaaaacgtcacctttgggtaactatatatgctggttgtagaggaaaatcaacacaaatactataggtgtcggttttttttagaaaaacttgtacctataatttataggtactggttaagtaaaagccacccggagcgggcgacgaataggacgatgtcggatgttggtggcgacggtggctaggtttgcggttcgatgacggcagcgacgacaacaacctccagcatgctcgatgttgacacgagggtggcactggcagcggaggggtgaaggcggatcaggtgggagtggaggatgcgcagcgatgggcatctaatctggtggaggctggcctttagtgagcccgttccggttttggccagccttgagcttcttggatccggtggctgtgggttgcggctcagaaaggcaggaccacgatgtagtcagatggatctagcccgccgtactcttcatcttctgcgggagaccttgatcgtctgggagaccaccgagcggtgtcgagccttggggcatgccggatctggcggttgtgggttgggtggatgtagaaggtagagggagaggaaaaagagataagacgagaaacaaaagagcaaaagattattattttaagggtttgagagaaacgaggttacgagagctggggtgttttttaatctcattggagcatgatttgatcactaacgctaaacaaatttagccatattccattttagcaatgtgattttggaatttattttagtcatcttatactgcttctagattttgatataatcattagatttgagcttagttttttttttagattacgtagtgaactctagtttatacctatgatgcagttctatggttagtttttaatctatctagattttactgaactcctggttcagactaaaatttttttagatcccattcatctgttgtttttcgtatttattgattaaaattaaatatgtatataacttatgttgaaagttatacatcaagcggatttgaataggtgatgttctaatgattttcagttgtagtggtttgctgatttcactgttcacgcattgtagcatcgcgtgattgtcgacggtgttgtgaatttaagtattgtgtttggtcttcttttttttattagggtggttaatttagggctgtcatagcattataacagattaacagtactagaatgattatttgttttatttctgccgcttgtttgtttttgttgtatacattgaaattaaaattaagcgataaccattcacccccttctgatcaaggcaacctcgctacaagtgccatgcgtacatcaagccgctcctccaaagagtagtccaaagagtagagtatatatagaattttgaatccaggatgctataatcgatttttaattgtcaacaaaaagtatttagattttgggtagacatggcagtaataaatataagtttctaataagatagagtagatcctataaggagtggagaaattgttttcacttggaaaatcacttcctaagaacaaatctatcaagtattgcttgctacatacctcgggtattccattgcctccctctccttgcagggtacctttcacacgtttgccattgtcgtcgtattcaaacaacattgagctgacacaccaggaagaccctatactcattcggcgtacaccggtgtaaccgccagcactggcaccatggcctccctcatcccaagcatggcctccagttccaccccacggccctatcttcacacgctgaagtgtcaagaccattaatacacctatcactggtggagaaaccctttgtagtcccggttcgtaacccccctttagtcccggtttccaaaccgggagtaccaatccgggactaaagatcgctatctttagtcccgggtgaaataaccgggactaaagatagagctgacctttttttttttgcatgcccctgttgctgcatggtttatatatatatatatatatatatatatatatatataaaccatgcatatatatgtttcaatacatatatatgcatacatatatatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgtaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaaagggagtatattattttctatggtctacttatatacaaggacctaattaattaaaggagacgtatagtaagaaatctaactgaacgatatacttacaaaatccagcaactcataatacagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggagtcgatgctggagcctgaggtggagacggtgctggcggagcacgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcactgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagtttttgaaaggaatatgcagctcacatggtgtccgctgagtgatgtcatcaacgggacaggtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggccatgcgttcatcaaccttccttgcaacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcctccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgccttcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaattcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaatactaaaatagtcatgtatatgctaagtgtttcgtgcgtatatgctaagtctaattaagactacaatagtcaattgctacttgtcacaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattcctaggagtcgcaccaattccgtagtcaataatgtcatactaagtctaatttgcaataaaataatcttatattaaaactcaaataatattagaacactacacaatcttatatgataagtctaattacaggtctaataatcttaattacattgcattacaaatataacaatcatttatattattacgtcacttgcctgctccaattccttctagggctagctcttccactcaggcttgacggacgactccgacaacacgtcttttctgcaagataaaaaaatgtattaggataaatgcgaagtaacatatatatatatatatatatatatatacatgtatatatatatacatgtatatatatatatatattgcatttcacgttaacgttcgtcctcgttcgttcgctcgttcacgttccctagctcgttcacgttcgttcgatcgttctcgttctcgttcacgttgtcgcggcaacgtacgttgacgtgttcgttctcgctctcgttcgttcgatcgttctcgttctcgttcgttaacggcggtgtggcggcatcggggcggcggttggcgcggcggcgtggcgacggcggcggcggcgtggcgttgtggggccgtggcggcggcggcgtggcgtggcggcggtggcgtggcgtggcgtggcggcggcggcgtggcgtggcggcggcggcgtggcgttgtggggccgtggcggcggcggcgtggcgtggcggcggtggcgtggcgtggcgtggcatggcgacggcggcgtggcgtggcggcggcggcattgcgcgcgcggcggcgaaggcggcggcggcgtggcgacggcggcggcggcgtggcgttggcatgcggcggcggcgttgcgcggcgtcaaaggcggcggcgtcgaaggcgacggagagagatcgagatcggagagatcgagatgcatgaagggagatgcggcggctctcaccccagagatgcggcggcagcggaggaggcggaggcggcggcgaggaccacgagctcgagacgacggcgagatacggcggcgtcggcgcgggcatttgccctaggcagtggcggcgaaggagagaggccgagagagatcgatcggccgagaacgtttaagtgttggttaagaag

SEQ ID NO: 9378 - DNA, 3464 bp, Oryza sativa
gcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattttgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttatgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattctcaatatggtaactcccaaaatatagagttctttttccacatcgccgcgtgacaatcttcgctctctatatgctggcttccaggcccctttccgaacactactttaagatctttaaccatagcaaacactgttttcccgctgcgatgtttaggattcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcaccttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatatcacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagccccggttggtgctaccaaccgggactaaagtcccacccctatatatatgtcggcttccccctccagctgcccgagcaagcttcacaatttcctcattaaaagaggggaggtcatgccataatttctattgaatttattttggtgattacatacaagt

SEQ ID NO: 9379 - DNA, 2617 bp, Oryza sativa
ccattatttaacccttttccttatcatcacgattgaccccaatttttggctctaccaacggattgtagtttacttcaactaacatgtgatcagacaccactattttgacagtcttacatagttttggggaagtgctcgagccaagtgataaacatccaaaaaagccaagtgatctccaccattttttttcgataaaagatcatatattagcccggcttttgaaagaaagcccaaaccaaacagagtattccagggtatcaaatataaggaacgtgcatatactttttatgaacaggattctatcaaaggacaacatgacgagtgataggctagagaggattcctatggacgtatttagctgacttaagttaaaggcaaaactttatcgaatacatcaggaaccagccctcccttagtctgtcaggttgagtccggccttgagctttatgatgtacccgaatatagaggcatacaaaggacgggcagggttatcaccacctgtcgtctaccctactttctgtgtagcacacaacaaatgaagataacctctaacctaaacaccacacctacgttatcgattactactctagcctcggccaagaactatcttgtttatccagagtcttagtactaaagcattaagtataaatactaagcgacgaatccgcaccgatgagaatatatctcacttaaataaactaattaaataccataaggaaacttgaatacttactttttaaaagaagtatccaccgaggtaaagcgagagaagaaagccggcaactcatgcgcttctccggcactctgatggaagaattctcggagaaaactccgatatttgggacacaccttccggagctttccttcactctcttcctaatcccacatactaaagtagctaccatgatatgaaagtgagttgtactctactttgttgtgcaatttgagagtgcaaataccttttcgttttatagctcataattacaatgctttacatcggtgatagctgccgatgaaaccttcataaccaccattggggagtcatcaagagcatacacgtggaagcagatggtgagaggagccaaggtccgttcgagcgaccttatagttcggccgaccttttggcccacctctcggcctctccttcggcagtgaggttgcctggtggccccccctacatgttataccttggttaggctcaattgtaggtagttttgattgacatgtgaggcttccaatccatgtaatcatgtctgattgtccggaggttccttctatcgcttggtgggtgtgttttctaccgaaaatcacatgcatacatatatttaccaaagctagtggaaatggttagttataaacccctaccacaaagttttgaaattatattttatttcttttatgcaggagttgatggtaaaagtttgcacttaacgaccggcaacactatggctcggtgaataatcatacacattgagtgattcaagagaatcaattgaggagtaaagttatgtttttatgagcaaaacgaaaaaacccatgacactcatcaggagaagtggaggtaacttgaatcatggtcgttccattcgtcaatcacccaagatgacatggtagacaatttaagattcacaagtacaggtatgacttgaaataattattataccagtatcattacaaagggattcattgctcttgaaagtgcatctaggcccctaataattttggtgattaattacaatgcgattagagaggactaacatttttatttaagcaaatgtgaaggttgttatgtcctcgatgagttagcgtaatgcatatcccgccaaatacgttgaagtgatgtgttgcggcaaatgagcaaatagtattatgtatccttttctttttgcttgagtcaataggaaagccgcattaagagggatgatgcattgacatatgaggagtgatcaaagtgctcaaaatcaatttttaaaagtgtttctcctcagttttagagttctggagtttttcggagttttccgaaagtcatttttggactttccaaaaatgattgcgaatgcaaaaatggttatgtgtattttcggacttgtccgaaagtgattttcagacttttccgaaaacatccagaacgatgttttggctatgagtactttcggacttgtctgaaagtgattttcggacttttccgaaaacatccagaacgatgtttttggctctgagtattttcggacttgtccgaaagtgattttcggacttttccgaaagtgattctagaacgatgtttttggttctggatatttttggacttatccgaaaaaatttcggaatgtccgaaaattctctcgttgactttgctgttggtgctgaactggaatttttggacatgtccgaaaatctttcaaaatatccgaaaatcacaattattgtgtataacaggcagaatttaggctgtggctataaatagccccctcccctcacttgtgagggctgctggtcacattggatatttttgtgcccttggcttgctcttgttgagattcacttttgagccttgctttcttgtttcccctctcacccatgttcgattcggatttggtgtgtgtgtgagagttgtgga

SEQ ID NO: 9380 - DNA, 16194 bp, Oryza sativa
cttgttgtaggcaaatagatctaggatttactttgctatttatgctgactccgaaaattttcggatatatccgaaaatttcggaaatatctgaaaattattgcttccgcttttaattgaattttttgaattagcctattcaccccccctataggccttattgacactttcaattggtatcagagcctaatctcctaattcggcttaaccgcttggagagatcatgtcgggccaagtgggggatgggaataatggtgataagggagctaagattccttatgactatccccctacatctacatcttatgtgagtacatttagcggcaaagcttcatacttcaatggtacggactatgtcgcttggaagcataagatgaagatgcatttgaagtctattaatccatctatttggagaatagtcgaaaaaggctatgttttgcagaatcccgaagatcccaccaaggaggacgacgagaacgagcacaagaacgctcaagccgctaatgcaatacttagcgccttgagtgaaagtgagttcaactgtgtggatggcattgagagtgccaaagtgatttgggacacgcttcagaacttgcatgaaggcacgaatagtgttcgtgagtccaaggtggagatcctcaaggggcaatttgagaggtttgtgatgttggatggtgagagcccaagcgacatgtatgatcggttgagcaagatcgtcaatgagatcaagggacttggctccaaggacatgaccgatgaggttgtggtcaagaagatggttcgagcaatcactccaaggaactctaccttggtgaccatcattcgtgagcgtccggactacaagactctcacacctcatgatttgcttgggcatatccttgcccatgacatgctcgtgcaagagtccaaggatgtcatccaatacatcaaccaaagctcaaccacaagcatcaagaaggaagacttggcattgaaggcgaagaaagaagaagaagagaaccgcaagagcaagagcaaggcagagatcgatgatgaagagatggctctcttcgtcaagaagttcagcaagttcatgaggcgaagcggcttcttcaagggaggttcttccaaccactactccaacaagtcaagtggaagacactccacaagagtgtgctacgtgtgcaaagagcccgggcactttattacggattgcccccacctcaaggatggttcccacatcaaggaagataagaagaagggtgagaagaaggatgagaagaaggagaagcacaagcatagcaagcgggaacattatggccaagctcaccttgggatgatattcggctccgactccaagttaagctcaagtgatgaagaaggagctgccacgttcaccgtcaagccttcatcaccaccgagactcttcgaccactcaagtgatgaggatgctcccatttgcctcatggcaaaggaatctaaggtaccttctcctcacaagtcatttaatgttgatcttgttagtgatgaggaggatgaggttctggatgacgaattgtttaagtccataactaaggaatccctaccacacttgagtgagttacttggaagaattgaggaccaatatgcaactcttgagaggcaagaggctttgctcattcgtgagaaagagcggtcttatgaactcaagaatgagctttctaaggagagagaaaaatgaggcttaggtacggttttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgagccatcttgttccaaaattgtcccaagtaatgaaccatgtgtgagatgcaaagatattgatattgaagcttgtgctactaactctatttctttgagtgctttgcaaaagcaaaatgagaagcttatgggactccttcacaatggcctacttaagtgccatataggtagtaaggccctaaaggagtacctaggctatcaaagggacaacttcaaccatcagggtcttgggtatgttcctccactaaaaggaaaggtggacaagagtgtgatgatcaataggccccaaggtcttagcaattttgttaaggccaaaagtatccttcctaatgattatacttcacattgttcttttgatgcatcttatgttcttaggaagaatgctagtggtcgtgttgttgctaagtatgtaggcccaaggggcaagaatatttctatcaagagagtactttgggtgcctaacgcacttgttactaacatgggaggacccaagcaagtatgggtacctaaaactagaaattgatctcttgtaggaatatgtctccggtggaagaagttgggtgattgatagtggatgcaccaatcacatgaccggagaagaatcaatgttttcaactcttgatctgtcacgccctaaaaatcctaagtatataaattgttgtttaattggaattattagaatttattttaaaagcctacaagttaaactctaataatctaggaaaattttcaacataaaaatggtctagataaaattttattaaatactttgcttgttcctctattttctagatttttctaggaattatttgagcaagggaagtatttttaataaatgaaacaacatttcacaaattattttttaattgaaaaagttgaaaaatcctcccctaagtcgttgggccgatttcggcccaactcttctcttccccgcgcggccgaaccggcccaagccggcccagccgacgccgcccgcccctcctcctcgggtcaccgacatgtggggccccggacccatcttcctcctccagccggccggttgccaggccgagccgtccgagccgccgtttgcgccgtcgattccccacatcctcctctatctttccccctaaaaatcggagcaaaccgttgagtattctctccgaatcgaactcgttttcgagtttatctccaaaaccgagtttcgtttttcccgagtcgatttcttgcgggaggagtccgatctcttcaatccaaggctataaataggaccccctagtcctcctctttcgtttgccctctctcccatcctctcccgtgctccgtagcgccgccgccgcgcgtgtcaagccgccccgccgccggtcgaagtccagccgcgccgccgcgccgtttgcgccgtcgccgccgcttgccgccgccgccattgggtgcgccgtggtgagaggaagctcggccacccttcctttttcgtcgccggtcaccggagctctgccgccccatacaagccaagccgccgccgttgcctcttcgtcgccggccgtcgttgttcgtcgtttggctcgagggtgagtaccgttgggttcgtctcgtcgtcctctacgtgtacttgtcctccaaattcgcagccgatcatccaatctccggcgagcttgccatccgagccggccgccattgatgacgtcatcgtgacatcaccatcttttcttttttcccgtttttctaatagattaaatcttcggaaaatcataactaaataaccgtaactccgattcgagtggttcaagttgctaaatttttctaaaatcaggatctacatgttaaaaatatccacatgtactgtttatgcttgtttttgtactgttttgttaatttttgtttaattgctttagtttccgacgttccggaggagagcgtttccgttgaggaagattccgaagcgtttgcggaagcccaaggcaagtcacacagatcccaaacaaacctttgagtatgttgaacccatttaaagctattattttatttcaactatgcattgttttcgaatgtcatcgggtggtgaacctttcccaattaattaatggccgaagatgatcttattttcctatgggttataaatttgattagcatgaaccttatatgttggattggttcagctaaatgctatatgtaagtctgcttagccatgcttagaaacattagctaactaaagggattaattataaactatgttacattattattttatttatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcatgattcattatagtgcgccagactgtgaagtggcgagaagtccacgggggtcgctggggagtccatgccttgtttataagggggtgattatgatccaggaaaggtgcgctgtaaaggattatgttgtgcaaggggtattgtcacaactcctttccgaggtatcgtggtggtactaaggcgcatggtaacatgttgtgggattgtgacttgtgggtacagtggtacacctctgatcagagtttaatctattcgaatagccgtacccgcggttatgggtgagttgagcaatgtttttcgtgattagtcccatattattcattaatggtaattgtgataattaatttgactcctggtttggaatggtacgttcctggtatggaggttagatttgtacaaccggggttggttgttcatatgaggttgggcctatgcaacatgggtgtgttgtatggtgttatttaatattgattaattattcaactgtttttaccattcccttaaatatttattaaatgttgtttctgcaaatgagctatattatgccatcctttgttatcctgtgcacttgcatatttgctgtgtgacttgttgagtatgtcatatgctcatttttgcaataatcattcatcagaagaggagtatctcagtgaaggtgatgatctggaggattaggcttgttcctggttaagatgcctgtggagtggagtcgccatagctgttccgtagtttgttatagtttttttttccgctgcgtagaaggtttttctttgagaggaactatctacctctgtagtaattatttatttgcgaatatcaaatagatatttatttgtactctattatcaatttgttattgtgtgcctcggttgattcctggacgagggtttaacacacatgtaagcgtttggaattttggatagaaattccgggcatgacatgatccaaatggcacttcacaagataacatggtcttcggggacgatggaaagggaaaggttatgggattgggtaagattgcaatctctaatgatctttccattgccaacgttctcttgttaaatctctaaactacaatctcttgtctatttctgaattatgttctatgggttacaattgtccttttaccgatgttgatgtgaccgtctatagaaggaatgattcatcggtagtctttaagggtgttctcaagggaaagctttaccttgtggatttttcctcaagtaaagccaaacatgagacatgcttagtggctaagtccaacacggggtggctttcgcatcggaggctagcccatgttggtatgaggaatcttcacaagattctaaagtacgatcacatccttggactaacaaatgtttaattcgagaaagatagggtgtgtagcgcgtgtcaagccggcaaacaaattggagcacatcaccccgtcaagaatgtgatgaccactacaagaccattggagcttctccacatggacctcttcaggccaattgcttatctaagcattggaggtaacaaatatggtcttgttattgttgatgacttttcacgcttcacatgggtgttctttttgcatgacaagagtgagacacaagccatcttcaagaagtttgcaagaatagtacaaaacgagttcgacctcaagatcaagatcattcgaagcgacaacggcaaggagttcaagaacacgtgcatcgagagtttccttgatgaagaaggcatcaagcacgagttctcggctccatatttacctcaacaaaatggagtaaccgagagaaagaataggactctcattgagatggcgaggaccatgttggatgagtacaagacatcggaccgtttttgggccgaagccgtcaacaccgcatgccacgccatcaaccgcctttatcttcactaccatcttaagaggactccctatgagcttcttaccggtaacaaaccaaatgtctcttactttcatgttttcggtagtaagtgttacattcttaataagaaggctagatcctctaacttcgctcctcaagtggatgagggattcttgtttgggtatgggtcaaatgaatgcgcataccgcgttttcaacaaaacctccggtattgttgagatcgcgcgtgatgtgacatttgacgaaactaatggctctcaagtagagcaaattgactcacatgtgttaggtgaagaggaggacccgagtgaagcaatcaaaaggttggctcttggggacgtacgtcctagggagccacaacaaggagcctcttcctcaacacaagtggagccacctacatcaacccaagccgacgatccctctacctaaagcttggatcaaggtgaagaaggcgagcaagtgctaccctcctcgcccaagaatccaccaaagtatccaaagagatcatcccaccgacaacatcttaggagacatcaacaagggagtgtccactcgttctcatattgcaaatttttgtgagcattactcgtttgtgtcttctcttgaacctctaagggtggaagaagctcttaatgatctagattaggtgatgccgatgcaagaggagttcaacaatttcacccggaatgaagtgtggactttggtgtagcgacctcggcaaaatatgattggcacaaagtggatcttccgcaacaagcaagatgaggccaggctcgtaataaggaacaaggcgaggttagtggcgcaagggttcacccaaatcgaaggattagattttggtgaaactattgcgccggtagctagacttgagtcgattcgcatattgcttgcttttgctactaacctcaattttaagctatatcaaatggatgtcaaaagcgccttcctcaacgagcctatccatgagttggtatacatggagcaaccactgggcttagaggatccgaagtatcccaaccacgtgtacaagctccacaaggcactctacgggcttaagcaaacccctagagcttggtatgtcttcgcaattttcttgtgaaaaacggctttgaaatcgggaaagccgattcaactctttttactaaaagacatgataatgatatttttgtttgccaaatatatgtcgatgacattatatttggttctactaacaagtcttttagtgaagagtttagtaggatgatgaccaaacgttttgagatgtccatgatgggtgaattgaagctcttcctcggccttcaaattaagcaactcaaggaaggaactttcatttgccaaacaaagtatttgaaggacatgctcaagaagtttgggatggagaatgccaagccaatccagactcccatgccatcaaatggccacctcgacctcaatgagcaaggtaaagatgtcgatcaaaaggtatatcgttccatcgttggctcacttctttacctttgtgcatctaggcccaatattatgcttagtgtgtgcatgtgtgcaagatttcaagccgctccgaaggactatcaccttgtggccatgaagagaattcttagatatttagtgcacactcctaaccttggtctttggtatcctaagggagcgaggtttgatctcattggctatgccgatgcggattatgccggatgcaaagtggataggaaaagcacatcgggtacttgccaattcttgggtaggtcccttgtttcttgttcttccaagaagcaaaactctgtcgccctatccaccgccgaagcggaatatgtttcggcggggagttgttgtgctcaacttctttggatgaagcaaaccctgagagactatgacctcaatgtatctacaatcccactcctatgtgacaatgagtgcgccactaagatagccaacaaccccgtccaacactcccgaaccaaacatatcgatattcgccaccatttcttgagagatcattccacaagagacgacatagacatccaatatgtaagaaccgacaaacaattggcggatatctttaccaagcctctagatgaagctaggttttatgagttgaggagtgaactaaatattttggattctcggaatgtggcttgatctattgcatgcatgtttgcttggtagaataggtttgcataccactttgtgacaaaatggtcattcaactcatggatggacactagtcacttttgtggagaacttgaatctatgtgtatggggatcttatttttcaatgaattttggtcctagcacaacttgaaatagattcacacattccctctctcgagggtgaattatcttgtatcatggtaattccctctcttttgatccctcggatcgtccatttgacttgtggctattgttttgtgtgattgattgtgtgctagtcacaagttcaaatggagcctctagtgctcgaccatccctcctttcctaaatactatcaaaaacctttgagaaatgtgtttttgtcaaaaatttcccggtgcttgtcccttgcaaaatccatttcaaatgtttgcaaaatagtttcatcaaaattcctagcgaaatccccttgcaaaactgtgttttccaggaattttcggactttccggaaaatttttggacttcccgaaaaattttcggatatatccgaaaaacattagaaccgtgcgcaacccttctggatccgttcggacttatccgaaaattttcggaaatgcccgaaaatttcggggtctttatatatcaccccgtggactcccttctctctcctttccactttttttccccacgggattgactccctcctctctccccaccggcgaccacctcctctccggcgacttcctgcggctcccctcctctctatcctcgtgggagcgcgcttgggggacttcttggggcttgcattgtcgatcttcaccgcgttcttcaagtgttcttcgcgttcttgaggtattcgccctaaaatcaaatcctttgattcctcaagttttatcttgcgattccctttggtggagatgttcccctagtgccctagaacctgcggattcaatctcacaagtttttgttggcggatttgtgcggcatctgagttatagggttcggcaggattcttttcggacttttccgaaaattttcggatatgtccgaaaatccctggccgacccctatcacttcagttttgcacgattcttaccttcacttacttgtttcttgcctttttggcttccattcactggtcccttgtatctcgcttgtttgaaggatgcctcccagcaagcaaacctcccacaagtccaagcgcccgagggatcgctctcccactccatcctctcatgatgattcggacagtgattggtctggtggagaggatgcggttcctcaggttgccctggtggctcggggtggcaacctccctcctcggcgatctactcaagctcttggtgctggtggtggtggtgaggactcctctcgtcaactgcaaacgccgccgcatcaacccaatgtccccattggtcctctccgcattcatacccccgagagggatccagcggtgattcgccaagtgtatgattggaggcggaagactgaggttgttgctccctggtgggatgaggatccgcgccctcttcaccactccgccacgaatccgcggttttggactctctttcaacaagacttttatgagtcagtgatcaagtccaaagctcatcccaccgttcccatgcaatggatcaactgggaggagttgcaggcgcataatgatccggtgctaaactctgtgattgcaaattgtgagcgcatggggattcgctctttcatgactttgcagcaggattggtgcaacgaagtcatcgctcaattctatgccaccgttttctttgatccacaccgtgccatgcattggatgacccaaggatcttggtattctgtctcctatcctcctttggctgagatttggggtttcgacttgcatgacttactcaaccttcctgatctgcataatctacccattcctaccaacactgatctcctccctctttacattccaaatgatcctaatgtggtgttgggtaaggtcgacggtctcaaaccgtactttgcctacttgaaccggatgtttcgccggtcctttgtgccaaaggatggtgatgctagcagcattaaccgcctctccaggactgtgcttctcaggttcgatccccctcctcatcgctttcatccttatcactttgtgtgggaagaaaaccgcatggcttccattcagtacaggaaggggttggtctatgctcctcacattatgcggatgatcgagtctgtcactcagcttcagtttcgccatgatgtgtctcattcctagcttcacttgtgccttgttaaggcgccccgctcctcagccgctcgggacatcccctcctcttccactcagccgcctcctgctcctgagcgcccttcctctgtggctcgtcgtgagccgtctcctttattccgcattttgcagagtctttttggtctttgctccgcggaggccaaaaagaactgccgattgcggaattcaacgaagaaaacggctcgcgacgtcaaattcctcaaggcaaggtattatgaggatcatcacatcgatatccctccttctcctccgggtttcgaggccgagcccgatgagctagaggaggaagagattgaggatccatttgctgggtcgcctcctgacttcgacttctttgtttatgcccatggctatggctatcctcctccaccacctccagaggatcctcctcaggccccccttcgcttgagtcgtcgtctcatcgtcctctctttttggtgtcttgatgccaaagggagagattatctatcatgtctttagggtcgagcacatttggcttttatttgtatgagactatgtgtgatttctaagttaagtttaatgctttgtaagactttattgtttaattatggatgcttgagatgtaatggatcttattatgtttaatgtggtgcaatgccttatcctctttatatggtgtgtgtgatgagatgtaattattcttatgcatgtgatgtgttggatgtgatgagcaaatgtgatatatttgttgtcttgtgagcttcaatgtggatgcaaagatttagggggagctctctacttgcttttatgcacactcttaggaggagctttcactaaacctttgcaccaaaaccttaaattatactcattctctcttgtgttctaatcgtattgtcatcaatcaccaaaaagggggagattgaaagtgcatctaggcccctaatgattttggtgattaattacaatgcgattagagaggactaacatttttatttaagcaaatgtgaagcttgttatgtccttaatgagttagcgtaatgcatatcccgccaaatacgttgaagtgatgtgttgcggcaaatgagcaaatggtattttgtacccttttctttttgcttgagtcaataggaaagccgcactattaagagggatgatgcattgacaaatgagcagtgatcaaagtgctcaaaatcaatttttaaaagtgtttctcctcagttatagagttctggagtttttcggagttttccgaaagtcattttcggactttccgaaaatgactatgaaggcaaaaatgtttctgtgtattttcggacttgtccgaaagtgattttcggacttttccgaaaacatccagaatgatgttttggctatgagtattttcggatttgtccgaaagtgattttcggacttttctgaaaacatccagaacgatgtttttggctctgagtattttcggacttgttcgaaagtgattttcggacttttccgaaagtgattctagaacgatgtttttggttctggatatttttggacttatccgaaaaattttcggaatgtccgaaaattctctcgttgactttgctgttggtgctgaactggaatttttggacatgtccgaaaatctttcaaaatatccgaaaatcacaattattgtgtataacaggcagaatttgggctttggctataaatagccccctcccctcacttgtgagggctgctggtcacattggatatttttgtgcccttggcttgctcttgttgagattcacttttgagccttgctttcttgtttcccctctcacccatgttcgattcggatttggtgtgtgtgtgagagttgtggattcgagtttgtgtgagtgcttgttgttgacttcgtgaagatttgtgagcacttgcatcatctccgggagttcaatgcttcatttgttactcttggaggttgaggactcctaggcggctaggtgtcgctcccgacccaccgatctacatgtggttggccgggagaagtttgtgaaggtcggatctcacctccgaaagggaagagatacccttagtggaaggaggagtgcttagtgcaacctcttgaggaaagggttagctaagacccggctcttagtgagctcctcaacggagagtagaatccctcaaggattcgaactttgggaacaaattcgtgagcttcatctttggtgactttacttcctccctctccactagctttgcttatttgagccgctataggtctagttgatgtttgtgctagcatattcttgttgtaggcaactagatctaggatttactttgctatttgtactgactccgaaaattttcggatatatccaaaaatttcggaaatttccgaaaattactgcttccgcttttaattgaattttttgaattagcctattcaccgcccccccccccctctaggcctaattgacactttcagctctgatgtaatcaataatctttactcagggacaagtaaatgctcaatgtgatggtgttgttgacggtcctaaagtaccaattccgaccgtcaattcatgcacaaatgcaaatgaaagagaatactaaacttagaggtagtgcttattactaaccatttccacaagtcttggtgaatatttgtacgtgggtgcattatggacgaaaatcacccgccatacgacaaaatacatatctagacaatcagacgtgagtacacggattggaggccctacatgtcaatcataatcgcctacaattgagcccatctgaggtacaacttgtaggggggccactaggcagcctcccagccaaaggattggctgggaggtgggccaatggggttggccgaacccaaggtcttttgaaccacctttgcctctccttgccatctgccgacgcgtggagcaagatcttgaagccccaaaggtggttatgcttgattaccggcagttaccgaccttccaaccgacttaaggaggctataaaagaaggagctcactacactctaaaattacacagcaagtggagtacaactcacttacacatttaggctgagttcgggagtgagcgttgggaaccctcactcccaacatgcaaaacagagcggtgattagtgcataatttattaagtattatgtaaaataaacttgaaaaatggattaatatgatttttaaaacaactttcctatatattttttttttcaaaatgcacaccgtttagtagtttgggaaacgtgcacgccgaaaacgagaaaggtgagttgggaaaagtaggggaagaacacagtcaaagggtgtgttcgggaggaggggttgggaatccctcctccccagcacggaaaatgaagcacgtattattgcatgattaattaagtattagctattttttaaaaaaaaagattaacatgattttttaaaacaacttttatatagaaaaattttgcaaaaacaacaccgtttagcagtttgaaaagcgtgcatacgtgccccaaatgtcggacttctctccgaaggagtgctagagatgtcgacattcttccaaggagttctagaggagtgccgaagatgtcagctctctgtctctctatctctttgatcttgtacctcgttggatgcttcttttacataagtatttgtgatctcatttggtattaacttttcttatttaagtaagatatattctcatcattccaggttcatcgctgtacttagagtaccttaatcttatataagtgtgacatcgagattggggtaataatcaatagcgtagacatggtgttaaggctagagtttacgtttgtttgttgtgtgctccacgggttgtagaagtagatggcaggtggtaacagccatatccgtcctttgtaattctccatgttcggtacgtcatcgagctgtaggccggagtctccttggaagatcacgagtaagctggtgttcgaaacaattgatagagttttaacttaacttaattaacccataggaatccgctctttcctaagcatcccaattagttgttgtccttggttgaatcttgttcttagattacacgcacatgttccctgtgatttgatacccttggaatactctaaagtgaagtgctacttcggtatccatgttcttgcggatttatttatgactgtagcaaataccaacagcgggccactattatgttgtcgctagtcatgcattgtgcacacattattaatagatgaggggtctcgacaagccattgcgtgcaataggtgatgacatgccctcccaagcaattagagcaagtttaacagtagagccaaatattagctataagatcatattagagttagtatgtatagtagatgggctctaactttgtatttatttttcttctcctctctctttctcatgcatatacatttagtgcatttattttaatgtgtgtgaagagttagctcttggataccatcagctcgccattgttgaagcccttaccactgcctaggattggggacttggggtgtgaggcccagagagaggttaggagatgggaatcggttgaatggttgaaacagaccagaccgggtggtcttcacgggtggcagggaaatcttgtcttttcaaaacatttctcttcttgtataggctaaaaataataaaataattgacagagcatccttcagcagattaccatattttttttaggatgtactcagaccgttctatatttttgttatgtctacatgcaaaaaccacaaattttcaatgtgcggtaccaaattttgccaaacaaccaccctggaatgataattaacaagtatgaagtttgttacaatcgtctcaaacttatttgttataaagttattgtcaaagtatgaccattaataccatggaaaatgattaaaaaggacaattatcgttatattggagggaatataaatttgtttgtgcagttcattgatacaaatatgaaaaacaaaaattaaaatgcccagtggatagacctcatgaatgattttgctatatggtttatatatggaaagtggcgaataaatatcatggctagtgtagtgggcaccttatccaaacaatgcataaaaagatagcttgaacttgcagctaaattgttcctttattccacttctttttttttattctcccaacagtggactacgcatatctgggccacgttgattttttttttccgaaaatggccacgttgattcggtggtccaatttaatgcacttgcgagcaactaattccgttccataaaaataaaccgatataaaaataaatctattatgggatatgactgtcatttaaattaagttgtgctaatatgatcctaatgtttccgctgtcattttaatttatttcatgcttacaagtcaatcaaactacagtatatatgttcaagtcaaacaacaaaagaaagctagatcaatctgtgcactcatgcacagcacagcagtagcaaagcttcaaactgactgtaatatgtaatcacatgataaaagtccattgaacatcctacaaacacttctaggctgtcacatggtattcctataaatactcctaagtcgtcatatggcactataataaaccaatggaaccattacattcaactactaaatttatctctttaggaaaaaaacttaatgaattgattt

SEQ ID NO: 9381 - DNA, 4811 bp, Oryza sativa
tttagtgtttttgagcagaattttttggaaggccgtagtaacgcatgtaggggtgaaaaaaaagctcgggctcgtgagctcagcttgggcttggctcgagctcaaatgccaaaggagccaagcccatgcctccttttcagctcgttgctgaaatgagccaagcccgagctagctcgtgagtcgctggtttggctcatgagcctaggctatcatgtatttatatggatgattttattttatagtgaagttattatttgtaattatgcaatttataatttataatttgtagaattgaatatataaacttattttagttatacatgtcgacgatttattattgatcatctacaaattatatatgaagagatgcttcaatgggaaggctcgcaagcctgctcgatctggcttgagccaggaaacgagccgagccgagctcatgcttgagcctagtttattgcgagccattgcaagccaagcctcgtttccacccctgcacgcccggcgcctcaggtctccatgctcaacctctcccgatctctttctcttcctattcttttatgttaccaaattaaaagcaagaaaagctataattttagtattaaggtgaccataattttaaatgtacatatctaatttctattctatctaaattgttcctgtatttataattaaattgacaattttagatccaatgttttgctatacataagtaatatgtcattgtggtcttcttaacgtctggtattctcggaggcattcggatgggcgatttctggtgatcttcaatggtgactccggcaccgccgggagggtggaatttctctcccggggatgcaatctgcgatgaagcttggcattgtttccgaccgccggttcatttctcctctaagttcagctcggttcctttccggttagtggtggatctacctcgctcaaattttcgtttaacaacttcttcggtggccttagccctcagggctgtgattggtggttcgcctgctgatctctctgtttcccttctcaaagatcgttctttctcttttttttgtctgctccaaacaagtgggtttatggatttatcgtttgagatcttatacttgcaatgattttgttctgcgcttctttctttggagaaatggtggaccaaattggtagtgggaacttgatgtttagagtcgtgaacaagagaaagaatgggtttttgtggctcctaagaaacgtgtttctgattctttgaggcaacctggtcgttcttatgctcaagctactcagcagcgggttattcctatgaagagtgtttttgatagattaaaggagtccttgaaggtgactggcggtgatactccggcaatcactgttccggtgaccaaagttccggagactaagctggtggctaatcccaaaattcaaaatgttagaggtaatcgggatcaactttctaagcaagttttaaattctaatttaatttgtgggcgttgctcagagaagggtcattctttgtctgtttgtgttgggccctttcggtgccgaatttgtaagagttcgggtcatgctgcccgtttctgtagctcaaagcaatctccctctgagggtaaattgccaaagtctgtttctaccccccgcattaatgcagttgctacggtcctaaactcccggggtaattgcaatcttgtttggagacctaaaaagcttgcgccggttatctcgtagccttctcgccttctccaatctactgttgagaatattgttcaagcctccccagcccaaagttccatgccaatggcagacctcaaccctaaccctcatcgtttccgccatcaaggtcacattgtgcatttgggaggaaatttgcgtgtccctagagttgatctcaccatccctcaaaggcctgttcgagttttgtgttgctttggtggagccgccggtgtcggagcaagattgggatcaccaccgcatgctaattcttcatcacattcttgatgagcgtctttttgaggtcagaaatagctaccgtcatgcttctgcggtgggtatgtatcaactccattctgctatgcatagagatgccctggtccatagtgggccgtttgtttatgatggagtgcattcggtaacttttgtgaagcatgatcaaggcccaaattggagagcatctcaatgccatagagagggttggttccttttcttggattaccaccttgactttattgattgggaccatctaaaccttgctacggctacatttggccaactttctttttggcttgaaagggatcagatcaaggggagagttctgataagggctaagttaaaggataatgattttgtgcctccaaaaattgtttttgcatgatccggtgggtatgggcggaggaggagaatcatggacagtttccgtgtttttgttggaaggggatttcattaacatggctcctgatgaagatctgccccctgcgggcccccaaccaaatcctaatggtctagatgatgatgatgatcctaatgtgggcaacatttggcagatggggcagcctcctgttggtccaggtgactgggatgatttggtccaacagcagcaagctgcagaggctgaggtagaggatgcttggggctaagactatccaatgggccaagtaatggaggtaaatcctgatggtctgcttgctttggtacctattgtttcagaggatgctagcccttctgttcctgctgttgctatgcctaatagggggaaaaaggttcaggacccagtccaagacccgaagatccaggaattcttagctaacttggataaactgactagaagtgaatatcctagacacccttatttttatccaatgtctggcctgaatgagaagattgacctcttgtgcaaagaaaagggaaccatgcaccaatttcttgcttctagttctgttcctgctgccatagatgtggtcaatccttttactgctcttgttttgcccaaaaagacaatgtttgatttttctcccttagtgggtcaagagacaagtgtttgggctccggattcaacaaagtctgatgttggccccctggaggcctagacccaagctgctatggaagtacttgatgtcatgcccttgtctattcagcctcccttcagcccagtttgtgaagcaccagctcttcctgtgttacctaaggctccaattaagaaaagagatgtcaaaactttgctttataacccttacaggaggcagagtgcaaggttgcagcagaataaggaggaagcagaactgcaagtggatcccagaatggacattggcaagccaaggggtaaatctgcaaagaaattgaaagagcttgcaggcttgcaggtatagcaaaaatctttgatgatagtagcattaaagagtctgattttactaaaagtgcctatgatgatattcattctgattcctttccatctgattgttctatctcattgttgcaaaagatgggagtggacatgtgcggcttaactcctgaggaggaagttgaatccagcatggggagtgagagaagaaagaagatgcccaggcctgacatggaggaaaaatgattttagttttcagatgtgttttagtagacctgtacttcccttttaattatcatgtaagggtctgtatttggaacttcccttttaattatcatgtaagggtctgtatttggacaagagcttttcagactttgtcatattttggttcagttgtatgcactataaggttatgttatttcaggctagttgtactagctctggttggtttctctttcaatcctgctttattcatgagtaattatataaatcttggaatgtgctttgctggaatattaggggaaagaatgcagagccaaaattgctctctttgagacagaaaattgaggactgtgagtgccaggttttttttgcattcaggagacaaaaaaaggatcattttgatctctcagatatcaggaagtttgccccaaaacgttttgattcgtttgcttttgcaccctctagtggtgcctcaggggcattttggttgtttagtcttcaagggtttttgtcggagctgtggcggaaattaatctgttctctgtgtttgttgatttcaatttgaggcatactgctcaaacctggtccttgacttgtgtttatggcccttgtggtggcccagagagatctgattttgttacttggtttaagaacattggcaaaatttgctataggacatccaaaaaatgcgtaattagctatgggacaccgtaaaaacgtgtatttgctgtagggcattgcaaaaacctggtaattagctgttggacacccacgacattattttattatttttggaggaataggagagagaaacagttgtgtaaatacggttatacccttcgattttttttctttttctttattcttccttattttttttttctctctaattctctttctctgctcttcattcaagcgagccccagggagagggagagcgtcgtgacggcgtggaccagtgcagcgcctcggctggggcggcgttgcgcggtcgtgcgcaagggtcgaggccagcacgacgcggcggaggtggcgcccgagctggagggttaggtggtgccggcggggttgggcggcgtcagcgcgcacgcaaggacggccgggctcagcgggcgcgaccacgccgggagcgcagcggctccgggccggatttgggaggctggaccagatggcgcgaggcggccgccaacggcgacgcggcgaggctcaagccatcgcagcgggcgctcttctcatgcatggaccttcagcacctgcaaacccgatgctgagc

SEQ ID NO: 9382 - DNA, 2569 bp, Oryza sativa
caaatttgtctttaatgattgtttctctctcctattcgtccgaaaataataaaataatgtcgcgggtgtccagcagctaattaccagttttttgcgatgccctacagcaaatacgcgtttttacggtgtcccctagctaattacacgttttttagatgtcctgtagcaaattttgccaagaacattagcattggtgatcagcaaaattggctttatttttagtgacttcgatttctatagatcagtgcaggatagaaacaaatctggagcagatatgaatgatatctttttcaatgacattatcagctcccttggcttgcttgagatccctcttaagggtagaaaatacacatggagtaacacgcaacaaaaccctcttcttgaaaggttagattgggtgttcacttcagctccatggaccttggctttcccaaacactacagtggtgcctttaactagaaatatctctgatcatgtgccatgtgtagtgaagattgatacaaaaattccaaaatcccctatttttagatttgagaattattgcgtgcagatggagggattttttgacattgttcagcaggtctggtctttggatccagggtttgaggaccctgctaaatgcatttcttttaagcttaaattgctaagaaagagattacttgcatggagcaaaaatctgtccaaattactgttgcttctgaccaactgtaacaaagtgattgattttttggatttggtggaagaaacaagaattctctcagtctttgaatggaatctaacagaaattgtaaaagtgcaaattctcaagttgcaggaatttagaaagatctattattagaagaagaggtgcactaacaggtggatgatgcttggagaggaaaatactaaatttttccaatctattgcaactgagagatacataatcaatgcagtgtcacaagttttggatcaaaatgggtagattgtgcagctacatgcacaaaaggcatctctttttcttcacagttttaagaatagaatgggagttacagctggtcctcaaatggcctttgatttgagtactctcttctcccgaagcacagatttggaatgtttggtggacatgttttccacacaggaaattgacagtcttatatccattgtcccagcagataaagcgcttggaccagatgggttcaatggtttctttatgaaaaaatgttggcatataatagctcaggactactacagattggcatctcattttcatgctggatgcacaatttggaaatcttgtagttcttatataactttggtttcaaagaagaattcaccagagacggtcaatgattacggacctatatctcttatggggctcagtttaaagttcctaaccaagctaaaggcaaacagacttcaaggggtaattctcaagctagtaagtgaaaattaatatggttttattaagggaaagacaatacaggattgccttgcttggtcttttgagtacatccatcagtgtcagcaatcgaagagggaaattgtttttttgaaattggactttgaaaaagcttttgatactattgaacactctgctattctttctgtcctgcaacatatggattttcctgaaaaatggatgcaatgggtgcaaatggttttctcttcagcttcttctactgttctgttaaatggtgttccaggaaattcttttaaatgtaggaggggtgtaagacaaggtgatcccctatcaccacttctttttgtccgtggagctgagctgttacagagagtaatgaataaagcttttgagttggacttaatctctaagccaattaatgaaaatgatgggagtgggttccctatcatacaatatgctgatgacaccctgatcttactcaaagcttctcaaaaggaaatcttctgtttcaaaactatcctgaacatgtttgcacagtccacgggtctaaaggtgaattttaacaaatccagtttgtatcctttgaatctttctcatgacaatgcttctttgctcgctggtattttgggatgctccattggttccttgcctttcacttatttggggttgcctcttggtaccactaggtctagagtggttgattttgcaccattggtggacagagtagaaatgagattgacagcaagctctatgtttttgcctcaatggggaaggttaacattgattaattcagttctttcttctattccaacttattatatgtgctctttgcaacttccagtcactgtcataaaggcaattgatacagcaaggaagagttgtctttggagaggcaacaacccatcctcaactagaaaagtttttagctttttgggacagagtatgcacacctaaagataagggaggtatgggtgtgattaacctgagagttcagaacattgctttgcttttcaagcatatggtaaaattatataatggtgttgagctgccatgggtgaaactgatctcacagacttattatgtttctagagcaccccatctggttttgaacaagggttctttctggtggagggaatcacatctctttcagatattttcgggctgcaggaa

SEQ ID NO: 9383 - DNA, 2130 bp, Oryza sativa
gccacagcccggcccctactgcatttcccctctccgcctccggaacaccaccgtcacgcgcaccacctctcttcgccgccgccgccgactccagccgcgcgccaccaacactcccaccgccgccgtgctgcgccgtcgcgcgccgcacatcgtcccccatctcctttccccaaatcccccaccaaaactccctcctcactgccaacctgagaccgccgccgctttcgccgcctcggccgccgtttaccgccgctcccagccatcccgagccatgccgtggccacccccagcgtcgctgtgttgtgccgcacctcggccgctgcccctcgctgccggaatcccacgggagcccgcttttccccgttcaaggtgagcttcaccattccttgccgcctccggccgctgttttcctcggcaccacgccttccccgtgccacctaaactctctatccccttccccagggtcccggaggtccccggccatcactcgtcgcccatcggccgccgttggagcaccaccgctatctcgcctccgtccggtgccgtgccgcttggtgagcatctgtaacaccctgaaaattcgaccaataaaaacaaaactctaaaaatacggaccttcgaaaactttttaaattaattgcatcatgccaattttattcgcctattttatttggatttgatttcgaagttcattaatcgcaaataaagaatagttaattaggaataaaccctaaaaataaattggcaaaataaatataatttaaaataaatattaggtaaggatagaaataaataaaatattattgcgaccatatttgtatgaattaaatttaaatgcgatggaataagaattaactctaattacattcaagtaaattatataaaaaaataaaaaaatgggtaatattaatcttgagtgaatccattggttggaataacacaaatattgagtaaaattcatatatgcaaaaattaggaattatagaatcaaatttatataggaaatagactaaaatagggttaaataggaaaagtcactattcattgccccctaggtgttcgatcgcgttccctagccctaacccctcctctgccgcatgcgcctggccgccccgagccccgtgccgcccgccgtcgtgtcgcgctgccgcccgtcgtgtcgtcgctttgcgccccgtgccgccgcgcgccgtcgccgtcgctgtcacgccgccatgcgccctgtgcgccgcgcgccgatgccgtcgcgttttgtcgccgctgccgcgccgcgcgccgtcgcccgtcccgtcgccgcgccgtcgtcccgtcgccgcgcgctgctttcccaggccccacgccccgtgccctgtcgcgcgtcaccgcgccgccgtcccgtcgccgcgcgccgttccctcgccgcctcgcgcccgtgcgccgctcgcccgtcctctcgccgcctcgcgccccgcgcccgcgcgccgctcgcccgtcgcgtcgccacctcgcgccccgcgctgctgccgcgccgcgtcgtcatcgcatagccgtcgccgtcgcgccgagccccgcgccgacccgcccatcgcgtcgccataaggccgcccgcccctctccacgccctattaagcccgaccgctccttttttccaccccacacacatcccctccatctttccccctctccctctcccccttctccacgcgccgccgttgttgtgccgccacgccgccgccctttgagccgccacgccgccgccaagaagccgccgcgccgcgacttgcaccgttgtcgccatcatcgccgccgccgccgctgtcggtaagccgccgccccccccccccccctcgcgttcactgccgttgccgcccgggtgggcaaggagccgagagagagagggagaaaggagccgggagggagagaaaaagaaaagaagagggagaggaaaagaaagaaagaaaaaaaagaaagaaagagaagagagaaaaagaaaggagaaggagaaaaaaaaggaaaggaggaaaagaaagaaaaagaaagaagagagaaagaggaagggaaaaataaatagaaaattagagagaaattaaggaggattagaaaatttaaaataattagaatttaattatagattaattatagtcgtagaat

SEQ ID NO: 9384 - DNA, 12728 bp, Oryza sativa
  unsure (1)..(12728): unsure at all n locations
gaattcgtccgatatttaagcttcgcgatagaaatttctaacctattatacggatataatactcgggctgattaaattaaaaacttgtgctaataaaatatttataccgcgaaatagcttaggatggataaattaagatcggattagctctaattcacgaacaaaaataggtaatgtaagaaactgacttccgctctcgatatcttcgtggatttacttggatctttatttgaaatctaaccgaattcaaatcgtttcttcgcacgtaattttagagccagagggagttgcggatccgagcgaggatcaagacccacagaactacgagcaaggcaagtcatcactattctttaaacatgttgatcccaattgcgaaactattttgtttacaaataaaattgcatgcaatgatgaacatcccacttgtgattatgccatgccttgattattgtttatccttaaatctttgtaaccatgattatgtatgagtccctagtcaaccatgacaattgcttagaaatgctactctagattcatgcatgctcatatttagcaaatgctatatgcctgggcaattacctttgggaaggtaattgagatgcgacatgtggagacaggagcgccacattgccatgataatgatgacatgatttatcaaagggaaataaaattaaacaactatttttgactaggacggacggaggatttgggtggtatctggaaaaggctagtaccgtccccggtcaattaaagaccgagccatgaagttaagcatgaaacaacccccgtacaaccgtacttctcgaatgggtatagacctagcggattagatagccgagcggaggcagtatccctgcatagatggttcacccctgagtgagacaggtgcgctacggtggggcagccgttgaggtagggccgagaggcgtgccctacattggtgtcgccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttgagttcatggagcgggtactgccaatgcaaggttatcgaaaagctttgccgtgacgcgtctcatgtgttgagacgaggcttatgtgttgggcagtcgcggagtgcgggtaaagtgtacatccactgcagtgtgagtaaaccaaatctattcgaatagtcgtgctcgcggttactgagcaccgggacatgtattacacttggctagactctaaattcttaacctgtgtgggatgggatattgcatgatgatttttatgctgttggagccacttcctgagagacgggaaggtggacgtcctcagaaaaccatgacgattcaatggcgggaagctatccttgggatcacaatggatggtggacagaaccgtcgttgtctaatgtgaacactagtattaaaacttgatcagtctatgctaggtcttaggcttgtgaaaagaattacaaaacttgctttgtgcaaaagaaccatagccattccttgaataccctctatcatgtgcattgttgctgtggtggcttgctgagtacggttggtgctcacccttgcaatatacaaacttaatcagaggtcggagatgaagcttcggaggatccctacgcttactaccaggaggatgatgaagacgatggcgctcagtaggtcttagttacggtcgttacctgtggcaatggcgtgccgctgtcttaactccgctaccttatctacttctgcttttggaatgtatcccggaccgctcggtccgatgatctaagactatgcctgcgggcttatgatgtaataattagcactagactctcgtgtatgtgcatttggtatgttagctatgaactcgtgtgtaccagactacttgatccagggaaatggtactgtttacacgattgattcctgttacaaaaatgggagtccacagcatcccccttcctcctctcctttccgtcgcccttcgcgcgccctctcgcgccaccgctcaccgccggtggccgtgcaccgtcgcatgtcatgtctcggctgggccggctctgagccgtgcccgtgccctgggcgccctgccctgtggccgcccgtggaccacccgtggtctcggtccatggtgccgtcccggccgcagtggaccgtgtccaccgtgcgccctcccccttgtgtcactgacatgtgggacccgcctgtcggcaccggcttcccttgctgacgtcagcggcggtccttttcctttgtaaaaataaatattaatcgcgcaataatgcgttaataattatagaaatttatttaaatggctcaaaacttctaaaattcatatctaattcattcgaactccaaattgggccgttcaacttgcaaaattcatctaaaattgaggtctacatgattgtttacttttttatgtactatttgtttggtttttattagagtttttcctcgttttgcgtgccagcgagtagaatccatcgtttcggaagtccgcggtcgctaggaaaagagttcagaagatcaaagttaagaagcaagcaagtcacacattccccttgagcattttgatcctaatttacaaatgttttaccgtttgcaaataaaatttcatgtcttgctaattacatgggatcagggtttacctatctgctcgcttgtgccatgtttacttgatatctgtcctttgtcaaccgtgggtaataaatcgcctagcttgtattacttatgtgacctagctagaactttatgcttagccatgcttaattaccactagctcaattgatgggataattacagttttagacatctagtatcttgacaagctgcgtgctcgagacatctagccatgtttcatggtcgtaattatccaactaaaatgcaactgaatggtgggctgtgggtgcatggttttgttagttgtgcccatggcaattaaggaccggttcacgagaaaccctagaagaattacagtgcttaccacaagcgggagtgggtaactgcttgatctggagtatagctcgaccctttcctaggcaccggtggcgagggtgggcgtcatggagttgggtcggccggggtgtccggttgtccagctgccggattcaccgcggcgcacgaggggactgccggctgccttgcgaggagtgcaggtgaaaccttagcgtggtgtggatggttaggggagagttatatgaagggtcttgtcacaatcactcgacatggtgacgtgttcatcatgggcacatgatgacacggtgacatgccggtggattgtgtcttgtgggtacagttgtgcacctctggccagagtaaaactattcgaatagccatgcccacggttataggcgatcaaccagattcaccgtgattagtctcacacttaataaatcgacccaatgcactgtagttcaggtggattggttgggcctgttcaatgtggtgtagcgttgttcagtcgagagttaatattaccttaattactcaactgttttactgttttgatcaataaaatgttctacaaccgcctttatgcaaatagccacaaaccatcctcgtatccccttgcacgtctgcatcattggtatggcttgctgagtacggtggttgtacttagccttgctattgttcccccttttcagaagtgtagtgcttctgagctgaagccgaagttagaagaccaaggctcagaccccagttgagttttgcctgtggagtggagctgaagccccgctaggatcgccttttttcgctgctgtcgttctctttcggtgtgaggactaagtgcctcttctgtaagtattttacgctttatttacgtttggaactgtatattacttgtcgttttgtgtaccctggttggtcctggacagggatttagtacacaaaatagtctagaaatttgggctaaatttctgggcgtgacaaaaacccagcccggccgaggccgggctggcaacgatggcactcgatcgtcattccccctactgagggtgttgtcgtgccgtctcaccccatctagtggtggctgccgggtgaaagccctgtcaaggtttctccagaccttgacagacagcagcggcgatgctactgtcgcttctctccatggagacgccgtctaggtagcacccttgccaaaacctcccaaacatctgttgcaagctcgttctagagtcatttcctcttgtatcggcgtcctagtttatacaagttggctatgtcgaagggcctaggggggagagcggttctattattctctctcaccctctcttcctaaatccctaagatgtggatagagtgtgtttttgtgtcggttgtaagggttgggttttgagcgatcctagttgtagttcctttgttggcttagcggcggtcggccaagcttagaggcagccggtccgatgctagtcttctcctgggattgtgtttggcgtcgtcagtgtgtgggtggtggtattcttttttccttttcctggttacgatgtcccaggattgtaatcttataatttttttctattgtatcaatatgaactttgcactgactagttcaaaaaaaaatcttgtgtctttaggtagaccaaacaatccaattagtctgtgattttttttaaaatatgctcaaataataaaagcaaggccaatgaatcagggaagcattcaaaaaaatcacatcccaaaagtaatggtgcatctttagttatactagaaaaaattatctgggcattgcaacaggtgaaggctattttattttaatcttattattgtccactctgaaattcattgtgagaattcgatgttatatggtttagttaaggtgagattcactatgggaatttgcttggatatataattttttagaaaattatgagctgcagttaggagtccgttcgtatcaagttagcatgcgagtttttttacgactccttctgtattttcattcaaaagtgaacgaacttaaaacccgacttaaatacggatctgtattttcaaaagcaaacgaactaaaaaccgactcatacacggatgacgtacaaaattaccggtaaaaacattttatagtagtagagagttgccaaacttaaaaaccgactcatacacggatgacgttcaaaattaccggtaaaaacattttatagtagtagagagttctaaaaacattttatagtagtagagagttcccgtctgtgttctcgctgagctccttgaatcgatcccaaacgggtgtctcctacactgtgcagtacaattgaactctaaggccccatgaatttagccctcacatcccacagccaatccattcattaacttatataaaaggtgattgacttttttaaaaaagttggcaccttaggtgtaacatctttatttatcatctcacgtcatttgaacttaaaaaaaatgcttgcataaaataaaacaaaaaataggaaatgccaataagagtaaagcggaccaattagggaaaatcttataaggtcttagaaaaaattggttcttccttttcaccaaaattggaacacccgttaccatatccattgcgtcattttttagtgtttagatgctaatacccttcaggtggcattattagtttcactacatcatgcacacaaaagacataacccactaaggtagaaatatataattggtttaaaagttatattaaacttgatattcactttgtttttttcttaaaaaaatactatgggtctaacacatcgtagggaagcaggggctagataagtattcgaattatgtcaatatgaatcagtaagagggattgttaacttcatggaacaactgaaacataattatttgcaataatagttttaaaaattttgttaaaaaagagagcccgtaaacattccatttgaataaaaactacttacttttaatttacacttacctgtttccaaaacaaagtatacttttcttttgaatgataagtcagatcatagttaatttcttaccgaatgaatattgtatagtatgtagtgtaaagccaacgaatagcttagaaaaagttacccaagcaataccgattaataccgattaagaaggtttttcagacaagtcacaatttttgaaatatagtatgaataatccggttgatggtatataagtctctaaagctgacaataagatacacgcccgcacatttgcgtgggttacctttctagtctaatttaagaaactgttgggaacaaactcgatacaaattggtaaaacacctggagaatataataataaacaaactcgacaaagacagggttttggtgctgtcaagcagcagcattttctggtttatactcaatttaaaatagcaaatcaacatacatatcatgggagggcaatgccaccatgtgcgccacccccgtccacgtcatgtgccatcccacacgccaagcatgccacgcaactagacgcactccggcttgagccagcaagccacaagcaaatacagacgcaacaagacaaggaaaaaaaacagaaaaaaaaaaagaaccaacaagaaatgttccatcagaaatagacttcaaaaccattagttcattacaaacaatctagatcagtcatatgctgaacccagataagagataaacttgatatatccaccaatgaccaatcactgtagggactttagtgttgttcttccaagtatatgaatcttgtatggatcgatcatcgatgtcggtgaccgttgtagtcaattgaatctacctgcagttggaattatagaagaaatatatcagatttgcagaaaagaagttgtgccctttcaatatgctccatatatgataagttcacaatgcactataaaaacaggttctagtttttgacctcctggtataaaagtttgaatatttggtacaaacataatgtctgacatatgtacatgtctatataaatagaaggctactgcagaacactataccattccaacagaatagattatatataacgacatcagcacggtatcttagttagatctgatatttttaatactagataggtaccagatctagtaccgtggtacctgatacaatacccataggtattatatttggtgccaatgataccagatgatactgcatggtactaaatcctgctacctaggtaccnnnnnnnnnnnnnnnnnnnnnnnnnnattccgttagaacagtgtatcgttttgtagtattatgatataaataccatgcaattaaaatatcagaagaacaaataattttgaaataaacattttcatgtttaaatttatctaaacttggtgaaaggattccataggttatgaataaaaataatatagatgcatatgggttgcacactagtaaactagaccatatagcctttgcttaccgtactactaagtaacctagttgaaaacaaaatggctaattctgtgtatcttttctacacctccatcttggtgtgcgcacataattgttgctgatttactatgcagataaacaaggagtaccaaatgacagcaggccgccattatagccagcactcaaaagttagccacttagcttcaaacagtcttatcatttttttttttgccgaactaatattttggtgcgacttttcatcagatattttacagtgctggaacttcaaaagagtgcaaaaatagtttttctaggggaagtattgagaggttaaataactattcctgaatcctgaacagtgccaattaaaatgtagggcctgggtactgtgggcctgctggtttcctattagttggaaaatacagataagaatagtttgtttccttgctaatttggtttccctcagatatattcacatgtattaaagataaaaattacattgtagatagagttttatcttgtggggccaagccaagtaatctgtacaaaaaggtagagtgctagcatgtataactattactagtaagcaagcaatgaagatgaattaacctagtctctccccctttctcaaaattgttcatccaaatctatgatctcccatcatgtacatacatacatacacatacacgcacacacatatatatacctcactatgttacctctcaattaacactaaaaacatttctagttcccaaggtccggagaaaaccacgcaaggaaaattaacactaaacattttacaaattgcacttgtattcttctcttaccaacctgttacaaccaagaatcgcatgcctagtggtattgctagccatgcaattcatttccaataaatccctaaatttcaaataggacctttactttatttcccactatacaccactgtcctccataacttcatttggggtttctcaaaaaaaaaaaaacttcatttggaaaaatcaaccaatgatggaatcagcatgatcaacaaaataaagaggaaaatataataaagcagtgttgcagtaacggaaacaaacttgaaatggaattctgttatactagccatgcaaatctatagaatattttttgcttattggcttatagaggtatgtggatagatttgacctgagaatagagcctttgggcaaggccttcttatagtattgcgctgactgccgcttgtagagcaatgactgatcatagccaccttctttctgaggccacactaggttatcccaccaatccttctcacagtatactatgggtcttggttcatgcaatccttggacgtcaggcaggtgtctaagactacagcagcccctgatcatgatggcctccagcatgggagctgacattatttttgcctcacatatccctttcaagctgggaagctcatgcaggtggacgtgcttcagctttgggaaatcaatagcatcattgcttactgtccccttggagtttgctgtgttcaaagggaaaacatatatgaggctggtgcagtacaggatctgaatggtctccaagcttggtaagttgttggacaagggaagtacatggatgagcctaggacaggaatccagatgtatatactgcagtttcttgaaggaatcaacatttacatgcttgacttccatgctccaaatgcagtgggctgtttggagatgtgatgcccagaaggtctctagccaagagaaagctacgatttggtcatggtctctgagtttgaatacagaatgtaacttggggcatctctcaatacagcaccacttaatccgaccccaatttgatccaggaatactagtcatccaagagtcatcatgcacgtttagagagtgtacaatgtctatgaaatttcccaagatattgtcattcccctgcaattgttttctgtttctgatctctaccttgcagcttctgttgcactttgactctaaaggcagaggcgggcaaggacaaatcacaggggcaacactaagtgcaacaactctgtcaaatatatcactgcacatattccctgcaactgttcgatcaacatgggcattccttatttgttcactactgcactgcttactttgtccttcatctttgcaataattaacaaaaacaggtgacatgcagaaatgcacatggtgactttgcattgcaaacaactgtagaaaccgaagaagcctaggatccatgataacaacatgtgattggaataatttatcatcatcctggacaggtgacaagctattttgtcgtttgccttccagatgtactccaactgtatctacatgtaactcatccaattgtggttttgtaacatctgaccactttattgcacaaagatgcagacaaccaaacagaagaagacgattaagtttttctgcctgcatggcatccaggtcaagtttttccaatattgtgccggaaagatccaattcctcaagttttggcagtccactcaagattagcttttttaaccggcaacatccagataatgagatttttgtaatatttgctgcctttggatactgttctgatgctgcaactaagctgaattcctcaagtgataccggaaggttgctatcactgacagaatccaacccaacacaaccatcaagagtgacagtcttcagacatgttgccttggacaggtcaggaaaagcttgcatggtagagttacctgacaagtctagaatctccatcttttccatacctgagaatgtgaatgtgaatggatccttttcatctttggttgccgtatagtcttgatcaatcgtcttgattacacgaagcttctgtatcttgttatgctgccgtttccaaatatgtctcaagttgtgcagtttcactcccttaacattgagctccctgacattgttcatttcctcaatcatctgtggggagaaaacccactgtgtgtactgtaggtctagcacccacaaaccatgaaaacagttccaagactgaacctcctctccagcatcaatgttcagatcaaggcagttatcaagcccaaggaatctcaatccgcggcaacagaggaaaggaggtgaagcaaatctaaaggtacagaggctaagttttagcactctaaggttctctgcatgttgaaacatgtcattataattttgtaaaagatgtgcagggttgagctttgacttaaaaaaatattctactagttccaccgtgtcttttgattctgtgtcaatttggtgttctgccaagaaaaatgatgacactgtttgagccactgctgaggcagccaggaacccataattacttgaaatcaggtgacttgttgaaatccagttgtcagtgttccgcatcatgtggtaaagtccagggtcgtcccattcttgccacatctcttgttgtagagcatcagcaatctcccattcctgaatgatcccatcacacacccaatagtttgaagcatgaactgcccagtcatagtcaatgatgtctctgccaacaaaattaagtttcgatatatacaaccaacatttggcaattgttgtagggtgcagcttggctactccggaacatgtgttggaagcaatttctgccgcctcctcacacaatatatcccaccaatggctttgatcctggaactccatcccatatattttgttatggaattcggcagcaagaaaaacatctgccttttgcaccttgtcctgaattttggtactcagccgaaacctgcccctgaaggtccacaatattttgtttcccttatacagctgatatagaggcagaccaaaattagttacatcttttatttcattatcactcccattatgaaaaaccacaagaaatcttccactcattaggacatcattaacagctattccaacatcattgatcacgtctctggagctttcatcttttccattgatatcatcagcctcatcctgctcatcaataagatcttttgcttgggtcatctctagtttctctgcaattttcctctgcatttcccttatgcttttccacctcgagcaatcaatgtggattatcttttcaaacctcaattctgggtccgtgatctggcccagtgtaagccgttcggcaacagctctgaggacagcagatacacccaatccttcccaaccatcaaaatagaccacatttgatacatctgatttctttagtttgtcaattatactatcaacagcctcagcaacattctctgcggtaattacctgcagtggttaacagtaattaactgaggttagctcagctcagctgggttgcgtacaaagtaacacgactgtctagaagaagaaaaatcaaatgaacactatattcagagaaaaaaaaatgaaactatatatttagagggggggaaatccttatttgctactccactttgagctgtcaccaaactaggtatgccgatgtaggcgaggctggtgatgtggagacttgttgccgcagccaccgtcccccacctcgtccatggctggcgccgcctccccatcctaagcatcatcgcccagatctagtttggtgtcaagcgcatgcgaatggctgctacttggggccatcagcaactggatggcaactgtggcgggctggcggcaaggtcaggaagccgatggaggcgggagaggaagagttgatcagcaaatgggagacgaggatgggcggccaacggccatactgcccatcagccatggggatgggagaaatagcaagaaagaaaatgaagagggaggaaggcgatggttcatggaaatttaagtatttgctactattctatttatcaattatccaaatgccaattttaattttgtgctggtaaatttaacgccccgcgctttgttacgggatatatattagatagcgtagaaataataaaatgatttggattgaaatatcgtgaaaaagatgatttggcatgtgcatatttattttgggagtacctatagaacatttgacatttttctaggagaaaaacttaaatgtaattacaatctaactagtgtgtaactagaggtttactctgatctaacaaaaagtatcaaaaagtatcttgagtatcagtacatccaacgatcggaaacgatttggtaccgtgagataccagtacctcgaggtactttttgtttgaatagcgcaaatctcacgtaactaagatgtacttactccgtttcacaatgtaagtcattgtagcattctccacatttatattgatgttaatgaatctagatagatatatatgtctagattcattaacatcaatatgaatgtgggaaatgctagaatgacttacattgtgaaacggatggagtaatttatatgtaagaa

SEQ ID NO: 9385 - DNA, 4881 bp, Oryza sativa
tgtcaaacattttgaaacggagggagtataaagttttgagatatcattgaacacctccaaaaaaattcttacagtgatgcatgctgcgccgatgaagaaacaaatcacaatggtagctgtagatgttactttctccgtttcacaatgtaagtcattctagcatttcccacattcatattgatgttaatgaatcttacatcaatatgaaggtgggaaatactagaatgacttacattgtgaaatggatggagtaattattctctctatctttattctcttttcgctttaccaaaagagaattggcaacatgatgacagaggctcgagagaatgaagacagagttagggtgaattcttttgtgtttgtgtgtgcgcgcgtttttgaaatcgaatgcttttccctgttcattgatctaaaatttgcaatatgctgatgataatcgttcgggatcggatgcctcttccgaatgtacttttttccatccaacatcgaatgtactaattcttataataaacgactacaatcatgttagttgcagtgacctaagtagcactctaaagtcctgagtttaaatcttcatatgagcgaatttcatattggattgtttgaggggctaaattctcaatttaaaaggttgcatattttatttgggcatcatttgattttggcatacagatggctttgcccagtagtttaaattttataaataacaaaaagggtctagaaatacaaatacaaattacatgggaaaaaaagaaaaactcaaagctttatgaagattataacctatctaaaactctctcttttagatcattatattcatcctccaagatacaagagaatctcattcttgaaactagctaaccatctgtcgacattaggtgctaggtgctcaaaaaaaattaagcattccgctgcttccatatatgtcagcatgaagattattactatcttcaagaaatctttcattcaaaagcacaatcttgcaaaaactttcatcttggtagaaagacaatgacgtcttccaggaaattctaaacttcctccagtagggcttactaaaagtgcaatcaaatacattcttgtttcccctatcaccactcactcactcaggcaaaatatgcacatgataaatccgtgtcctgtggagcacaatgttgatcatgtcattgaacaacagccaaagaaacacttttatctttatgacacattttgatttccatttgcatgataacggccttgcatggctgcttaaaaaaaacaggctatacattcccgaatttttttaaaatagtaattaataacctgaaaattaaattaatagtaaatgaaaggtttaatttataaaaataagaaggacgctatgtgcaacagcgtccaggcatggacgttattcccgagaacgtccagatcaggacgctgtttgtaacggcgtccaccgttggagccgaaccaacctacggtagggaagcctccactcgcgattctttgtcgggtcgtcgtcctcaacgctgctcgccaaggaaggcctccgctgcgtctcgctcggttagcataagcgccctagccctagccgtcaggttaatagatcatatccgatcctgctgtccgatatgattcgacctatgcatcctaattttttagcgcacttcttcaaattaaatggccagctcgatcctgcaaatggcttctctttttttttccctaacgaatcgcagatggctactcttgattcgatacatgcgtgcctgcaactagctgcttcgtttatttatccagaacgtcctactgattgctccgtaaaagctagtagacctggttaataatgtactcaatgttagagcaaacagatcgatcaaggatgcaagtaacgctaatgcatgctgcagtgctgcacataaatggagaattggtaacccaaaagtgatggaatacagagattaataactgattatatatgtatgcccacatgcaaaacctaaacgaaaatcaactaatatccagtccagagcatatatacatcgttttcgaagatcagataagcagccggcgctgggttcatgtggcggcaaatcgatcctcagcagacgtcgcgagcaaattaacgggggcttctggatcagggcagagtttaacgaatggcaacgtgcgacaggaagttttgggcgctgatatatgctgacggtgctaggagtgactagtgagcgcaggctccctggcgagacgcgttgggggataacgaggctggtttggctgcaccaggagacggacgcagttgcgaacagcgtccccttccggacgttctcaggaacagcatccacgtctggacgctctggtagatagcatccttcttatttttataaatccagccagcaatttactataattatttaatttataggatattaattactatatataaaaaaaatcggatacattctctgtgatgaatatgatggcctattccataaaaatcttcaagttgtgtggatggactgtatatgtgcttctagttgaatgtatcatcatatgcttactatgactatgacagtggtaagtgacatgtctgcttttatctatcaaacattatggctacagaatcatccttgtatgtaaaaaagagtagagctagccttgcatgcttaaccattttaacggaaccattccacatgtctttctataacaaaagggtttgcccattcccttcgaattatgaagcatagtgagatttctgtaaataaatttgatagaccccttattatatacttatcattaccctcgattattgtttggcaaaatttgctatatgatatctaaaatttgtgtaattggttggagaacactgaaggcactattttataatttttggagaaaaagtggacaaacattttgagtttaaagttttcaatttccaaatgaaggttttgaaatttgagttgaatgtttttggagttcaaattaaaagtgttgaaatttggttgttttttcaattttgagtttaaagtttgaaatttttcactaaaaaattcccaatttccttttcagatttgagtttgatacactccgtaaaaaataatgtgcgtcattgaaaaaagaaaatcatgtcgcaattcacattgcctatactgtcctcaccaagatcgagtcggtgtttgtaccgcgttcctgttcctcgtagttctatgcataacagtgcaagccattttctcctgtaaaatcaaagtgtaaaatcaaagtgtgtttgattgttattctgtgatgaacaattggcatatgagattattgattttgatatttggagatcattgacgaagtggttttggagatgattgatttgcaggtgatgaacagagactgttgctgacaggtagtgaccggtcaggccgggttgttgtagtcagtcagaccagaggtatgtgtgcggttagaccagctagctcgtggcttgaccggccggctctgtaccggtttcggtttagggttgattctttggatatccatggacaatcaatgtttattctagatggatactatgcatatgtaatactgttgttcgctaacaatgagtcaaattggtgagaacttgtgctcggatattgtttcttggttgatgcgtttgtaggtggtcttgatgcctcgggagagtgttgccggtgatggatcgggagtcaacttgggataagatgacgtccggacgatcagaatatcacgtgggatatttaagctaaagatcaatacacgtggttgtgtgtatgggatacatagccgaatttagagggagtccaaatttggttcaattggagtttgtaaagtttgtttcttgtacggaaaggtttcttaggggattatgacttcttgtacaaggttggtctgtggctttaggctgcttacgttgggtataaatggagaaggagggtgtgtcattctggtatcatttttgatagagttgcgttgagataagataggcatatttgtaatctctatacatccaaaacttaaatgaagagcttgtcttttcgtttggcaatatttgattcaactcctgttcgagagagtttatagtagctatagcttctcttagaaactccagctgtcagacattccccaaagagttatttttaaccagattctgataatttgttgatgtagaatccatataatgaactagaagccaaaagatgagaaacccaactttctagatcttaccaacagcttatcagaatcttaagttcccaaaaacatgatttaaattgttgactctatccaaacattcatcttaatacttctgggttatgcagacttttggataaaacgagtaacatagttaatggacgaaaattaaaccatggcaatagttaagggacagaaatagactttgtttaaaataaagaaaagagaagagctcataattggtcggtgctgagtcttttgacgcagctttagaatctatcgagctttgttctacttttctttttctagcaagacaaatcattaaataaaatgaaaacgtactactgtacaaaatcacagtaaaaacacaacaaacacaaaagaaaacgaaataagaaaatactttccctattattatatacatcctgagtttaactcggtaagacggtaaagtctcaggtgagtacgccaagactgtaaagagcctttccttcccacgcatagtagtagccatagtcgatacagcaaaagattagcatgagcctcacttcaggagacatatacagattaaaaattgggcaaggaagcaaataattcagaagttaataagaacaaataaatgtaaagcgagaggtattcaggtttttttgccaaaatgaatacggcgaatagcttcctgagaacgtcgaaacttctgattcacatctatca

SEQ ID NO: 9386 - DNA, 10445 bp, Oryza sativa
agctgatacccatcagtaaacttgtacatggccaaaaaacagatttacagcggcgatacctaacactcatctaattaccttttaagtacccggagagatctatacaggccacagtaaaaaagaagagaacacatccagtctccaccaggacacccctattggctattacagtgtatctcaaaacaaaaatctccacatttgtcaattcaccagatttgcttattgatgccaatgcttaaaaaggattagcgtcaacatctgtacagcttagtgactgctgacattggctagtcttggaccccatccgcactcggttttctgaaaatcaaggagaaacgttagaagttggaaagatttcggtcccgattgcatgtcacgataaacaaacttatccgctcacctcctgtaatgattaacttctccacacgcgcaactatatgcttcccgaaagtgtagttcttcagttcgttcaaatgcatcttgatgcttgagaggatcacaactaggaatttgtcatcacatgtctgaaggattctctgtacaacataattgccaaactgatccttcatcagtccctgcatagattggtcaaaatgtgttattacaatcactgaaaaatcattgtgcatcaagacattgtcatacagtactagtacaaatacagtgaacattatattaaaacccagtgccatactgccatgtgttctgtatgaacaataaatcctaaaggctcttgtgcacttacttgacatacaaaatgaaactaaacacaataaatacagcattgatgtccgtgtggaaaacatagggttgtggaatcatttgatagaaaatatgctttcagttaacagctcaaggaagttgcttgttggacaaacctggaatgtttggccagaggatacaatctctcttataaggccttcacgttcatcaggagttccaaaagatagacacttttccacaacattagaagcatacttctgctggctcaagttcaccacttgcccagaaagcttttgaataatggatgaccgctcctctggcctaccatgttctaagacgtgctgaaaattgtttgaaaaggttcatcagtaaccatcaattagaaccgttaaatgctcattgaaggaaatgaaaaaaaataatactacattccaaactgggcctaaaagatataacattctttttaccatgctgcaatgtatcaacttatttaaaataataacaagaaacatttacaagttaattgagcccaggaacatcataagctggtgctgttttatatattttaattcccagtaggtaaaatgataatccgctggtgtcaaagtactcagttaatcagttaatgattgtttccagagtatgaagaatatatcgtatttcaggaggttactgttgtatttatatgtaaccatttcaaatggagataaaaatagccctaatacatagaagaaatgtggtaatcctagtaaccgctggcaaccagccacatccaacaaaagtttgaaccctggctccacacacataatttattttactaattttatccacaatatctgtaaactactaggttttttaatgatcaaggcagtgtaactatttttatacagggttaagtcaaaagtttgacaattgcagcaagtgaataaataaatggaatatgttaacctacttgaacaacatagtttccaaatttatcttctgtcaaatcaaaagcacgttcgacaatttcatccatcacagcactttgagttgctggattatggcaatgctccaaaactctctgcaaagataaggttagaaactaccatttaaagttacagaatttaatgcttaggaaacagaaggttgcaatttgtacctgaataactctgcagccatattggtgagtgcaaagcggataaattttctgaagtatatcctcaattacaaatggaatgtgatcttctggaacacactctatgcacttctggattacgtggttaccattctgatcagaaatacatctgagaacagaattcttaagctcaccaacaatagatatctttctctccaagtcaaccacatcaatgacctgtggcaaatgcatggataaaattccaatcaagcacctctaaagtgaaatgactcgtgcctcatcaatgtctcactcataatgctgacagagtgacaccaattttagttaaggtggcattccatgcatggacttttggtgaagacataacgctcataacgcaaacaaagaacaaagcatgttcattttttttaataaacagagattcattatctcttgtcagccaccatgaaaaaatgatttgccacataacaattagaaaaatcataaatggtaaatcatttgtcatcaattgtagcttttacacattagctcaatgctagtagtgagataagattgagtgttaaaagcagcggatgatttaatcttggttcaggcttccactcaaattatttttgtgtacattaaaattcttttttgtacattactaacagatttactttaggagactacactgctgtccacaataaacttgtaggaaattgattataaacttgtagagtttgcatgggttacagatttacatgaaccccaagaaaaaaaaagataacttaccttctgaacaactctgcaaccatacatctgaaagctgagttgcaaaaagtgacctctgagctgatctgctaactggcttaactggctttctgtagcaaactcaaaaaactgcaaatgtacaattctgaatgttaggtttcaaaatataaatatgagtaatcaaattagcaggacagataggcgtaccttctgaatcacataattgccaaatacatcagttgtcagagcaatagcattggtcagtatctctggaaagattttttccctgtcatcagctgaggcaacctctagtttttgttgaataaaacgacttccaaattgatccatactgcattaagataagaagtagataatgtgacaaagcattaaagttgaaaatctacaacaggagaatggaagagaaatgtacctaacttccataacatggcccactacattaacaagctccaagggacaagcaccacttctatttgcaagatccaaagaagacagatccaggcagtttgctacaggattatcttggtagatttgtgatcccatatttctaccaggtgtcctcctactagaggataacatccgcgattgctgatcaccaagatatggaatgcccctcaaatgtgaataagcatgggaccctgatctttgcattcttgaatatggaaaacgaggtccatcatgatatagtatgttgtcattatatgagggaccagattttgactgaaagacattatcttcctgcaaacaacgctgtgcaataagttcttcaaggaaatggttcctactcctgattaagtccaagtctgtgatgttgcgtctgtttctcaaggggttgattatatttaccatatctgcattgctatggtaattattctcgtcaagattgcttagctgcatcaaagctagttgatcagcaagagataggcgatccacattcttcatgtgatggttattattccttgaaacatagggactatccataatactgttctgcctgcgtagaagaccatctccatatgaaggtagtgaatgaacatccaagtgctcacaaccaagcgtacacaaagcattgccagataaaggagaacggcagtcattggcaatcttagaggaaaaatgcctgtcgtgattacgcatttccatttcatcaagcaggtctttggcaaggcccctttcatcatattctaaatgattagacaagttcaccctagataaagcatttgaaagatcagagtcagagagataggtggactgaaggtcccttctagcaaaagcattcatctttcccatgtttggcatgaagcgattctcggcatgcctatgaaagtcagcatcatctgttttggtctgtatccatggggaaccaacattaactgcagagtgatccagcatagcgccaacactatgaacccgggttggtccaaattgctgtccattaaactctctcgtaccattaaggtggaggcctggtgctccattagataatgactcagaatttccaaaatgatcctacaacaaacgaaataaattcaaattcaaataaccaatgcataaacatcaaacaaaacgtaagtctggaattggtgttgttgtattggactaaatagctcatcagccaatcctttagctcctctgagccatgcacattaattaatatccaaccgaaatgagagtcaatctcatacatgcacagggcagcagttaattctttgacagcgaagaatttatggcggtatacgcggagtcaaaatggaacccaaaactaaaatacctgggcagaagggctgcgatctatgtatctggaaaacacaggagcaaacacccaagaacatggatggatgtttttataaaaaaaaaaactgaaaacaaatgcacatcaacaataaattgcaaatcaaatatacaaaaacaaacaagcagattattttacaaactttagttcgctcactatgggccaaacggcaatcctcaaactctcctccccatccctgtgaaattccccaatccagcaaccaccaccatctccttttgatctcattgaaacagagaagagaccagatggacggtgactctgtgaatcactggatcttaagcagtggaagcaacatgagtgggagatacatattgtgtgagatcgcatgggtcctgcaaatcacacacaggttcacacttcacacacgaagtaacccacatgaagtcagatagaacatttcttatcttccgttagaaatttaggaaccgcaaaaaaatatccagaggaactgttgacagaactttctacaggaaataatggacagaaactatcactagaaacttaagaaattgttcagagaatctttccataacaaaacattgcatagcaaactttccatcaaaagatcattctacagcagatcttaaaactttcttaacaaaacttagaaactatcttcaagacaactttctacggaatactactttctgttgaaaaagcttgttagtaccaagtacaaacttttattcaaaatctaaatctattcgaattaactatcatgaagtgatgatttttttaaaaaaaaaaagtattggccaatgtggcacgctgcccctcaaactccaacagtcaacagagcggccacccaggaacaaaaattgaaaacatgtgtgcaggaaaaacacattaaacattcaatggacacaagtgttccacgattaggaattatgcatgactggattgaggagattacatagcaaggagcaactaggttcatattctctcttgattttgggcatttcatctaaacaagtataagtatctatggggaaaaataaacacccaaacaaataggtccaaaatatacttaggcatatacgagaatgggaactgaaaaggctcaaaagcaatttatgtacaagctatataataaatgtttacagcacatacagcctggtaagataattacatgatatttacgacatataagaacagaaatagcaaattctaatggcaggaaaataaagcctatatataattaacagaggaactaaagagcccaatggttcaactaagttgaagttgtctccatgagttaatcgaagcaatccactgaacatcaacatgatgaaagcacaaagataacacaattttcatgtgagttctagaaagatagctaacaagcataataagcatttagtagttctttaaggacgccatatgcactagtatggcatgggaacccatattttgcggaggaaaaaagtgaatcttttggccgaaagacattggttttacaacttttaacaattagtagcaaacttgaacgtacataggcagcacaaccgagagaaccaacatagataaatcaatagactaaagccacacaggataaattgaaataaaaacgatatgacaagaacaccaccaaacacttcatccaagcatccaaggtacagaacttaaaatccaaaagaactaacaaagaaaaatttacctacatagctacacctgaaaaattgcaacatgaacccacgcgagcaaaagaaaaaaacttcttttcataatttcgctgcgcatgattattactggaacgattcagcccatcagactgatgaaacccctaacaaacccaaaccaaataagccatgccaacaaagctcatccaagaatcgaagaaaagagagatcgataaaaatcggaacaacccaaccccacaacttgcatctgtcaggacacacaatcagtaaaacaaattcaagaaaaagaaatcacgcttcgtgcacataccacgcaccgccatccaatctacaccacgcgcacaactcaaaaaaaaagaaaagaaaggcaggaagccaagaaccgctcacctgcgcggcggcgccgcgccgccggccgacctcgtcgagcctcgcgccgaacccatccatcccggagaagaacgacccgccgccgccgcctccgccgcccccgtaaaccccctccacctcctgctgcgccaccgccgaagccgccgccgccgcggcgccctccatggtcggcggcgcgctgccgctcctcatcgggtcccacccccaccccgcatccccctccctcttctcctcctcccctccgccgccgccgccatcgccgaagggagccatcccctctctctcccccacaacgcgcgcgcaagcgaaacgaaaactcgcgtgtggttttgaacccaaaaccccacccccgcggtcgcgccgaaatgggtgggtgcggtttttggggtggtggcggcgccgagttagggttagggttttggttgggttttagggcggagagggtgggggcgcgcgggcgggagaggagaggaggggagggaatggaaattggggcccaaaatctggtttttttggggtggtttatatagagagaggatttcaggttgtgggtttgtttccttcagcttaaacctggagataaataaagaaagaaaacccttttctttctgataattccgtgcagtttttttttttggtataggagttacatgatgggactgggtagattcatagacactggatgtggggccagggtggtcgtgttttttttcccggtcagtgcttgggcccaactgtcagtgatgttgtttaaggtgggtttgttcgagtggatttaaattaataaaaaaatatgatttctctttttctaatataatataatacaaagaaggacgctgatatacatacactccctccggttctattactctttacgttttagacaatgtaacagtctcaaaatatatctttgactatattttttattataatacatataataaataaatatgaatacattgttatagttacttataagataaatctatatatattgttcttgagtctttaaactaattatttttaaattcattgctagtcaaagttataaaagtttgacctaacgttatccaaaacataaaaaattatgtaaccggaggaagcaaatgctattgtcgaaaaataaacacttatatgtagaatagattaaaacaccaaagtagtgtattgatttcttgatctcttccctgcatcatactactaggttatatttatatttataggtttatatagctctaactacaaatccaagtatataggtttttacatgcttatcttgtagatatggacatgtatagggctggttgtgtctttccacttcatattcagcttccaaggttatcctaggccgaacccaggtcgttagggagctggcttttttggaaggtcacttttcagggcaggccttcggcatcatggccccgacggcctcttcctgtcccagcgacagtacgccatcgatcttctgcagcgagccggcatgtttgaatgccacccaactgccaacccggttgatgctcgcgccaagctctccgcctaggagggtgcccccgtcgccgatcctactgagtacaggagcctcgccggtgcgctccagtatctcactctcacccgtcctgagatcgcctatgtcgttcaacaggtctcttcatgcatgaccctcgcgagcctcacctcgccttggttaaacgcatcctgcgctacatcaagggctcactctctgccggcctccacatcggcaccgtccggtcggttctctgactgactactccgacgccgactgggccagctgccccgactctcgtcgctccacctccggctactacatcttcctcggcgataacctggtgtcttagtcctccaagcgacagacgacggtctcatgctccagtgccgaagcgaagtatcgtgccgttgctcacgcggttgccgagtaatgttggctccaccagctactccaggagttgcatgctcccatctccactgcgactgttgtcttctgcgacaatgtcagtgctgtctacatgaccaccaacccggttcaccattgccgcaccaagcacattgagatcgacatcctttttgttcgggaaaaggtggctctgggataggtccgtgtgctccatgttccgtctacacaccagttcgccgatatcatgaccaaaggcttgccagtgcagttatttacagattttcggtccagcctttgcatccgtgagcctctcgctgcgactgcgggtgggtattaggaatactttgccatatatgtacagattgtattgtattgtttctttccttgtattctcctctaattgaggatcttgtacatgtgcttcctatatcaatacatggtcacccctcccattgggtgtgaggtgttctccccattccattctacacatacaaggacacgaagcaaatgtaggcaaaagggtaaagatgatttccaaatgagaaacagtgtctacggaaagcaaagtttaatcccaacgcgagactttaggcactagccagcccgctgctcctagatgtcgctctactgtgtactcctagatgtcactctgctcctagatgtcgctagagtagtaattaattgcatagacacggtctctaggttgttaattaccagtgattgctgcgtatcccacagttcgttagaggctggtgtagaggtggtgatagcccccaagatcaccgtagtcctccctgtccgggtacgaagtagagcgtgttctggtagcagcaagcaagccagtgcctgaagtattgagataggattaaatttaagctttctgtagacactgtcctcacttaggaaattctctctaccctttgcccatctttgccttgtgtcattggatgaacttgaaaaggaactagacacacatgtttcctgtggaaaatcgatgccttggaatagtcccgggtgaagtgctacatcgtagcaccctgcgcctgtggattttatttatgaccataagaaataccaacacttaccagtattgactcttgcttattgattattttgctgcttaggttgagtgatgcgggaatcatggatctttaggatagttcttactaggtgtctatccctagtcggtttgcctgtgtggtaagggcaggcaggttttccgctgaacttctattgaccggtcaactgcatatagatgatttagaccaatgtttctagctattcttaagttactttaattcgtgccttcatgtttctgatatcttggctaagataacagtgtgaagctagcaacctcctgagactagccgatcacaagttagagttttgagcaattgagatggtcgtgaaatttagcgatatgagtcaagtcccctgatgtaatacatttggtcgtcaccttcgagtagtttgatgggcatattttaagttgaagttgactgtcgggctattccatcgaagatctcctgtgctcactactcggtgctttgggttttatgttgtgtttggtgtttcgcatgctagatcaacgatgaggttggatggttactactattattatttaggtttaatttaatatcccatccaactaaatatttcatgttgtcatacttagtagcctactcaatatctagcccaggtgtcctgacaagagttgaatccatggaagcctaatggcgatggtattttttagataaattaacttgtgatggcattttgtgggactaacattcgtcgatggcaaaacatggaataaggttaatggcaacacttagaatatctcatgtaacattgccccctgtaaagaagttacttgacactcgactggagaatgacacacacgaaatggacagtcatggataccaaaaaatgatgcatgtcaaaattgaatatgccaaccttaccatgactaacaaaacttacacaaagaaaaccaaggtgggttcaccctaatgtcctcccttttgcaaagcacctcagactaatacacctttgagatta

SEQ ID NO: 9387 - DNA, 7141 bp, Oryza sativa
cagcagagcccaacaacaatgatgaatacacatagcagtacctgcaagagatggtattcatgtttattaaatggcatatttccaaaaaaaatgagcttgaatattgaaattatgggattttggttcttgcatatacaaaaagaatgctaattagttcccactgaaaaatccagattgaattggtgaatagcgacgcgtaattaatgaatatccttgaactctttgaactagacagatcagtctaaattataagatccatttaatcttcagattgttccattacctggattactatatacatatatgtattcatctattcctggcagagcatactaatatctgttgcatattgtgaatatgatcaaattagtttcttgcaaatatgatcgaattgtttcttcttcaagccttgttgacctgttgtaagaaaattaaggaaagcttgaagactactgcataatttacttggaaacagtacaggatctttgcagcttgtgtttgtctgcatagtcatctgaattgatccccaagacttcctttcaattagtcgggaagtaattaagcattttcaacacaaattcgcaaaaaaaaaaacaaacgttgcccaagctggagttttgatgtcgtccacataaggtgagtaaaattaattggttgcatgctactgagcttttgcgaaattccccattggttttatgacaatgtataggtatctgtatattgaccggcgtgtaatttagatagtgggtggtagacaatcagacatgggatgaggtaaactttcagcagttggaaaactaacatagtaataatttctatattgaacaactatcaaattgaagtatttgagcaattcgatgaaaataattcttatttgtacctgataccaagtcactgttctcctaaggattgccaagaagcatgcacatggtagaatatacgcctaaaaccaaaaatatgtatatataaatggtataaacagcatgactaagacccaaaaaaaaaaactgaaggaaagataactcaccacaaacatggtgaggaaggacccaactagtgacataacaagtcctgaaagggctcaaaaacatcaattaaatgtgaagattagaacagaaaataagcaacatagtcattttggaaagtactgatataagtgatgagaaggacttaccgaagaatggaacagagagagccacaatgagggaagatagcacaagtgctgatctaagcatgactatgtttgagtatgtctgtcgattaggaggtagcaactcctccatactaagggcaagaggagtcatggtcagtgcatatgtggttattagttaaggatatccaaactgcttcctccaattcatatttagcttttgtcctatgtcaaatttctctaactttgactgagtttacaaaaaaaattatcaacatctacaacatcaaattaatttgtttcatttaatccactgtgaaatatatcttttatagtgacttttttgttattatagatgagaagtttgacttatgacaaaagcaaaaacggcttacaacatggaacaaagtatgaaacaacattatgagaaacttgaattaaatatgcttttttacaacctaataaattgaaaatcttcttattccgtataattgaactagctatctattagtttgtaatgaactgccaacatgttgttcaataatgacaaagtagcgtgggaaaataggtgtaaaaaagacaaaataacacagtaaggatatttagttattggatttgtcacctgcaagaaaaagcaaagtatacactatcagtagagtacaatattcctaataacaacattaagtattagaagctataccagatgttacagagaatgctaaagatgactgaaataaagagtcatacataacttaattttactcaatcatacaagtgatgcatttatgtcaacattgtactagatgtcatagcttcctctaatttagacaagaacaataccgttgtccagacggcaatcttggaagctaccagattagatggcaagttcaatgtgaactgagattctgttgattcaccaaacattatgtatcccataattgcagcaccagcaaacaaaacagtagataatgcaatgctgtcaagaaaaaaaaacataagcaaagcttggcatcactgttttttaaagaacttatgaatcacagacatttgttctagggttattaccaggtgaaaataacagcagggaactggctgcgtttcttcatggaagagtagatgttagggaacactccatgacctgagtagcagtagccatacaacccaacggcaatgggaattcctgggagattcagtgctgtcccttcatccttggcctcaatgtgatcaacaagtccaacccagaacaggcaagcaacaatgactatagatgcaatcactcctccagctataacagaatgaacaagatgagatccaaggcacattgtgcaccccttttttttcccgattatatgtatgcgcaaacaccacacttgcacatccgtttggtgtgtgtccacatatactcaaagtaacaaataccagcagcatatccttggcccactatttttttttttttgaaagagtacttgtgtgtgtgtgtaatattcaataagttcaagttttgcaaatatatttggtgaaacaaaggattccggtgacaagtgttgatacctgaaatgaagcttagacagctgagatcgcgaagccaagttgttggcatgacaatcagagtagtcaggattgcgaataatatatgcgcatttattgtaaatgtcccaatggtcaggtgtgcattggggaacaactttgacaaattatcactctctaatatcagatactcaatgcaacaggcctgtagagaaacattaggaccaatgaatatgttgccaatattctgtacaaaataaaacagaatggttcaaagttcaattcatctgttctttttaacactacaatgtagaatgctttacggaataaagttgttccagtcttaacatacaattctggtatatttgatttatgataacctttccagcttctattcttgcataaatttcaattttcagtagggttaatgcttgactttctttttctgaaaccaaattgctccactaaactcaatattctattacaaaccatttagtaatacattaatttaactctttctgtaaattgcgttactaatttattcgggagagagtaatgtttttatagcatcaactaataatctaatacaaatacacaactaaactgaattgtcagtaagaagtacttacaaacagttccatgtatagaattacctgcaggttgaaagacatcagaaaatcagagttaccacagaatcatcatccatggaacaacacaatgaaaacataacaaatttaaactgacagtttaccgagatgacgatgcgaccggtggtgccgaaagctgcgtggccaatgtccgggtaggtctcaaggccttccttgctgtccaggcagcgtttcagcaggatgccggtgtaccatgccaacacagccaacagagccaatataatcagcccaagccagccaccttgcttgacagcataaggcgttgataggacccccacaccacacaggacattcactcctgtatatcacagaattgaaatagagaatcatattgctggattgacatatactgtaaattttaacagagtaattgatcttctcagttctcacacagacctggaatttcaactgtaacagatgaactgaggctgcaaatactatatgagattcaacttgtactagacattaatatattcaaaacctagagaaactaattcagcagtgaaactgtgttcttctgtaaggaaaatgaatttttgtatggtgtttggtataattacagtctgaaattacactaagcagatggtaggatttaagtgtacttacactctgaaagtctgtttaatagaaacactttcatattcatgtttgcaatgaggtgtttcctgagaatggaaagtcttgtatatggaaaaaaatatccaaattgttctataataataaagaatgtctcatcttttaagaagaatataaggcttatccttgtttttctaagttatttaggtttagtaaataaaattgttctattgatttagaaaaaacactaaatccatactcatgtcacataatcccttggtaaaaatatttgatgtttaggaaaaattcagttatgtttttttaaaaaattttaaccatcaacagttcctcaaatgcttattttagaaataaaagaaatgatatacataaatttgtctcgaaaaatactatcacagtatcataaatttactagatttaataaacttattattgcaatataaattgaatattggaatttcaaaagttttactgaatcttatcctaaacatcttggatggaccgaggataatgtggagattcgtttttatgggagatacgatgttggtcaagggcataagtatatattaaatgtgataggtcagttggaatgggaagtttactttgatttggtaaaagagtctcagtttagatctctagaggtgtttgcatcaaagttagttcgtaccgtagaaaatttggatctaaacaaatctccttcttatcattacgttgagaagaattttgtgacatattattctcgccgtggagggggtgcaagtaagagtgagttggtacgagaagacttggagggtgaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtattcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatgttgaatttgctgaagactctgatgatgaccgtccattccctccacttactaataatgacaagttagcattagaggaatgtcgtgcgtttgagaaggtgtttgggaggaagccggacattcctgagtttagggacctaacacatgcccatggtgcactagtagatggcggcatcaacctagatcagttgccagaaccattccaggtggatggtctcagaaagggtttagagttcccatccatggtcgcattgaagctatggctccaggagtacgccatcgtgcaccatcgtccataccgtgttgtcaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgtccgtttgcccactttgctgcaagccattaagcagaggaatcccagtatggtctaccacatcgatactcatcctgatagggttgtcaacgttgatggagtgaccaagaaaatttttatgcgtgcattctggtgctttggtccttccattgaggcttttaagcattgtaggccagtactagctatagatgcaaccttcctaactgggaaatacggtggtgccttgatgactgcattatcagctgatgcggaggaccaacttgtacctttagcttttgccttggtggagaaagagaattcacgagactggtgctggtttatcgatcttgtccgacgggttgtggttgggccgcatagagaggtttgtattatctcagatcgacatgctggtataatgaatgccatgatgactcctgttccaggattgccatcggttcaccaccggtggtgcatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatggccgccggtggggttacatgacaaccaacatggccgaacagttcaatagcgtgctagttggtgttcgtaagcttccagtgacggccatcgtatcatttacgttcatgaagtgtaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgataaggaatctcccaaccgaatgccgtatcagttctcttcaagagccgttgtgaacacatgggcaagtcgctttgagccatacctcgaccccacacagtggccatcgtacgatggtgaagaatttgttgctgacccaaatttgaagattaaaacaagagggaagaggagatcgaaacgattcaagaacgaaatggactcaggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtcccaaaaaaattt

SEQ ID NO: 9388 - DNA, 955 bp, Oryza sativa
cgcttacatatgtgtttataaaacagaagttaatgcattaacattatttaaagtacaaagattgatgacaattacttcgaaaaattatttttgtctgtaataaattaagtggataaatcgtaataagcaaatatatgacttataattaataaaaattccaatatatatatattcttagcatatatatgaatgatattattatattggtaaaactctaattaagatattaatgtacatactgcatgatttaaaattaataaaaattgtaatcatcatatgtacttagcgtaggaattatattaaattaaatgctaacaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatgtaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaacatatacatgatttaaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgttccctccttgtgatcgctgcgtgagtaaggggtgtcttcatttgataggaggatgct

SEQ ID NO: 9389 - DNA, 134 bp, Oryza sativa
tgcgatccagagcgcgccaacatcctgaccatcatgcaggaggtcggggcgtcgggggagcgggccccctgaggccacgatggcgcggggagggggtcgtgcttctgggccctgcgaccggggcccggggggca

SEQ ID NO: 9390 - DNA, 1798 bp, Oryza sativa
cccacctacggccggaacccccgggacatgcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtgaaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccattccaaagtgtccaggtgatatgaatatttcccaaagtctatagttgaaaaaccacctaatgttacctaattaaattgcgaagcatctacctaaaattaaactagtggtgccatgagtagagtgtccactagttgaggttttgtttattctagggtgaacaaggtaataataacaataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgtagcgtctacacgaccaacggaaaagaaaaggcttttactctaataaactccatataacagcagaaacaaagcataaaaatgggttcttggcttcataaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagagaggggcgcgcggaccgggtccacgggagtggggcccacgcgtcagcctcatggtccacggtggaccgggcgcacgcggctgacgccggctggcgccgtgggtcccacgcgtcagccgtacccgcaggcgcgggcggctgacggccgggccccacctggcagccgcggggcgcgcccgaaggcggcctcgccggcacggccgacgggaggcggcgcgcccgcgcccctatggtcgccggcggcggccataggcacgcggagcggcggccgagagaggggagggaagggggaaacgaaatggcggtcctcggctcaccccgggtcgacggcgatgacgggaacggcgaccaaagcggagagaggcggcggcgcggctcgggtcgacgaggacggcggtgctccggcggttggcgggcgaaacggaggagtggacgaggtcgacgagaacgcggcgaagccgaaggaggcgatgccgaagcgggaggaggtacggggcgacgacggcggcgaaccggagctcggcgccgacggcggagagagaggacgacggcgcgagctcgaatccgacggggagagagtgcggcgagtggcggaaacggaggagagaggcacggggagcgtttaaatagcgtcgggagtgagagagggcggccggaggggaaggaatcggccgcggaaatctcgggctccatcaatggcgccggcgaggtttgcgggagcaaatccgaacgaatccgagggagagagagaggggaaagagggggaaaagagggagggaatcac

SEQ ID NO: 9391 - DNA, 2128 bp, Oryza sativa
caagccttatttgacttttaaatttgcacattttaattgttggaggctttcacatgaattttaattattctcggcataattttgaggatgtattttagagtcgttttgggacgcgacaaacctaccccccttaaacggaatctcgaccccgagattcggaagaactggcgaagagatcgggatgggctgccttcagctcgtcttcacactcccaagtagcttcttcttcggcatggttgctccactggaccttgcaaaaacggattacccggttcctggtcctgcgctccatggtgtccaggattttcactggcctctccacgtatgtcaaatcttcgcgaacttcaatttgctctgagtcggcctgctcggatggcactcgaagacatttcttgagttgcgacacatgaaacacatcatgcacgttgcccaaggaggcgggcagctccaactggtaagcgacttctccacgccgagcattgatacggaaaggacccacataccgaggtgcgagcttcccctttgtctgaaacctgtgtacacctcgcaatggcgtgacccgaagatacacaaagtcatccactgcgaattccaggtcatggcgtcggttatctgcataacttttctgccgggactgtgccacctttagattatcccgaatgattctgactttagcttcagcttctctcaggatatcagtcccgaacacttggctttctccaacttggtcccacaatagtggtgtccggcatttgcgcccgtacaacgcttcataaggtgccatttgtatgctggcttgataactgttattgtaggagaactcggcataggggagactcttatcccaggtcttcccaaaatctagtacacatgcgcggagcatatcttctaggatctgatttagacgctcggtctgtccatctgtctgcgggtgataggcggtgctgaaatttaatcgggtacccagctcttcttggagcttcttccaaaagtgagaggtgaattggcttcccctatcagatacgattttcttgggaacgccatggagactcacgatcctagcgaagtagagctcggctagcttgttccctccataggtggtcttcacaggaataaatcgagctaccttggttaatcgacccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaagtacatctttgtactgcccgggtgaatggaataagggctctcgtgagcttcctgaagtatcagctgtttaagttctctgttatctggaacgcatacccgctttccgttccatagggttccgtgttcatcctctgtgaaaccagcggctttaccctgtttcatattcttgaggagtccatgcatgtccggatcattcttctgagcctcgcggatttgatcgagcaaggtaggcttggcttctaacgcagccaagaatccgcgaccaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcatagtccttgatgagttctaaccatctcctttgccgaagattcagatccgactgggtgaagatgtatttcaaactcttatgatcggtatatatttcacagcgattcccaatgagatagtgccgccagatttttagagcatgaaccaccgcggctaactccaagtcatgtgtagggtagttgccttcatgaggtcgtagctgacgtgaggcataggctaccacatgaccgtcctgcatgaacacgcaccccaatccttggcgcgaagcgtcacaatacaccatgaaatccttgcgagtatccggcaagattaacaccggcgaggaaacagcttttccttgagggtttgcaacgcc

SEQ ID NO: 9392 - DNA, 9334 bp, Oryza sativa
agcgtccctgcggccttgaccaggctgcacagttggcgtaggaggacggggcgcacgagtcccttgctgactctgctgttgctgcggctgtgggacgcgcaccacgaattgaggtcgaggcgcggagcgaggttgctgctgctgttgttgctgctgcgaggaggattccccgggatagggattggtgtagcggaccctttggttagcaccctgttgattgcggaaattcgccaagcggcgcttgtgcgactccagttccttgtgcttggcttccaaacggatgctcttgtccaccagacgttgaaaatccggatagtccccagagactagacggacggacagctcggggtccattcctgccaagaacttctcttgcttctcctcatcttcccgcacatcctccggggcgtaacgggccagattgttgaactcatgcaaatactccatcacggagcggttgccttgcttcaactctcggaattcccttttcttaagggccacgactccggcgggcacatgggttctccggaaagcggcggtgaagcgggcccaagtaataggttgcccctctggctgcgtagcctggcaatggtcccaccagagagatgcgggcccctgcagctggtgggcggcgaagatgactttctcctcatcgctgcactgcaccgtgtctagctttttccccacggcatgcaaccaatccaacgcatccacggggttgttggagctagagaaggtaggtgggcggatgcggaggaactcggcgagtttagagtgttgtgggggtggtggtggggcattatgttgtggcggattttggaggtggtggaggaaagcagtcatcatgttggcttgctgggcgaggatttgggtgagaatggcgttggtgtctggtggtggtggtggaggcggaggaggaggtggaggtgggttgccctggtggttgtggttgctgccttcaggttggttgccatcaccggtggcagcatttctcctggtcgtcaccatctgaaaaccccacacagaaccagcaaacagagaaagagctaacaattaacgctaaccacgactaccataattcttgaatttattactgctattaaattggttcattaaaggttcaagttgcttaggcaaataaaataagacaggctccgacatagttatgccacacaccggcataaccatgccccacacaacccaacgagaagacaaacgaggaagaacacacgcgcaagcctactaactgctcgtctaccgctgcgacgggccagaacggaaggtgagcaacagcgcatcctccgtgctaccaacgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcatgttgttctcgaccatcccacgacgcaccatctggtggaagtcgatacgagccgcgtcgtacgcctcaaccatgcgcgccaggtgcacgatggtagcgtcatcctccgagctagcatcccggaaggtggcgtagtcgcgggctcctccgcggcgggggtggtagcggtagggcgagtgctgcaactcgtccgggtagcgctggtgaagagtgccgatggcgaggagagcggcgttctggcaagcggcggggaaggaatctccacccgcggtgactgccagcgaagtccgctcgggagagccagagaggatcactgcagtgacctcccaaccagcgtggggctccgcgtcgtcaccctcctgctccggaagcggcctggcctagtagtccactccatgtggataccccaagaccacgcacatgccccgcagctccaagacgaagccagtcatgtccaaaccacgacgggtgacgctgccggccatctacaaacaaaaacaaaaagaaaagcaacattttaaaggtcagattttggcgataaatgaagcagcaagacagagagagactagacagttttcacaaataacaaaggatttttatttttgaaaatattgctaaggcttgggatctacggctcgtcctagggtcaagggtggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgagaaacagcggaagactagggcgacgaccacaggcgcttgacggcaggcacgagctagacaccagagccttcatcttcaaggagctcctcttctgggcttgggaaaaattgagcaagactgagtacaaccaccgtactcaacaagacacacccacaaatgcagaataaatgcaagggagtacaaaggagttataccataaagggttagggttgcaggaaacagcatttaaagatatttagttgctcaaagctattttgtaaacgcgatcctagaactatacaatattattaatcaaggccgtgaacccacacgaacctgccttaacccaaggcctatgatgattcagaccgaactggcaacccgaccctgggtcccagctcgtcccaagccaacccaggccaaccattccacattttagttgttaagcaggttttaagaattgaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagaatgtccatcgacccccgacttcatccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaatccaattccacaaaaaccagaccattccaaagtatccaagtgatatgaatatttcccaaagtctatagttgaaaaaccacctaatgttacctaattaaattgcgaagcatctacctaaaattaaactagtggtgccatgagtagagtgtccactagttgaggttttgttcattctagggtgaacaaggtaataataacaataacaataataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacagcagaaacaaagcacaaaaatgggttcttgacttcttaaggaaaaattagagacttgaacggtccaattccgagttcaaatggccaagttatggccatttgaagtttatatgctctttaaatggatatttgcgaatttcttcatttaaattttaattaaaaatcggatttattgcgtcagccgagggaggggcgcgcggaccgggtccacgggagtggggcccacgcgtcagcctcacggtccacggtggaccgggcgcacgcggctgacgcccctacggtcgccgggaggcggcgcgcccgcgcccctatggtcgccggcggcggccataggcacggcggagcggccgccgagagaggggagggaagggggaaacgaaatggcggtcctcggctcaccccgggcgacggcgacgacgggaacggcgaccgaagcggagagaggcggcggcgcggctcgggtcgacgaggacggcggtgctccggcggtcggcgggcgaaacggaggagtggacgaggtcgacgagaacgcggcgaagccgaaggaggcgatgccgaagcgggaggaggtacggggcgacgacggcggcgaaccggagctcggcggcgacggcggagagagaggacgacggcgcgaactcgaatccgacggggagagagtgcggcgagtggcggaaacggaggagagaggcacggggagcgtttaaatagcgtcgggagtgagagagggcggccggaggggaaggaatcggccgcggaaatctcgggctccatcaatggcgccggcgaggtttgcgggagcaaatccgaacgaatccgagggagagagagaggggaaagcgggggaaaagagggagggaatcacggggagtgatttccccctctttatggcgcgcggggacggcgggatgcggcggattcggcggcggcggcggcgctagggcacgggcgggcggcgggagcggcggaaggtaggggatgacgggtgggccccacccgtcagcgagggtggcgggcgggcccgcccgtcagcggcgcgcgcgcgggggaaggccgatgggccgcgggggagaggagagagagggagggagttgggccgagccggcccaagaagggagggggggaaagaagactttttagggtttttctttttataaaaccattttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcataattttgaggatgtattttagagtcgttttgggacgcgacaaacctaccccccttaaacggaatctcgaccccgagattcggaagaactggcgaagagatcgggatgggctgccttcagctcgtcttcacgctcccaggtagcttcttcttcggcgtggttgctccactggaccttgcaaaaacggattacccggttcctggtcctgcgctccatggtgtccaggattttcactggcctctccacataggtcaagtcttcgcgaacttcaatctgctctgagtcggcctgctcggatggcacacgaaggcatttcttgagttgcgacacatggaacacatcatgcacgttgcccaaggaggcgggcagctccagctggtaagcgacttctccgcgccgagcaatgatacggaaaggacccacataccgaggtgcgagcttcccctttgtctgaaacctgtgtacacctcgcaatggcgtgacccgaagatacacaaagtcatccactgcgaattccatatcacggcgtcggttatccgcataacttttctgccgagactgggccacctttaaattatcccgaatggttctgactttagcttcagtttctctcaggatatcagtcccgaacacttggctttctccaacttggtcccacaatagtggtgtccggcatttgcgcccgtacaacgcttcataaggtgccatttgtatgctggcttgataactgttattgtaggagaactcggcataggggagactcttatcccaggtcttcccgaaatctaggacacatgcgcgaagcatatcttctaggatctgatatagacgctcggtctgtccatctgtctgcgggtgatacgcggtgctgaaatttaatcgggttcccaactcttcttggagtttcttccagaaatgagaggtgaattggcttcccctatcagatacgattttcttgggaacgccatggagactcacgatcctagcgaagtagagctcggctagtttgttccctccataggtggtcttcacaggaataaatcgagctactttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtttaagtacatctttgtactgcccgagtgaatggaataagggctctcgtgagcttcctgaagtatcagctgtttaagttctctgttatctggaacgcatacccgattttcgttccatagggttccgtgttcatcctctgtgaaaccagcggctttaccctgtttcataatcttgaggagtccatgcatgtccgggtcgttcttctgagcctcgcggatttgatcgagcaaggtgggcttggcttccagcgtagccaagaatccacgactaactatgcttaggttcagggcttccatctgttgattaagttcgggtggaatgccacggacgttaagagtgtggcaatggctttttcgacttagagcgtcggcaaccacgttggccttaccaggatgatagtgaattcccacatcataatccttgatgagttctaaccatctcctttgccgaagattcagatccgactgggtgaagatgtatttcaaactcttatgatcagtatatatttcacagagattcccaatgagatagtgccgccagatttttagagcatgaaccaccgcggctaactccaagtcatgggtagggtagttgccttcatgaggccgtagctggcgtgaggcataggccaccacatgaccgtcctgcatgagcacgcaccccaatccttggcgcgaagcgtcacaatacaccatgaaatccttgtgagtatccggcaagattaacaccggcgaggaaaccagcttttctttgagagtttggaacgccttctcgcattgcgggctccacacaaatttctcttctttcttcagcaactgtgtcatgggtcgagcgattttggagaagttctcgatgaatctccggtagtatcctgccaaacctaagaaactgcgaatttgggtgactgtcttgggttgcttccaatcggtgacggcggtcgctgtttcggggtccacagcaactcctttagcagatatcatgtgccctaagaatttgacttcggacaaccagaactcacacttgctaagtttggcatacaattgatgttcccgcaactttcccaacaccagacggagatggtgctgatggtcttcctctgattgtgagtatatcagaatgtcatcgatgaaaaccacaacaaacttatccaagtattccatgaacactttgttcattaagttcatgaagaaggcaggtgcattggttaaaccaaacgacatcaccgtgaattcatacagtccgtatcgcgtggtgaatgcggtcttcggaatatcctcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctcttcgtcttgtctttcttctctacaaaaatcacaggagcaccccagggggaagtactcggacgtatgtaccccttttctttcaactcttccaactgtttctttacttcggccagttcatttgctgccatacggtagggtcgcttgtgcagaggagtgattcctggagcaagatctatccggaactcaatctctcgcttgggcggcataccgggtagttattccggaaacacatctccgaactccctgacgatggggatttctgacagtcctatctgatgaagttctgaacttttgacagaggttgggggtgcaaagaaaacaaccggttgttccggccctcggtacagagtgacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcatgacccctccaggggtggtgatgagcagagggttcctaagcctttctacccccaactgatttctccccacgaatggcacagatataaacgagtgggaagctccagagtcgaacaaaatggtagcaggaatggaatgaacgaggaacgtaccaacgatgacgtctggagttgtcagcatgtcctcggccgtcacatggttcacacgaccccgaatgacatccttcccaccgttgttggagcggggaggcgcttggccttgctgacgcctcggctttgggcatttatccgcaaagtgccccggctcgaagcagttgaagcacagacgttgcggaccttgagtgtccctgcggccttgaccaggctgcacagttggcgtaggaggacggggcgcacgagtcccttgttgattctgctgctgctgcggctgtgggacgcgcaccacgaattgaggtcgaggcgcggagcgaggttgctgctgctgttgttgctgctgcgaggatgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaagccccagcacacacagagacaaacgagaaacagcggaagactagggtgacgaccacaggcgcttgacggcaggcacgagctagacaccaaagccttcatcttcaaggagctcctcttctggggttgggaaaaattgagcaagactgagtacaaccaccgtactcaacaagacacacccacaaatgcaaataaatgcaagggagtacaaagga

SEQ ID NO: 9393 - DNA, 15642 bp, Oryza sativa
aattcctgcagccccttctcaattattatttgtgctctgaaaattccactaaaatttatttacgcattttaggcttttaggaaatatacaaaaatcctccaagccttatttgacttttaaatttgcacattttaatttttggaggctttcacatgaattttaattattctcggcataattttgaggatgtattttagagtcgttttgggacgcgacaccggccgcacggcgagacgatgctcaatcacctccctagggaccccgggcatgtccgccggtctccaggcgaagacgttggcgtttgcccgcaggaaggagacgagcgcgtcttcctatttgttgtccagaagaccaccgattcgtgtggtcttggacgggccgtcgcccagggcaacctccttgactgggacctcgtcgcacgtgaccatccgctgccttggggcggccgggacggaggtgctgagcctctcgtcgccacccgcgggcttggacgccgcggcgagatggtccgcgcgctgctccatacaagcaagcgcgactttgaggtcgccatggtcggtgatggggccaccgggtcccggcatcttcatctgaagataggcgtagtggaccgccgacatgaacttcaccaacgcgggcctccccaggaccgcgttgtagggcagactgaggtccgccacatcgaagtccacccgctccgtgcggaagttggcggaatcaccgatggtgaccgggaggtcgatatgacccagcggccaggtgtgccccggcgtcacaccgatgatcggctgggacggccggagcaccatccctggggccttgatggcgtcaaaggctgcgggggaaaggatgttgagggctgcacccccgtctatgaggacacgccccaacttcacattgcaaatggtgggggaaaccaccatcgcgatctgtcctccccgggcaacgcacggcgggtggtcggtctgtgtcgcgaccgagaaaattgccttttcccgaacgctagtgtattaatccccgtctcaggaaaagccggggtacaccacacaaacatgatataaaagacacatctttattatatcgatagtatttacattattacagaggcgcttcaggcctggcgatcaaaaataaatagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcggatgcacgattaatgcaagggggtacaaggggataataataggggttaagttttgcagtaaacagcatttaaaagtcacttagttgcccaaagccattttaaaaagacgatcctagagctacacagtattgttaatcaaggtcgtgaacccgcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccatagacaagagtactgacccaaccccacctacggccggaacctccgggacaggtaggcaggattgagcccctagcagcaggacaccagccctgtgccatgacatctcgactaccgggccgcaactcgtgtagccttcatttgtcctagagatgtccatcgacccccgacttcgtccatctccatccgtgtacttttgtttataaccagactgagccacaaactaagccttacccactagacatgtggaagtacggtaatgctttgcaacagaggcccgaagaccggtccttatatggccgaggtgctactatcaaaaccatgcaccccgagcccagcctaaaaccattttggggattttgaatagagggggccgtgtgaatccaattccacaataaacaaacaattccaaagtgtccaggtgatatgaatatcccaaagtctagagctgtaaaatcacctaatgttacctagttaatcagcgaagcatctacctaaattcatactagtggaaccatgaatagagtacccactagctggggttttgtttattctagggtgaacaaggtaataataacaatagcaataataataaggtcataacaaaggtaaataggcatggctaaataaaacagtgctaaagcaggaatttaaataaagcgataatgcattaatttaaatcaaaataattttataaactgggattcaatatgctcaaggatgatatgacttgccttgctcagagagaacggccttccgaaccttcggcgacgaccacgaaccacgcttcgggaacctccggaacgacagaagctacgcgaagcacacaagcaaagctacaagcctataaagaagcaataacaatacataaagagaaaacacagggttctttaggttataacaaacattaggagacttgaacgggtcgattcagagttcgtatgaccaagatatgatcatccgaagtttaatgctgttatatggagatttgcggattattataattaggctttgcaaccataaaacatgtgtaagcgctagcctggaaaagacaggaaggctgcgccgttgacatgcggaccccacatgtcaacctaaaggaccgcggtagaccgggtacacagagacggtccacgggtcgacggaagcggactccgtgtgtcaaccgaggcgagtagccgacaaacggactccactagacaccacacgggctgcacacgtggaaaccacgcggctaccgagcggacacactaacacagtcaccacacgcacaagcgaacgactaccgacaccggtacacgggtaccggggtcgacaaccgcacaacgggtacggggcgacaccgaaaggacgaggacggggcagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgtggccggcacaaggcttgacgacgcggagccgaggacgaagacgacgacggggctgcagcggctcgcttgacgaacgcggacgacggacgagaacggctcgacggagggacgaacgccacgacgaccgggaacgacgagaggacgacgacgacgacgaccggggccggcgaggaagcgacgagggcagccggcagtggctgcacggagacggggacgacgtggaacacgccgctgcgatgacgatgacggaggcggcgccgcgagacgacgagccgggcgaccgacgggacgtcgacgacgagaacgaacggagacaacgacgatggaccgcggaggggttcggtcgaaggggaggcgaggccaagggcgaccttgccgctgcgatgccggaggtggtggtgccgcggctgactggtaaacaagcgaggaggaacgggcggccggaggactccggcgaggcgggtggaggggttggtggcgacacggcggtgttccggcgaaaccgaggtgtggccggggaaggagacgttgccacggcgtcgacgaaggagatggcgacgtcggccgacgctccgacgagggacagcagccggctggagggagtacagtggcaccaatgccactggttgccggcgggaacgcgtctccggtggtctccgcatgaaacggaggcgacgccggtggaggggaagcagctgcgacgctgctggcggcgacggcgcgaccggacgacgctccggcgaggagggagaggcggctggaggcggccggcggcacgggagagagaggacgacggcggggagaggcggggcggccacgagagagcgcgggagggggctaaaactggagaacgtaccgaggtggttccattttataagatgggggagggagccgggcacgggagagggcggaacggcgacgggaaacacggccggcggccatggaaggcggccgggaaagacgcgtccattcccgacgattgggggcgccattcaagggggaaattgggcgggattgaagaggaatcaatggggattaaaaccccctaaccaattttggaattggccaattgaatcaagcggatttggaggagagagcgagctagggttcgcacgggagagagagaagccgggcggaaggaaggagacgaccgggtgagtgggacccaccggtcgggcgcgcggcgtcagcgcgcgtgcggcgcgcgtgcgcacgcgggagggggagcggctcgggaggctgggtggggcggcttgggccgggcggcggcccaggcgggaggaggcgggagaaggtgggccgggaaagagaggagggaggggcagcccgggagagagaggggaggggaggaggcccaagaggaggagggagagaaggagagggagagaaagagagggaggagagggagactttgggctgggcttggcccaaaggaggaagaggatttatttttaggtttttctttttaataaactctaataattgtttttgttgcttaataattatttccggtactctgaaaattcaagtaaaatttgagggctccttttagaccaaggagaatttaacaaaaattctccgggccacattcgaatttttcttgtacgtattttagtgtttgccaatttcttttcgaattttaattaattctattattccttttagcgaatgatttttaattcgggatgaatttatcaggacgtgacagtctggtcgaaggtgagggcaacctccgaccaccgcgcccgccgcatcgcctcatgggtaggggccgcggccagaagctcgcgcttcatggccttgaggctccggcgagaagcgtgagcgcacgctcccccatcgacggtggcgacggtggcctcaggctcctggaaccccaggtcctcgtcgccatcgtcgatgtcctcggcggtggccttctgcttggcctcacctcgccggttgccggcgggagccgccggggccttgccctcacggcgctcctgcctcttctcctcctcccacttcctcgtccgttcagccaaacttttgaccgcgcggcagtccgcgaggtcgtggagggaggtgttgtgcacggtacaccacttgccggtcgggcgctccctgctaggagcgccggcctccttctttttgtcgctcgcaggcctccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccgaaggagttccaggtccaggcctcctccttgcgagccacacggtccgcgagctcaaaaagctgcgcggtggtctggggctccttggaggcgatcttctcgagcatgcggttgtgccgcacgccccccctgaacacgtagatgtcacaccccgaagttttcctcccaagccaaaaattgaatttacaaatgaccccaagaaaatgcaggtgaaatcaggaaaaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttctttttcctctctttttcctccttcttgtcaaatgggccgtcggcccatttcccttttcctccccctcctctttgttgggccggccgcaggccgaggcccagcccggcagccggccgcccgcctccctcctctctcggggtcgccgacaggtggggcccacctgtcgggcccgtctcccacctcccgccgatcccggcgcgccgccgcgcccgcaaccgccgccgcgcccacgtctccgccttccccgggccacgtcgaccacgcccgcgcgtgcgccgcatcccccgcgcccgttcccctctctctcccgctcgcgcccgcgcccgagatggccgggattcgaaaaccgaatcccgcctctctctcctccccactcccccacgtcggccggcgaatcccgcctcttccggccacgtccggtcctctctccccctatttaagcatcgccggcaccccctctcgctttttccccatttcgccgacccctcccgagctcccaatcgtcctcgcgccgtgcaaccacccgccgccgccgtttttgctacttcggccgccgctagccgccgctaggctcgccgccgtcttgcgccgtcgccgccgttagattcgcggggtcgagatctacctcggccgccccttccccgttgaggttcgccgccggagacccatccccgtcgtgcgccagtgagtgacgccatggccgccgccttcggccggcgctctcgctctctcgcgctcttccctctccctctaatccctctccttttgttcattaggaggttccggagctcgtcccgccgtcgccatcgtcctccgtcgccgccgtcgtcgaccgttgtcggtgaggccctcctcctcgttttctctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgcccggccgcgagctcccaccgccgtccgatctacccttgggtagatcggggccgtcggttcggccgccacgtggcgccgccgccccttccatctcccgtgccgctgacagtgggcccgcgggccgacgcctcctctctcctccccgtgccgctgaccggtgggtcccgcatgtcggcgccgcactcccctgtgctgacgtcagccctggttaatattgcgcaataaatgatttaaggtttttcttttatagtaataaacacagtgaatcttctaaaaatcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgctctattgttttctttcaaatgttgcattgttttataatattactatgggatggttacctattgttacagccatgtttttggatatcatgctcctttgttagcttggggttataacatgattagagtttggactaggaattgcttagccatgcttagttcaactagttcacaatggggaaaatcatattaatgtttagactgttggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaatgtggatagtttaggtggatggttgggcctgtcgcaacgtgggttagcgttggacggcggatgtttaatactgcttaattattacaaccgttttcgcattcaattcctgtttttaaatgccaatatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccggaaaatggggatctgttcttgtggttcgagggaaaaatcttggtcgctcgtttaagcggggtttttcaaaacaagtcagtctagggttttagtaaaattattgggatttattcgtcagtcagttggggtttgatgggtgaaatgcattaggtcctagctctataacatgggttgcaaggtgtttatgcttcgtttgttattattaatatgtatctaatttctcattattttatcgttatgtgagtctgtcttatttattcgctctcatgcaaaatgatctatgcacgaaaatttcgcttttattcgtttcccttatttgagtcttttattgctttatttaaatttggatttgagcatgcattgatcctactcctttgtcttctctagatggccggtcacccacccaaccaccgcggagaaggcatgatcgacttcgtggcagagctggcacgcatgacactggtggtgggctatcccaacgcgccagagtacacgaccatcccaccgctcagtggcgagcttcctcaccgtgtccgcttggaggtccatggctacgtggggacttgcctcgctaacatggcggtcgaggcatctggaggcacagtagatcacgcctgtcaggaggcggcctacttgatgatggccaggttatgggagcgccacgactacatcttccacgacacggcgtaccgctaccaccctcgtcgagcccatggtgatggcgtcagctccttccgtccgacagctggcgagaacgacaccacctttggtcacatgtgtgctgtgatgaggggattggataggatgcactcggacctgcacaaggcgaccaaggccttgaacgatgggaagctcatgaggatcgtcgctctgaaggacgagatagcgcgcctgaagaaggagaatgctcagttgaagggtcttccagcgccaggaggagtccggatccgcactacgccccgtaagaggacgactgcacctgtgcgcatccagcttgcgcccaggaacccacctccagcagcagctcccgcagcacctccagttccgcccgcagttcctgcagctccagctccagctcccgcgttcactctctccttcgctccagcatcagccgccagaggtccagccagtggtaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgattgtctagcttctgtttgttagtttgtgtgtttaggttgcttgtttggggtcagtcgacggtcgatatcatgtgcctatgatatggctgtcttaataaggatttttgcttgctcttttgagtgttttaattcagatcagaacaattgcagttttaattcctttgtaataaagcttagttcttgagcatctgtttttctccttttcccccgtctgcttttccctccagatggtctacaccaggactggcaaccgcacgacaggcgagggcagcaacggcgaagaacgcgccgatggtgtgcaccccaacagtgattctggcaatggtccgccaccacttcccgagaatccgacgcttgcccaagttatggcacatcagactcagatgatggcagccatgatgcagcagatgcagcagcagcaccagcaaatgcaccaaaggatgatgcagcacgccgaacagcagcatcaacagtttggtccccctccccctcagtccaagttgccagaatttctacgcgtcaggccacccaccttctccagcaccaccaaccctatggaggcgaacgactggctccatgcaatagagaagaagctgaatctcctgcagtgcaatgatcaggagaaggtcgctttcgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaaccggactgtgacagagtacctccacgagttcaatcgcctcgcgcgatatgcaccagaggatgtccgcaccgacgccgagaagcaggagaagttcatggcgggtttggatgacgagttgaccaaccaactgatatccggggactacgctgactttgaaaggctggttgacaaggcaatccgtcaggaggatcagcgcaacaaaatggacaggaaaagaaaggcggcgcagttccggtccaaccaaggtagtcagcaccgaccgcgcttcactcccggacagcagggtggacctaccaccatgatcgtccgtcagcaccgcccgttcaactccagcaacttccaccagggcactagtggcagtcagaaccaccagggaggccagcccaaccgcggtgcagctccacgcccaccaatggcaccggcacagtcaggccagcccgcgcaagccaagaaggagacgggagcaaaaccagggtcctgcttcaactgtggcgagcttggccacttcgctgacaaatgcccgaagcccaggcgtgccgggccaaggtttatccaggctcgtgtcaaccacgcgtctgcggaggaggcacaagcagcaccagaggtcgtactgggtacgttccctgttaactcaatccctgcaacagtactttttgattctggtgcaacgcattctttcatttcaaagaaatttgtggggaagtatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcattgattgtgcgaatcgcacagtcaccttgaccaacgagaagggagaaaccgtagtgtacaaatcaccagactcaccaaagcaaggagtctccttgaatcaaattgaaacggaaatcccagtggacaccgtggagaagaacttgagaaaattggaagatatacccatagtctgcgagtatccggaagtgttccccgaagacctcactaccatgccacccaagagagagattgaattccggattgacttggcaccgggaaccgctccaatttacaagagaccatacaggatggcggccaacgaattagcagaggtcaagaagcaagttgatgagcagctgcagaaagggtacgtacgaccgagcacttcgccttggggcgctccggtcatatttgtggagaaaaaggataagacgaagaggatgtgcgtcgattatcgcgcacttaacgaggtcacaatcaagaataaatatcctttaccgcgaatcgacgatttatttgatcaactgaaaggagctaaagtgttctctaagatagacctgcgatcaggctaccaccagttgagaattcgggaagaggatattccgaagacggccttcaccactcggtacgggctatatgagtgcacggttatgtctttcagacttaccaacgcacccgcattcttcatgaatctgatgaacaaagtgttcatggaatttctggacaagtttgttgtggtgtttatcgacgacattcttatctattcaaagtccggagaagaacatgaacaacatctccgtctggtactcgaaaagttgaaggagcaccagctatacgccaagttcagcaagtgtgacttctggttgacggaagtcaaatttctgggtcatgtcattacagctcagggtgtggcagttgatccgtcgaacgtggagtcagttaccaaatggaccccacctaagaccgtgtcgcagattcgaagttttctaggactggcgggttattaccgccgattcatcgaaaatttctccagaatcgcccgacccatgactcagttgcttaagaaggatgagaagtttaaatggacagctgagtgcgataagagctttgaggagctcaagaagaaattagtatccgcaccagttttgattctgcccgacccgactaaggacttccaagtctattgtgatgcatcccgtcacggacttggatgtgtcctaatgcaggaaggcagagtggttgcgtatgcctcgcggcagttgcgtccacacgaaggaaattatcccactcatgacttggaattggcagcagtggttcatgctttgaagatctggaggcactatctgattggaaaccgctgcgaagtatatacggaccataagagtctgaaatacatcttcacccaaccggatctaaaccttcggcaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagttagagccgctcaagtaaatgatccggaaatagcagagctgaaaaagaacatgagagtcggaaaggctcgggacttctttgaggatgagcatggcacaatctggatgggagaaagattgtgtgtacctgacgacaaggaattgaaggatctgatactcaccgaggctcatcagacccagtactccattcatccaggcagcaccaaaatgtatcaagacctcaaagaaaagttttggtgggtcagcatgaggagagaaatagctgaattcgtcgcactctgcgatgtttgccaacgagtgaaggcagagcaccaaagacccgcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtatctcgcaaggatcatgtgtttgcatggggtacccaagaagatagtatccgaccgaggtagtcagttcacctcaaagttttggcagaaactgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatgcggaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaaccatcagggaaaggttgaggattgctcagtctcgacagaagagctacgcggataaccgccgaagggagctcacttttgaggccggagattacgtgtatcttcgtgtcactccgctccggggagtacaccgttttcagacgaaaggcaagttggcaccacgcttcgtgggaccatacaaaattttggaacgaagaggagaagttgcttatcagctagaacttccatccaacatgatcggcatccatgacgtgttccatgtgtcccaattaaagaagtgcttaagggtacctgaagaacaggctgattcggagcacattgatatccaagaggacctaacatatgtggagaagccggttcgtatacttgatactagcgaaaggagaaccagaaataaggtcaccaggttttgccgtgttcagtggagtcatcattcagaagaggaagcaacctgggaaagggaagatgagttgaaggccgcccatccgcacctcttcaccagctcctccgaatctcggggccgagattccgtttaaggggggtaggtttgtcacaccccgaagttttcctcccaagccaaaaattgaatttacaaatgaccccaagaaaatgcaggtgaaatcaggaaaaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttctttttcctctctttttcctccttcttgtcaaatgggccgtcggcccatttcccttttcctccccctcctctttgttgggccggccgcaggccgaggcccagcccggcagccggccgcccgcctccctcctctctcggggtcgccgacaggtggggcccacctgtcgggcccgtctcccacctcccgccgatcccggcgcgccgccgcgcccgcaaccgccgccgcgcccacgtctccgccttccccgggccacgtcgaccacgcccgcgcgtgcgccg

SEQ ID NO: 9394 - DNA, 2310 bp, Oryza sativa
gcggtcaaccagattcaccgtgattagtctcaccctagtgtaatcttttgaatgtggatagtttaggtggatggttgggcctgtcgcaacgtgggttagcgttggacggcggatgtttaatactgcttaattattacaaccgttttcgcattcaattcctgtttttaaatgccaatatttatgcaaatgaaccactttagctcttctttgttaattccctgcatcatacccctattccggtatgacttgctgagtacagtgggtagtactcagtcttgctctacttttctgtcacgcccagaaatttagcccaaatttccagactattttgtgtattaaatccctgtccaggaccagccagggtacacaaaacgacaagtaatatacagttccaaacgtaaataaagcgtaaaatacttacagaaaaggcacttagtcctcacaccgaaacaaaaacagcagcagcggaaaaaggcgatcctagcggggcttctgctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgcattgggtcgatttattaagatgggactaatcacggtgaatctggttgaccgcccataaccgcgggcgcggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaagatacactacaagtccagccgttgcccacgctggcttgtggtaagtacgataagttcttccagggcatcccgcgaaccggtccttaactgccatgggtgcgactagcaaaaccatgcacccacagcccaccattcagttgcattttagttggataattacgaccatgaagcatggccaggtgtctcgagcacgcagctcactctgatactaaaaaggtctaatattgtaattatcccatcaactgagctagtagtaattaagcatggctaagcatatagttctagctaggtcacataagtaacatgagctagtcgatttattacccaatgttgacaaaggatagatatcaagtaaacatggcacaagcgagcagataggtaaaccctgatcccgtgtaattagcaaaacatgcatatttatttgcaaacagtaaaacatttataaattaggatcaaaatgctcaaggggaatgtgtgacttgccttgcttcttcactttgatcttccgaactcttttcctcgcgaccgcggacttccgaaacgacggaaactacacgctggcacgcaaaacgagaaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattattatcgaattattgcgcaattattaattatttttacaaaggaaaaggatctcgctgacgtcagcaaggggcagccggcgccgacacgcgggccccacacgtcagcggcactaagaaagggagagggggcggctggcaggcgggccccaccggcagcggctcaagggcgccggtccaccgtggaccgagaccaccgaggcggtccaccgtcggtccacgggaaccgacggcccggatcggcccaaagccgatcggacggccacgaggcggcgcggccgagaccgacccggccggccatggcacggcggctacgcgcacgcggccagacgaccaccggcgacggcagcgcgtcgcggtggcgggcatggggagcggcggatggggaa

SEQ ID NO: 9395 - DNA, 3493 bp, Oryza sativa
  unsure (1)..(3493): unsure at all n locations
acgggaggcgacgggaacggcgttcgacgacgcccgaccacggtggagccgcggccgagggccggcaagacctagggaaaatattggagcggttagggagagaaataggcgaccggagcggtgaggagcggtggtttgagacgacaacggcggtagcggagctcgggtcgacggcggaaaggtggttgcggcgatgaaatggggaaacagagcagaggccgaggtagagcttggcacagcgttgccgacgacgcaaacgacgaggtgcggcgacgactaacgcggcagcagcggccggctgaagacggcggcggcggggaagagaggtggtgcacgaggcggcggtgttccagaggcggagaggggaaatggagtagaggccgggctgcggcacggcgccgcgaagccgacagtggtggcggattggcgcggcggtgggtggagcggcggaatcggccggccggagctcgccggaaagcggtggtgcacgggagcacggtggggaggtgtctagggagcgcggggtgctcggggagaggggaaaacggatgaagggaggcacgtgagtcgtttatataggtcccggagggggagaacgtggccgggagaggcggatttgaagggggaagaggcgccggcgatgtgggcgagtggggtggttcggcgccggttttggagggggaaagtgggggaggagagcggggtcgtgggcggcgaggtcccacggacaaacgcgcgcgcgcggggtggaggaggtgggcggaaacggcggcgacgtgggcggttttcggcggccatggcggcaacggcagctgccggcctgaggttggggatgaccccgacaggtggggccgcgggtcccacctgtcggccaaagaggagagggaggccggctggggaggcaaagtagacttcggggaggagagggccgagcggcgagctgggccgagggagagagagggcccgagagggggaggaatttgggccgagcccgaaagcaaggaaggggaaaaatattttcttttctttttattttaattggttaaatgaactttgtgactttaaaactatttctcgagctccgaaaattcacggaaaattccggagagtattttagggcacaaagaatattgcaaaatattcccggccaatgatttttaagggaaaattttaattctcccaataattcacttgattaaattgcttaactttttatttaatttctagaaaatgcattatttaatgatttttaatcccgaacgaaaatcggggcgttacaaatctaccccccttacaggaatctcgtcccgagattctgggatggctagaaagaaagctggtgtaggctgtcggtttgactgatctgacgggtctgcacactgcactgcccctttctatcttgaactgactgattgactgattgatccaacctgcaccattgaaatggctggattcgacctttctattcctttgctttgccaaaactaggccggctagttctgcttgaactgacccagaccagaactgtggctgctcacgaaacttacttatcttgatctgaactgttgatactggcagtttgataacctgacgattcaccaagctggctagagaagggtgaagttgttcctaagacttgcatctggcatttgtaactcattaatcctacgtccgcttgaacgggtcctggctcgaatgacacgtaattccaggaaacctgcttgacctgtcttttgtctgaactgcaaccgtccctgatgctgcttctcaaagctgagctattgacctggcctcaccggtgtacctcagaattcaatcagataacttgagattggtgtaactctgctgacaccttgcaactggcttcttcaagtactacccggattgttgcactgggttgaaccttcaactaaaacagcgacgaagtgagccaaaactcatctccgagacctaccccccttacagggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactgtaggtagcatttgttgcctctgggattggtggtgacttagctgtgctggtctgctgaagacttggtggcgtactgtctgaggttgcaggtgcttcctctttgaaaacaaactggctttggctccgatcctgattccggcttgcatctgagtttgtacttgttgttggagacattgtcgttgcatctgccgctttggactctgcggttgctatatcaatatctggcacatccatcttccaatcttggttaaccagagcgaggtgctctgtcttagctggtagcttgttgtcttgaactgatccactgactctgactgcaacacactactgctggagttatttccgctacatttgactaggtatcgaacctgcttctcccacatcgaatacacccatctcctgatcttggacaccaaaagttgatcatgagcagggttcatctggcattggggcaccttgcagctttcaactaaaccattgatccgtggctttagtacaccgtcgttgctcttctctctaacactgaccatctgctgccagaacggaagagaggtggaagagaggggttgctaaagataaggtactaaaccacttgtctactgatctgttgtgagtagatttttatggtttaagttgcttaagcaaacaacctagtatggtcgcatccccaccaatgatgcaaaccatacccctacacacaagcaaacaacacacgatctagaaagctaacggaactactcttctgggaaagattgggtttaggtcatctccgagaaaacttcacttgatcttcgcagaacgacgactctgaactgatcttctcgctccttgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9396 - DNA, 250 bp, Oryza sativa
aattcctgcagcccctctcacgcccagagatgcggcggcagcggaggaggcggaggcggcggcgaggacgacgagctcgagacgacggcgagatacggcggcgtcggcgcggggatttgccctaggcagtggcggcgaaggagagaggccgagagagatcgatcggccgaaaacgtttaagtgttggtgaagaagacgagggcgcaccgggaatatatatacccccggatctttactcccggttgttctc

SEQ ID NO: 9397 - DNA, 1061 bp, Oryza sativa
ggttgtataaaaagaaaaaccctaaaagtcttctttccccccctcccttcttgggccggctcggcccaactccctccctctctctcgtctcccccgcggcccatcggccttcccccgcgcgcgcgccgctgacgggcgggcccgcccgccaccctcgctgacgggtggggcccacccgtcatcccctaccttccgccgctcccgccgcccgcccgtgccctagcgccgccgccgccgccgaatccgccgcatcccgccgtccccgcgcgccataaagagggggaaatcactccccgtgattccctccctcttttcccccacttttccctctctctctccctcggattcgttcggatttactcccgcgaacttcgccggcgcatcaatggagcccgagatcgccgcgccgatttccttcccctccggccgccctctctcactcccaaccctatttaaacgctccccgtgcctccctcctccgtttccgccactcgccgctttctctccccgtcggaatcgagcccgcgccgtcgtcctctctctccgccgtcgctgccgagctccggttcgccgccgtcgtcgccccggacctcctcccgcttcggcatcgcctccttcggcttcgccgcgttctcgtcgacctcgtccactcctccgtttcgcccgccgaccgccggagcaccgccgtcctcgtcgacccgagccgcgccgccgcctctctctgcttcggtcgccgttcccgtcgtcgccgtcgacccggggtgagccgaggaccgccatttcgtttcccccttccctcccctctctcggccgccgctccgccgtgcctatggccgccgccggcgaccataggggcgcgggcgcgccgcctcccgtcggccgtgccggcgaggccgccttcgggcgcgccccgcggctgccaggtggggcccggccgtcagccgcccgcgccctcgggtgcggctgacgcgtgggacccacggcgccggccggtgcaagccgcgtgcacccggtccaccgtggaccgtgaggctgccgcgtgggccccactcccggggacc

SEQ ID NO: 9398 - DNA, 6099 bp, Oryza sativa
cctgtgtcgcgccctatcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcaggaacgcccgttgggttatttccggtcgtgacagccgggcgcaaggccggtccggcagaaagtgcggcggcaggccccggaacgtcaagccttcatccgcgaggaggtggcgcaacttctggaggccgtattcatccgtgaggtcatccatccggagtggctggcgaacccggtcgtcgttcctaaggcgaacggcaagcttcggatgtgcatcgactacaccgaccttaacaaggcatgtcctaaggacccttaccccctgccatgcatagatcagattgtcgactccaccgcggggtgcgaccttttgtgttttctagatgcatactctggttatcatcagattcgcatggctagggaggatgaggaaaaaactgcattcattacccccataggaacttattgttatacaacaatgcctttcgggttaaagaatgcaggccctacttttcaacatactactcgaatttatttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttcttgggttcttggtctctgcccgaggcatcgaggccaaccccgagaagatacgagctatagagcggatgcgcccccccagcaagcttagggatgtgcagtgcatcaccggctgcatggccgccctaagtcgattcatatcgaggctgggagagaaggcactacccctatttaagctcctcaaacgctccgggccgtttacctggacggaggaggctgagcgggccttcactcagttgaaggcgtacctcagttctcccctggtcctggtcgccccggagccagatgagccgttgctactctacctagcggcaaccccgcaggtggtcagcgcggcgttggtcgtggagcgcgacgaggacaaccctcactccgcacatccccaccctgtgtcgactcgacccgggagagagcagggaggagaggcccccaagccgaacggcggcccaaggcccccgacggccggagctggccctccgcctgcttgtccgacggtgccaggcgcccccgacccccaggatggccccggggccactgcgggaaggccgcgcctgtcgccctctgaccccgaggtcatcagcacagaagccgagtgcgccccgcgtggcctctcggacgaagagcgccctggagatgcggcccctagcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtggttacgacttaccccctcggccaaatcttgcataaccgagagggtactggacgggtggtgagatgggcaatcgaactctctgaattcgatttgcgctttgaaccacgccacgcgatcaagagcgaggccctcgccgactttgtggcggagtgaaccccagctcccgagcccgtctccgcccccgaggccacctcgggcccctcgcagctgcctcacaccgcctactgggtgatgcagttcgacggctccctgtctcttcagggcgtcggtgcgggggtcacgttgacctcgccgagcggagacgtcctcagatacctggtccgcctcgactttcgggcgaccaacaatatggcggagtacgagggactccttgcgggactcagagtggcagctgaactggggatccgccgcctcctggtgttaggcgactcccagttggtcattaaccaggtctgtaaggagtaccagtgctctgacccgcagatggacgcttacgtgcgccaggtgcggcgtacggagcgccatttcgacgggatagagcttcggcacgtgcccagacgggataacgcggtcgccgacgaactctcaaggctcgcttcctcgcgagcccagaccccaccgagcgcctttgaagaaaggcttgcccagccgtcggcgcgacccgaccccctaggggagacggacgcgcctgaatggcccccgaggcccgtcggagtccaggcctcaggacccgaggggagcgctcccagctcccctagattgattgcttggatcactgagatccaggcgtacctcgcagataagactctacctgaggatcgcgaagggagtgaacgcgtccggcgcatctccaagcgctacgtgctggtggaagggaccctctatcggcgcgcggctaacggagtcctcctgaagtgcattcctcgggaacaaggcgtcgagcttctcgccgatgtccatgaaggcgagtgcggagcccactccgcctcacgcaccttggttggcaaggcctttcgctagggtttctattggccgacggctctcaacgatgcggtcgacctggtccgacggtgcagggcgtgccagttccacgccaggcaaacccattagccggcccaggccctgcagaccatacctctttcgtggccgtttgctgtctgggggctcgatatcctgggtccgttcaggcgggccccgggcgggttcgagtatttgtatgtcgctgtcgacaagttcactaagtggcccgaggcttatccggtcatcaagatcgataagcactccgcgcttaaattcatgaggggcatcactgctcggtttggggtgcctaaccgtatcattacggataacggcacccagttcaccagtgagctcttcggtgactactgcgaagacatgggcatcaagctctgcttcgcctcccccgcccaccccagaagcaatggccaagtggagcgcgccaacgcggcaatcctcaagagcctcaaaaccaagaccttcaacatcctcaagaagcacggggactcgtggatcgaggagctgccagcggtgctctgggcgaaccgaaccacgccaagccgagcaaccggggaaacccctttcttcctcgtctacggcgcggaggcggtcctcccatctgagcacaccctgaggtcccctcgggtcactatgtattgtgaggctgatcaagatcagcttcgccgagacgaccttgactatttggaagagcgaagacggcgcgcggccctccgagccgcgcgctaccagcagagcctgcggcgctaccatcagcgccacgtccgggcccgatcactctgcgtcgacgacctcgtcctatgccgcgtccaaacgcgtgctggactgagcaagctctcaccaatgtgggagggtccgtatcgagtgatcggcgtcccccggccgggctccgttcggctggccacgggcgacggcacagagctgcctaacccgtggaacatcgaacaccttcgtcacttctacccctagtgggggtcgggtgtcatttcttgggctcgggccaaccccgcacccccccgggcgtgcagggttggccgggggctaccacatgcatatacttaccttttttctcttccgtatttcaataaaagcattttcgatttcctgaggactgtgtctgtgccatcgtttccttttgaagaatcttggcttgaattagcacactcgttcccgaccctgccctcggtggcccgggccggctaaaatcgccaaacggggcccagaaccgagccgtgccccggggcgtagtgaactccgggggggaatcggcaaaggcccacaatcgggtcatccataaccctcggtcaccgcgctcccggcctggccagtctcgacacgtggatcttcccaggcactagccccgacccgcgccgtttgaggctgggacctgggcacgagcccttgttcaagccaagacacagaaggaccgcggcacaggccatcctcgtctcatacacacaacaaacagaactgacgcagaaatttcttctttacttgattgcagaataaatcagtctatacaagaagggggcccgaaggcctcggaagaagaaggaaaagttattaagattggtgggggcctgggggctcactccgacgcgcccgggtcgccggcctcgtcgtcgctgtcgtccgcactgtcgtcaccgccctcctcgtcggagtcgagcgcgaacgcgagctgaggggccgtaccctcgaagctgtggacgatgtggtcggcggcgtcccggacctgcgcgcgcgcgccgtcctcggttccgggagggaactcttccagcgctgcccacggggagaagtcagggtccctggcctggtaacttgccagtacgagctccaccgccccccgggcgaggtctctcgaggatgacttgatcgtctcctcgagctcctcagggagccgcttgagggtcccggccatctctgagaggcgctgggcgaggcccccctggttggcggcgtacttcgcgtaccgcccgccccagaggcccgcctgccgcccggcgcagtctagacgggagacggcgtcccgaagcatgccgggccctacctcgctcgccaatcggagggcctcgacctccccggcggacgagtccagcgcgcccggcagctcggcgatggtgtgttcagcggctgcgaggcgggcggctaggtcgccgtcgcccgcggccgccccgccgctgtgcgctctcgcgtccagctccttcgcccgcgcctcgagctctgcggcccgctgatccagtgcggccctctcggcgcgggcgccttccagattgcggcgcgcctgctcctcccgcgctgcctcgcggaggaacaggctgtccgccagccgctgcgccgtagcctcggcctcctcgagagctcgcccccgctcggtgagctcgtcctcgcggaggcggagtgcggactcctcttcggcgcaggcggcctcgtgcgccgccagtgttgcttaccgggtggcgacagcggcctcgcggtccgccaggtctctctccttcgcgtccagggcgcgggcgcgctcctccagctccgtggcgcgagcctcaagggcctcttcgcgctgccgggacgccgcctcgttctccgccgcccgccgttcccgggcagcggcggcgtcgaggactccccgggcggcgatgagggcactctcccgctcctcctccacctccctggcgatctccgccaggtccctacgacgggcctcgagttgtgaggcgtgccggcggtgtgccttgcggcccgcctccaccatggcctccaccgagcgccgcccctcctcgacgcgcgcccacgccgcgtcgagctccgcccgctccgcctgcagggcctccatctgggcgcttcacccgtccagcaccgtgctgttcgcggcggccaaggcctgcaggaggggctccgcgctcagtggggcagcggaaggcagaggggagagccgcctcggtgtgggtgctgcgcggctcggcccgccgatcgacgtgccggactcgggggcgtcccccgaagctggctcgtcccaagcgtcgcccgaggggtcgggctcgagcggcgcgcccgcggcctcgtcgtgggtggcctcggaagtcgttgtcgcctcgggcggagtcgggtcgggggcttggcaggccgcctggcgtgcgcgcgccgcctctgcctcccggatggactccccggcccggcggagtctggcctcctcccgagcgacctcctcagcctggcgaacccggacggcctcctgggcagcctcctcggcttcccggaggcggtccgcggcttctcgcgggtcagcttcctgcctccgggcctccgcggtcgccgtctcctcggccacagaccggccggacttggaatggcgggggggggggggggggggcgacgggatctagctaaggcagaagaaaaaccagaagacaaaaagaaacgggtaagtgaaaactcgcct

SEQ ID NO: 9399 - DNA, 1052 bp, Oryza sativa
gtacggtgaaaaaccaccggaacagccggagagatgggcgcaccccgataaacatctcgcacaggtgcgcgaagatggccaacgtcattatcgcgttgggggtaaggtgcgccatctggagatcataaaactccagaatatccatgaaaaaaatagagaatggcgggaccagccccgccattgcaaaagagaggaagaagacggaccgccccgggtagtctggcgccgggcatcccttgcccagcgcgaccacctcccggccggtggcagattccggcatgaatcggcgcggcagcccggcctgcctctcgctcacgatgcaggaaggcggcagcacgctaccatcgagcagtgcggagccccgtgccatgacgccggcggaggaggagcttgagagcgagcgagtgcggcaagggtagggcacaggaaacgaagagttagagcgcaagtggcgaaggcaaggggaagagtggcgagaggaaggaaacgaatcccttcctcggcgtctttacacccttgccaacgctatgcccggctcctcgcttcccgcgcgcactacctcgccccctcgtttctcgcgcccacgcctccactaaccccactcgcccgtctgcggcgcacgcggcagatgtgcggccgtggcggttgagatggggcagatcgtgcgcgcattaactacgctcgccaaccgcggaaagcgccatcatcatgtctccaggcgaaacgaaccggctcgtcccgattcgcgcgctactcgaataatgtagcggtcttaaagaggccgctcattattgtcagtcggttttcccttgccgatgcgcgcgatttgcgaccgctgggtttctgcccgcctgtagggaccggccccacctgtcaccgggcctaaggagtggcgtcacgcccgagtgcttccctcgaggggcgcgatcgccctggcgtaatgccgggggctactgtcggtgacatggggccgggggtatcgtgactagaggcttgggtagccgcggtcacccacgtggcctgaccccctcgggggggggggggcgggcccg

SEQ ID NO: 9400 - DNA, 1934 bp, Oryza sativa
gagagcttcctggctctcgtccctagctggagccggcgtgctgactcctggagttggtatgtcagtcccggtcagattcattccaggcttcagcgcaagtatggcaaggaagtcgctggccattaaatgaaggttgaaatgggcgtccacgggaaaagcgggcgagcggggcaggaggcgtgtgctctgcttgtcagaagtcatttccggctgtagactagccctcattgtaaaaagcatgtttcctttcttaggcagcgagaggcccatgtggtgacccctgaccagataaaaaggaggcccaggcctagagggaggaaaaaagaagaggagggaaaaaggagcaggaaggggggttgtgggactctggcgaacgggttctagagcctgaactctctctcgctctccggctctctgtattccttcagacacagatccaccagaacacaggagtagggtgttacgcatctcagcggcccgaacctgtctacgtcgcccgtgtcttgtgcgcttcctctctcgctgacgttcctcagatcgagggcgaagaacctcacttagcgcccccggccgaaccggcaaaggggggcctgcgcggtctcccggtgaggagccccacgctccgtcagagctgaagctattgctagaccattattccactgctgtttttttttcttttataagtatgtaacgttattattatgatggatttgtatattaaattgtcagtttgtgtacctcggctgattcctggacgaggattttatgcacaaataagttcggaaattactagtgaatttccgggcgtgacagattatgtggtacagatttctggggattcagttatggctaaagggaatttggatttttgaatagaagggattgaaatggtttcttagcacaagagaaattattctggaaatattattcttgtgccagaaagaatcaaaccttgggtatcaaactggcggtttgatttatagatagaagaatttggataatggaatatctagaggaatttgtggaaggtgttgtatgaaagagaacaaggatttctaaagataggtctagatcaagggtttgatccagaataaatttcagcaaaaaggaaattatactggtttagccccaaggataaaatggttaatggaatataacaaagagtcgggtcaatcagggaattattggcccaagctaaatagtagactttgaaatcttgagtggataatttagatgaacgagattttaaagggaaatatttgtgggagtatagaactggattcagaagtatatatggatgggaatttctacagatggaattggtggtagattgataaactctaagggatgggtatgttaacttaaagggggattgaagagtatattttatggactctgggaatattgagatgaaaaggaaaggtattaactctgaggaaattggaaattgtctatgtactctagggaggttagagaatgacatttcatatactctggagatagttgagtgaagatcaaaaggaaagtattggttctggagaaaataagaattgatatttcgtgtgtttgggtagagatcaaaggggaagtattttgtggaagataaaactggatttggtggtagtggtaatctctaaatgaaaaggtattaactctagagagattgatatctcatatgctctagagatggttgaacggcaattgaaagggtatttgttggaggtgttcgggaatggattcaaaggaaatataattttgagtcaaagttaaagattaaagaaaataaataaataggtttttataaaattaaaaagggatttaaaagagagcttttaatttagtaaataaaatctagatccaagttaaagaaaaggttaaaagcaagattattccaatggaagaatcgaaagagcataacttaaaatatttcgcaa

SEQ ID NO: 9401 - DNA, 7082 bp, Oryza sativa
aaatcgactgcaaattgatatgcaagtttctatgcgggcctatcaaatgcagggttagccatctcatccggctacttatgggcaataatgtggcttaatttgtcgagacaaataatgtgtatttaatcagtgtgcaaattgatatgtaagtttttctataaatgtagggtcaggcgtctcatctgtactcggtagtttgattttggagtgtattttttacattttggactttttcaaacttattttacaaatatacccttaaaaatgtcatatttcgaaaatggatcattttcgcaacgccaacatcattgacgccgtttctcttgacttatcttcgctggagagactagagggacaacactaatgtttagtaccgtcatgttagaccatggtatcaatgacattgacgacatgaaaatgatttatttttagaataagctttttgaaaaatttatttgtaaaataagttttcacagtagaccaaaaagtgaaaaatcgagatattttggagtggtcatcatcactccctcgtcgctgtcgttgttgtcatcgttctttaatttcctgtcctttcacgaccatgtcagagaagataagaatacaatacatgcatatccagttactgatatgtacttggttcgattttggagtggtcatcatcactccattgccgctgtatttgttgtcatcgttttcttcgtgtcctttcatgatcatgtaaaaaagataagacttcctttgttaagggcttgtttagtctaaaaacttttcccaaaaacatcccatcaaatctttagacacatatataaaaccttaaatatagattaaaagaaaaaaataattacacaataattatatgtaaattgcgagacgaatcttttgagcctaattaggccatccatgattacccataaagtgctgcagtaatccacatgtgctaatgacggattaattaggctcaaaagattcgtttcgcggtttccagacgagttataaaattagtttttttcattcgtatctgaaaaccccttctgatatccggtcaaacatctgatgtgacatccaaaaatttttatttcaccgagtcctaaaatgtaccccttcatagtatcctactatgtacttcctctgtcaaaaaatcagtgtcaacttcatcatcggcccagtttctcgagggatatatagccattataggacatattgtatagtcaaaactgcattattggtgatatgtgacgcatgacgcatggctacatatcactaataatttagctcagtttgacaagacggatatcgcgtatttaaatcgagtgtaacttgatatgcaattctagctatgcaggcctctcaaatgtttgccaagaagtagtaaagattaatttactatcagaatactcttacaatattagagtacacggccatagaaaacggccacatcaaccaatgtacccatgccatcgctgccgctatcagctctacatataggattctccccctctttctggtggagaaatgatctttgctaggtcgatccaaaaccataatagtctcgattccaaaaaaaaccgggattaaaaatgatctttagtcccggttaaagatcctactaaaaatgtcagatgtatgtcgggggccgaggatctttagtcctggttggtgtcacgccaactgggactaaagatcaccactttagtcttggttggtaataccaaccgggactaaagatcatctagactctcggttggtattaccaaccagaactaaaattaaacgcgtaatatataatccctatcacttatcctctcctctacaatcgcaactcacacagatcaactctctccccctcttccctttcctcctcctctcctctcctacagtctatcctctcttcctcatcccctctcctccacctcctgcccttcctcctctcctccccctcctccccttcccatccggcgggccggcggccgtggcgagcagtggcagcggctttgtttgtctttttttatataatctgtgattcactaagatgtttaaatttgtgattcaatgcatggatctgagatgtataatctgtaatgtatttgatttgtgtgtaattttttaggatttgtgatgtatttgatttttgtgtataagtaactttaagatttatgatgtagatttgggatgttacattgatttggggatttagggtttgatttgatttggggatttggggtatgatttagggatatgcatgccacttgattcgggagaaaataaaaaaagaaaaaaaagaaaaggggatcatctggtactgccgctattctttctttactctcggttgataacatcaaccgggactaaagatccctctctttagtccggttggtccatctttagtcttggattcctattccggttggaaaaccgagactaaaagggttactaaccgggagtaaaaatagtttccacctatatataaagtaaaatatatgactgattcaatatgtcatctgaggtccaacgtgtaacgatcgatcgaatcgccatcgtagcacccactgtggcgagaaatttgtatttagacccctcgtgctatataatatgccttcaagtcaacttccaaacactcccagaccttttgagaaaaaaaattcaaaaatatacttttttttcattggttttatataaatatacaggtttagaaagaaattatagaaatctaatcgtcacgaaagaaagttcaaaatcgcgtgttgccgcacgacttgcgcgagaccgctcagtctcgcgcgcgtctcctgtgtgcaagaccggacttcgcttccctaacctttgattaataaattaattaattagtgtcattagcatttaattaattaatagtaatattttttaataaacatcattagtaattaattaatcggtaattgtctgttaattatccactaatcatgatgccagttgccaggccatctcgcgagcggatgaagcgagaccgtgactggacctacggtatcgcggcaggatttggcgagaccgcggcacggcgtcacgccattgtaattttcgctgaatggatatcgttttgatttcgtactccgacaacggtatatttgttataaaaaatttagggtaattgtgttcttgttcttgctttacagttgaattgtgattttacccctactttttagggtttatgattttgtcctatctttttgaaatgaaggagtggagtgcccctattatgttaaaatttgctaacggtgttacatgggcgacacaacgacgagtatacctcttgtgcaaatatgtgttcacttgtgtatttacccgttttgagttcagctttgaacggaactttacaaatgtttcgaagtgaactttgctatacttggaatttataaaaagtttgactatatttcagcaatagcttaacaaatatcacaaaatttcaacaggattccaacatgatttcagcaatgattagacaagatttcatttcacaaaatttcaacatactttgaaaaaagagatctcactgaatttcaacacaatgttagctagcatcacaaagtccagcagcaccacctgtggtcgtccctgagctccccttcgcgccggaccacactggcctgcggtcgccgccgcgcctcccttcgtgccggccagtggtcgctgccgccacgctggcccgcggtcgccgtctcgcctcctgcgcaccggccagcactccttgccgccgcacaggcccgcggtcgccgcctcgcctcctgcacgtcggccagcggtcaccgccgccgcgctggaccgccgtcgccgtctcgcctcctgcgcaccggccagaggtcttcgccgcctcgcctcctgcgcgtcggcctgcggtcgccgccgccgcgctagcccgcggtcgccgtctcgcctccaacgtgctcgccagtggtcgccgccgctgccaccggttgaatggtcatgttgctgcgccatcgccaccactcgctaggccatgctggatggggaaatacacagcttcaacccgatacacacagctgcttagtgatttactactcaccatgggtataacagtcattgagaaattgcaatatcattttttattttcttttccctttgtttaactcaaaaattccgggcccacctaactcccgtcaaaaccaggggcaaaaggctgctcatttcgaaaaagcaggggcaaaagcacaaaccctaaaaaataggggtaaaatcacaattagatcgcaaagcaagaacaagaacgcaatagctccaaaaaatttacatctccgatatttatgagaaaagaaggccttgtttaattccaaactttttttttcaaacttccaacttttccatcacatcaaaactttcctacacaaataaacttccaacttttccatcacatcgttccaatttcaaccaaacttccaattttagcgtgaactaaacacacccgaagtaaatgaatagaatatttgtagatttactttcatcttttgatgcatgacttgagctataaatttttcagacgttgagaaatgcatatgtgttgattagggatgataggagttgatttttttaggaagtagcagttaattttgagggcataacttcgcaaatagaccaagtgtaaaattcttattaccgtggactgtcacttgagctgcgtcatttaaactttagatcttgagttatacattgaagcaagagatgggtgaaaaggacagtattcatccgagcttaagcaccaacaatgtattttacccatataattgttgggaattgataggctagtgcgaagtggatgaaggatagtgattctaggtaaatcgagactaagaagggttgaaaggactgatactaaagatacatactaagccaaaataatatgtgagatgttgcattcgaactcaaaatctttcaccttagccctcacgcacattaccatctcacctactacacacatctaacttgaatatagatgtttttcttttaaactaactctgaagatatctttactaccatttggtaacatcaaccggttttagaaatatctttagtacgggttgttgttttcaaccgatacaaaaaatgcatctttaatgctggatagtaattaacatcaaccaaactaaagatcatccaacattagtctcggttggtactaccaaccggtactaaagatatattttttattggttgataacaccaaccgagattagagatgtttatagcgatttggacttttagaaacggtactaccggtacttaatctagttgaaatatttatgttttggggctttggataaaaactcgtttgtcaagtagtgactatagtcttctaaaggggtatacatacaaaacaacgtacatattatagtcaacgcataaccacacgcacctgctgagtacacaccaaactggaatttcatatgtacaaaattaaaagaaaggagagaatatggtacttagagtatcacttctgtcttagtctcgtcataaatgtcatcggttgtaactttctgacgtcggaagaaaaggttagtgtctatactagttactaccatattcgtctcataatataagggtttttagcgttggatacggttattaagaaagttggtagaattaaacgagagaatgttgtgattgaatgggatgtgaaggtagatggaaaaattaaatagtggagggttgtgattggttgggaagagaatactagagaagaaattgttatattttggaaaaattttgaaggctaaaagttattatattttggaagggagggagtacctcggtttcatattataatacactttcatttttccctaaataaaatttctataaatttaatcttttttcacgaacgcgtaaaataattgcacgtcaatatattaaacgaatctataaaattaatcaagtttatagtgaaatctaacaactcttaaaacatcaaattagatccattaaatctaatattaaatatattttgatagcatgtttgtttgctgttgaaaatattatcatgtttttctgtaaacttaatcaaaattatataaatttgacttagaaaaaaagttaaagctcttacgaaatgaagggtgtacatgtttgggctttggacaactacatctgtatataagtttgccctcaaatctgagtttaagtgcaccaccttgtggccctccagcgcgcgcatatatatatatatataccagcctttcccacatagatcatccaaccaatagctaaccacgaaagtgcaagtgagactaaccttgtacctgtagtgagtactggtgatgatggctgcgagtaacggagaggaacctcctagcacatccatggcaacaagttcttctccattgcccatggtcgctcaactgatggtcaccacagaccgtgctgtaagccagcagctgaaggatctagtgaataaggaaaactccactaccatggtggcggcgttgtccttaagtagagaggcttatgaggtggcgatggcgttgaagaacggggaggagcatcggcaagggagatgcagcggcaagggagatgcagcggcaatgttgatgatgatggcgtccaaaaaagaagacgccgcaaagccttccactgcgtccatgaaccccctgttgctatcactagcatcgcagggtcgtctaaatgattatggtagtattctttccttacagagattaagatttactaaacggtgtgtttcatatgaaatatatatatatatatatatatatatatatattgctttaaaatattaaatatatctatttgttaagttttcaataattaaaacttaattaatcgtgtgttaatatattctgaacatggaagcaatatatagctgctgctcgagcatttcctaatgatctccaacgggactcttcgggtaatggatctaataataactaggcgattcccatgctctgaggaattttatactttatagttcttgagaaagtatcttgagatatctaaattttatgttcttgagaaagtatcttgagatatctaaattttatgaaaaattttttagtaccttagtagctagtacctataggtac

SEQ ID NO: 9402 - DNA, 9471 bp, Oryza sativa
ataaaaaactaaataatttcccatgctttgatatggaatatatggatgaatcactagaacggtaaccaccatctcaatcaggcggcaacccccatctcagtcggacatggcgtccgtcacagcctagaaatcacagatgtgaaaagttatctcaatcggacaaacggctgtcactaatgaagctatctcaatcaggcctcaattaaagcccgtcactgatagccttgaaccagacgaccagtcaaactatagcccatcacggctgacctatctcaatcgggccacaactagcaaatatctcttatttggtttataaactataaaatagatatgtaaaatttgtgaacaatgttactaacactttgtctgacgaagaaatgaaaaaaataaaaattatagatcttgatgagttatacaactttgttgttgatgactttttagttgaaatcatttagtatttgaaaatgttgtttgaagttgtcatattttcaaattcaaattcaaactgttcaaaaaaaaagttatatagaaaaataaccaaaataaaagttatagatcttgataagttatacaaatttgttgttgatgacttttttagttgaaatcatttagtatttgaaaatgttgttttgaagttgttatattttgaaattcaaattcaaactattcaaaaagagttatatagaaaaatgaccaaaataaaagttctaaatcttgataagttatacaagtttgttgttgacaatttttccatttgaaatcatttactacccgaaaaaataataaaatgaattattatactgcagttaattattttgatataggtcaactcacaaatataaacatttcatatgaaaaatggaaaaatactaagtcatattaatcgggcattactatagttaacggatgagtcatgtgtgacaggcctaattattatcgattgagatatggtcgcacgtacatgttagatgggcataaaaatcaggcccgccactgatgacctctatcagtgacaggccgtagtttaggcccgattgagataacgatccatatctcaatcgggtctcaagttggcgcccgtcacggatgatcatcaagtttagccccgatagagataatgttccatttctcaaacttgaggcccgattgagctatggaacgttatttcaatcgggcctaaattacggcccgtcactgataggtgtcatccgtgacgagcctgagttttatgcccatttaatatgtctatgcgactatatcttaatcggacactttttcggcccgattgagatgactttctagtgacggcctactaattctaggcatgttagagaccgtcacagatgaaaggttttgtactagtgaatatacatgtcaagtattataaaaatgatgactatatatgttaaaatattttagaaatgatgtgagaggtgatgatgattggatatgtttacatgttgatttatagaatttaataaattataaatgatattgtatgtatgcattagcttttttataactaatattattgctagtagataataatgtggtatctttatatattatgtttaatatttagtgagttataactctggaaggtatagatatgacgacgcagcaagcttctggtgcagatgcagagtcgggcatggatctggacggggtcaccactgaagggaacactgcactccatgttgtggccacctgcggtgatggcccgggctacttgaggagtgcaggcgtcatctacagcaggtcccaacatctcatgttagtgcagaacaacaacggtgacacacctctgcactgcgctgtccgggctggccattccaaaatggttgatcatctaattgatctggttgaaactaaggacaactcccctagcagcgcgagactggaggaactcctgagaaaggaaaactgccgtaaggagacggcctttcatgatgccgtctgcattggaaataaggatataatcaccaaccttcttaaatattattcagaattggccggcttccttatggatgcaacaggtacttcaccgttgtacctagctgtcttgcatcaacaggtcgacattgcaaagttattgcatcaaatgacagacgggaatctttcgtactctggcccaaatagacaaaatgcattgcacgcagccgttctacaagaccaaggtacgtgtgcaatttatatttgctgttttgaatttcattctagctatattccatacttattttgaatcatatatttgcttttatcataaagcgacaacttaatttgttttataagtttataggtcaatatgtcatacacaaatgcaaaactcatgcttttgcaagttggggcccacaatgcaagtcatacgcacatatatagtgggaaatatttgtagctttctaataaaaataaaatggtttgctatcgtgtcaatttcgttgaaagtatataagattgattgagcgagagagattgagcgagagagagaattgaacgcaatagagcgaatgagcggatgtcctttattgatcaatgcggtacaatttatagataggaaatgggtgctaaggagtgcctagggaagaggggggtgctaatgggcgggtgatcgctctccgtccccctatactctactctttcccttcctcctccccttcttctcttcctactacaccataaatttaaaaaaaataaaaaaataaagttggaaaaatttatgtatagaaaatactatatataaaaatatttgaatttaaattcaaatttgaaatgggtatgtaaacttttgacttataaactttgggtctataaactaatatttgaattcaaattcaaatttgaatcgggtatgtaaacttttgactcataaactttgggtctataaactttaggtgtataaactttagatgtaaagaaatactatatataaaaaatatttgaattcaagttcaaatttgaatcggatataatttaaattcaaatttgaatcgggtatataaacttttgaattataaactttaggtctataaactttagatgtacagaaatattatatataaaatatatttgaattcaaattcaaatttgaatctgatgtataaacttttgacttataaactttgggtctctaaactttaagtgtataaactttagatgtgtaaacttgaggtgtacaaactttaggtgcataaatttactaaaataggaaagtaatgcggtgccaaaaaaggaacccacgtggaggagggggagggggatcggatctgatcgccctgagcgagcaatcgcctagtagcaattccgtagggaagaggcgtggttgccttcggttgcgatcaatccttttatatggatgagatcaccctattgtttcataatactctcccttgatcgaatccagctttgatcattgctctttcattgttccagaatatttgtaaacataatcttagaaataattataatttattgtattagatacatcaggtaaactcctcaaaaacccattgggaaaataaggagaagaaccgtgatatatagttaactatttttagactttatgagtaaagctcatagtatggtccaaaattagtataatgtctatagttatcatttagtaaaaaccctagtggggaaaagcaaaatgataagacatataacttatgttgatattacctcgttaaaaactttggatgagaaaatataaagggtaaaactcatacaaaggaaaaatagtataatatgacgaaaataggttatttcccagagagagttactccccctcaatcctgcaaatttttaagtcatctcataccaattccttcgacacatttaaaaaatatggagtatggcagagattttatgaataaatcagcgagattatcacatgacttagtttgcaagatgtttatctctccatgttgctgaagctcatgaggataaaataatttaggagcaatattcttagtgatgttgctcttaatataaccagtttccatctaaacaacacaagcggcattatcttcatagataatggtaggtgattctaatgaaccaataccacaagatgttaatatgtggttaatcattctgtgaagccataaacattcacgtgatgcctcatataatgcaattatttcaaaatgatttgtggaagtggctaccagtgtctgtttagaagacttccatgaaatagcagttccaccttgtaaaagtacgaatcctgtttgtgatttggcattgtagggatcagatagatagccagcatcagtatacccaattaaggtcgaatcttggttctttttaaagaaaagtctaagatctcttgtgctattaagatatcgaaagacattcttaactctagtcgaatggcgtttggtaggagcagcgatatatcttgctaatagatttaccgagaaagcaatatttggcctcgtactatttgcaagatacataagtgcgccaatagcactaagatatggaaaatcaggtccaagcacatcctcaccatcttcctttggtctaaatgggactttctccacgtctagagatcgaaccaccataagggttttggaaagatatgacttgtccatatattgaatttctccaaaattttctaggtatatgcactttggtgcacaaggattccagaaggtaaatgctcaagttgtatacctaagcaaaatttggtttgacccaaattcttcatctcaaattccgtctttaaatgatgacgtgcttcattaatatcttgtgtattgccaatgatgttaagatcatcgacatataccgagataatacaaaatcctgtgggggactttttgataaggacacatgggcaatcatcatttttagtgtatctctttagtgaaaggaatttacttaatcggttgtaccacatcctgcccgattgttttaagccacaaagtgacttctgcaacttaacacaatacatgttacgatttaccttctgattcggcatgtcgattccgtcaggaaccttcatgtaaatattagaatcaagtgatccataaaggtatgctgtcactacgtccatcaactgcataaatagacgattttgtactatcaatgatattaaatatcggaaagttataccacccataactggagagtaagtttagttgaaatcaacgccatgtttttgcgtaaaactttgtgctacaagccttgctttatatctcaccacctcattgttttcattccgtttccagacgaaaacccatttgtatcccacaggaaagataccacgaggagtaggcattacagccgagaatacatctcttttgtaaagcgaggctaattctgcgtcagttgcgtccttccatttgttccagtcagagcgcttttggcactcttttatagacctaggttctggatcaacttgcaggcaatcagcaatttattcagaaaaattaatgtcaacaattgtagctcttctatcaaaagattctccagtttccgagtagttgatggcaatttcatcaacccttatagactcattgtgatttcccaaaacaatgtgtctatggtcttctgaattcctagtctcagcattatgcacaactgggctaggttgcagattatcacgatctgcttgatacatagtatcaatttggtgtgtaccaacttaaggttggtttgcatttattgtctttcttttcttgctagcaactgtatctcgctgagtggccaaacttcttcctctctttttagtgagtggaagttgagtggttttatttggtacctccactctttctagcgcattctgagcaggaatgaaagatttagtaacacctttataattagtaaatgcatctggcaggttatttgcaagtctttgcaaatgtataatttcctaaacttgaagttcagtttcagtagtgcgtgggtgtgaggctggaataccctgggcatcccaatcaatttcctgtcattctttctggtacttgaagtctcccgctaatgccgggaaattttcctcatcaaagatagagtcagcgaaccgggcagtaaatagatcacctattaagggttttaaatactttatgatcgacggagatttaaatcccacatagatccccactttcctgtgtgggcccatagcggtacgatgtggtggtgagatcagtatgtatacaatacaaccgaacttacacaaatgggaaatacttggaggatttccacgtactaactgcattggggaagtttcacgatatgcagtttcctcaatgcagttggtcgtagttggacaaggtcagcagtgtgcagaactacatgaccacaacacaacgaaggtaatttgcagtttatcaataatggtcgggcaataagcttaattctttagatcaatgattcagccaaaccattttgtgtgtggacatatggaacagagtgttgaacctgaattcccaatgccatacaataatcatcgaaagcatgagatgtaaattcggcagcgttgtctatacggattgattgaatcctatgttcaggataatttcccttcagccttataatttgagacattagtttggcaaaggcatggtttcgtgtcgatagaagacacacatgagaccatctagtagatgcgtcaatcaaaaccataaagtacctgaacggtctagatcttggcaccatagggccacagatatctccttgaatgcgttcaaggaatttaagtggttcggctctaattttgagataagatggtctcaaaatcagtttcccagtagcacatgctgtgcatacgaaatcagagtatttgggaaatttgtcagtgatcaaatgatgaccaatagaattgtcaataatttttctcaccatcccgataccgggtgctcaagtcgatcatgccaagtgtggaatgcatcaacattttaaaaaatcactttgtacacaacatgtgcaatgggcttaatgtatgtatagtacaatcccaatgtgagagatggaattttctcgcaaatgcgtttgccatatcccttttgtttggttaagagaagaaattcttctcgattatgcatatgggtttcaatgtgaaacccaatttgacggatatctctataacttagtagggtatgggttgaatcaggatacaataaagcatcctcgattgtaatttgtgtatccattgggagtgtaatagttgctcgtcctgagccaaatatcacagtatcgcgcccagcgatagtcaaaactttgccttctctctttttgagagcttgaaagtatttgatctccctaagtatagagtttgtggtaccactgtccacaagacataattcatctccaatcggagtcatatccttagacatctatagtgaaagaagaattgcttagtgaagaattctttatccacaatatatacatacatacaataattaaaacatcaaatacatagtatgatgtttacaaatgttataagtacatactctaatgactagcaagtcttacaaccttataatataagggagtttgtacttatctacttattacaaccaatattgttttgacaaactataggatatcaatataatgtctcaaacacactgagattaaagcagctttatctctaagtggggtgcactgcgatcatagtaaatctccaactgggtccgttgagcagtactcgatgagcatgtcatccattgcagaaagtgccgcggtatcctctaggagaagagcgaggttgttctctggttcaataggagcctggtgagaactttcaatctcaggtttttcttttgtaagattgaagtgagcttcaacctggtgagaactttcaatctcaggtctttcttttgtaagattaaagtgagcttcaaatcttagttctttagaagatttatttttctcctttagggatttctgatacatgagaacaagatgtttttgggatgcggcaatctttagtgacatgatagtcagatccacacttgttgtaatgcctgttgctatttgccacgaggttgtggtgcctgacctttcccttttcctttctgtcgaccattggatttgcgcctgttgttgcgtttgcgttgtccagttagattcttagggttattcgaggaatttctcttgaatccttttagtgcgatactattggttcagtatcctgtcctttggaaacatagttgatagagttttctctatcttctctgcttccgttggctctttttcgcaaaatcctgtaggcgtaaatgaatccactcataattagcctcaggccaaatgagttccttttgctgatcataacgctcttttagagctttctataggttgagagggctcgtctccaacatgtactcatgtttgagatctttatagatgtagagccttagaaggaaaatggcaatatatagctttctgttctcaactagtggatcccaatcattgggttcctaaattgtatttgaaatcccacgagaacaaaaatttattttgatatcggaagcccaaattgggtagttactcccatcgagggcgagttcgtcgaactctatagttgtcatgtccctataatcatgattaacattatttatttacagaggtaaattaataaaaacatgacattgaggttgtaatctcaatgcgaaatgtaagacttcatattttgtaatgtttcgaaaagatgtaggttatagacctgataatttgagttagaattcgaaattaggtggcacaatgtggataatctccaagtaattaaacagtggagtagatctcttaatagtgggcaagttatacttgctgcctaaaacatgatctctaggcaaatatattctggtgaatataccgcagccaatgtttaggactccactaccttgtgtttatccaaatttcaaataatctcatttttcaaaacatattctcggaaaataccacatgtgggtaatcatcgtgagatgtagacctctgtgtgataggcgagatactcgctgcctaggttatgaccagtgtggccaatttgtaggactccaccgggtaatcatctcaaaatgtagaacacttaatgatgggcaacatacttgctacctaggttatggtcacgatgaccaaaatataggactccagctacatgtgattaatttccgagtcaaaatgtgtagtggaacatgcattaaatcctccattaatcatgttgtacataattaagagaatttgctaaattaaagtacaaaatttaaagaattttgtaaattaatgaagcgaggaagtagagcatgtctcaaaataatatgcaaaaggcatttaattaagacaacatgaaatttagtgaagcagggtatttgaataaacacctatgttaagtaacatataacaccagtggtcttacattgtaatttgtacaactgatgaactgcttgtactaaattaaataaaacacagggactaatatgaaattgctgctaaaataaaattaaaaactaaaataaaggggtaaatgggtgg

SEQ ID NO: 9403 - DNA, 9156 bp, Oryza sativa
cacatgatgtcgccgaggcggcgccgcctcctgcacctcttctgccgccaccgtccatttcggcgcctccttcttcaccacttccagcgccgtttccactgccgactccctcatccaccaccgattccttttctgccgcaccttcttcccctgttacaccactgccggcgcctccatttctgccgccctcaccgctatagtcaccgcagcccccgtcgtccgccgacagccccctctcctcatcggagtaagagtccggtcgggttcggacgccgttctccccactccatttgagagcgtgcaactcggggagtcgtgaggaatggcgcgggcggaaagtagcggggaggctgggtggcaagcggcggcttcaccagcatggtggcgagactatgatggagggtagaaggccggctaccccgtgcgcgtggtgagagttccaatccccgaaaccccggcggcgcgggatcgggggagcagctccgacgaggtgaaggtgatggcggagcggcgacgaacggtgccggtggcgactccatctccagtgggagggagcactgctcgccggcgggtgtcaccaccgcaatccatccatggtgcctggacctggacgcggcggggcgccggtgccatggcgggcgcttgtggtggtggagtcggaggtgtagcagcgacggcaaatgctgcgccgaggatggtggcggcggccaccaaccctagaatggtgcccggcatggcgatggtggcgactcctcgaatcgacagaggaggtggcgaaggcgatgggtgcggtctcggcgagggaggccgagaacggcatcgaggatgaaatcaaggtagacataccttatgcgcttccttagtttcttctgttcttcgctttttcttgagataaaaagcaatcggatttcttctcttcgcttagagctaagtgctgataacatgttgaaagtgggtaagattgattgagcgagagagagaattgaccacaatagagcgaatgagtggatgtcctttattgatcaatgcggtcctttattgatcaatgcggtacaatttatagagggggaagaggtggcaactgtagacgcgtccgttgccaaggagcgcctagggaagaggcgtggatgccttcggttgcgatccatccttttatatggatgagttcaccctattgtttcataacaaattttgtgaaataccttactataaatttgtaacaaactggcagttttaaccaaataattgtcaatatatgtaacaacattagcatttgataagggaaacatgacatcactgctacagagtacccatagataccggatgggaacttcttctcaactggcaccaatttagagacatatttcacaaaggtgtactaggtttttaaaactaacacctaaaaagatgtgccagttttccatggtaaaagaaaaagaatagccggctctctaccggctcaaatggatgcaaccctgattattgccgccgttattaacaacttgatcattaaaaggaaagtcaagcgcaattaccaaaattagagcaggaaaaatggatcttctaaaaaaaacaaacaataaaaagatgtaactacacagagaccgcaccctatattgtcttaaccagagactcatctttagatctggttgcctactagtaaaccgaataatacatgccttttttttcttcttatagatttttcttttaaattacttatctatccataatccgattacaccattgtgtttgttgcaattaaatttgtacaacaagatcttacatgactatattttgataaaagaaataaatatatatatatatatatatattgtaaaatatttttattatataaataagttacttttatcatatatataaattacttttcgatttgattaaattacttcttatacattcatgatgttgtgaatatattgtttattttattatcatttttggtcaattccgtaatttgtgctaattaaatttaattgctagataaactcatgtttttatctccataacggatttacttttaatatcatcacaaagttactttcttttttttaagttacttctataatatatgtaaattattattttaagttacttctataatataatatatgtaattacttttatgctttattgaatttacttttatatgtcgaagaagtagtttagtgaaatttaaaattaattaaggtatattataagagtaatttatatttttttcattaaaacataatcatgtgagatcttgttataaaactttaacttttatgaacacaacggtgtaattggatcatagatcggataagtattttaagagaattttatttgaagcacatgtgataggaatatatttttttctacttgcttgttggactagctagtactatagtgaaggtatattgttagggcctctcgttagcattaaaacaagatgcctcttgatttagattttaccaaaaaaaaaaggttcgtatggagaaaaaaaaggagaaaacttttgggaaggaaaagaatcacgaagaaacagcgaaaccaagaaattcccacctcaaccagtcaaataataaacaaaattagcttaattggatccatgcctttacaaatttgcctattcaaataaatgacattaaaattcgtctattaatagtcgtatcactaaaattttacaaaattggaccgtgccactgtcttcacgttttccatcaatatcctttattttccatcttcttccttctttctctcgtcttcttcctagaagaagagggcatacaatcacgagccatagagagccatagccacaagccacgttaagagatagccaacaggaagacaatcgctaagagataggacaactgtagtttcctattgcaaaactatatcctgataattaaatcaatacttcaacatatccacctcatttaattagatgatgcggtcatattatctatatttttaatagataatatcttcaaataaaatattgtaaaattcacaaagacatatatagtatgaaaaaaatgttacttagtagaatttagaaattccaaaagtaagatacttacaaaaacacacttatgtacaaatgttatatagtttcataggtagcaacttcatcgtgacacgatattttcttataaattcaaaactcggtgtttttaagtaattttagtttacaagttatacattgttatacgccacaatggtaatcccaaataaatttttttaaaaaaaacatgtttacaatagaataagtataaatattcgtaataaaaaagatggacgcgcatgtgtgcaagctatcttccaatttcattaaacaaataaaaacatccagctgccgcaccaaattgcactcagcggaaaaaaacacatccactgatgcagaagaaaaattgagaacaagtactacggggacttccccatacatcgtgagtaagctaaacctgagatacaaagttagataatataaccttctttatccactgtgcactgtgtgtttatttagacgcgttaaagcacgcaatgcaagatacttttcttttcttttttacgtttaaaatgaacaactacaagtccacaacctaatgttttggctaattaaataatgctatttagttactgcagcgttaatttgctccccttaataacatagtttcacatgaatataccttgtatgcagtgatgaccaaaatgttgttgaactggaacaatggcctcacagagcaatcggacgaaaatgggagcacgccactccatttcgctgcatcacttctacggagaggaatatacaatacggtcatccctgtgctgagagccaacccagttcagttgtataagcaagactctgaaggattgtaccccatacacgtcgctgcctcctccggtgccaatctgacagtcaagtcctttattagagagcgacctgagatcgctggtttacgcgattctaaggggaggactttccttcatgttgccgttgaaagggaaagatggaatgtagttgtgtatgcttgccatactcaatcgttggctaggattttgaatatgcaagacaacgatggaaacactgcattgcacatagcagtgaagcatgggaataaggctatcttctgttctctactgatgaataaggaggtaaacttaaatatatcaaataataaggggcaaactgctttagatatatcgcagagtaagattcttgcaggatatttctatggatgggtaagattacacttttaaccctttttgattaacaaagaaaaatgagtaaattacgttcatggtacacaaacttgtatggtgggtgcaaataggtacaataacttacaaattgcttattcgggtacaataacttggctagttcatgcaaacataggccaaaccgatccgcaaaagtaaaattgatctaatatgatacatactactggtgtaattgttgttacacatcaaaattttatactgacacatattattactattattcgcatgatactttcaagatttagaaaaaaaaacaaaataattaaaaatacctaatcattaaaatacactttcaatgaaagtgtcggaacatgaaaatgaaaattaaaatgttcttttagtagttaattgtacatataaaaattatcttggtcttgaatagataaataaacattagacgagttatatagatgatcaattttttccaaaaaatgaaataaatattgtatcctatacatgaaaaataaacttttggacatctaattcctctttttatttggattcgaaataagatctccaaatcatagttgtacgtatatgctgttatgtcattattgtgcactaatttagaacaattttacttgtatggatcattttggcccggttcgcacctactagccaagttattatatcaaagtgagcaatttgcaagctgttatatctatttgcacccaccacacaaattcatgtaccgtgagtgtaatttactcaagaaaaataaagagtactgacctactgatccattatgtttgctttgcagaaccctaacaaactgatattgcgggcactaacgttttgcaatgcaagaggtggttgtcgtcgggtagatcacctgcaggaacaatatattattcatcaaaaacaagtagatgaagtgagggaatcggacaaaatgacaaattcaacacaaactttgggtattgcctcagtgctgattgttactgtcacgtttggcgtaatgtttgccataccaggaggttacaaagcagacgatcacaataatggtggcacaccaacacttgctggaagttatatatttgatgcattcatcatggctaacacaatagcattcatttgctcgagcttggctatcatcaacctcatgtactctggaatgcctatggttagtctaccacttcgccgtcggcactttaacatatctctactcctggccttcagttcagtgacaagtttgggtactgcctttgcactaggtatgtatttagtgctggccccagtgactcgatgcactgcaattgcaatctgtgcaatgatgatgattgcatcactgtgcttatatacggagcctttaaatggcgttcgttttgcaatagcactatatgttaggaggggcaatcgggtattgctagttattgcacagattctacttattcgaacgctaattacatattggccctgtgtgataatctttggctgggcagcgatttcaacaaaagatgggcacacaagacatggatgagtcgtcattagatgcacccgaccagagagacagagagatgaccaaaagtatgtagtaagtttgaaatttaatctatatttgtagttgccaatcattattcacgtgatatctctccagaattaatatttgattcgaaaaaatatgtagctacatgctgtgctcagctcagatattgtaatttctttttgttatttctatttttaacattcagaccctgttaatttccttttattaaaccatcatggtacgtactgtcaatgaatacttgaggcctgttcgtcacttttatgtgacacttcaatatctaacagacaacctaagctgcaaaccgaatgtttctggtatatgtttgcatcagcgattgtgaatttaactaacaaatcattctccaaggccacattaataaagcacggatttctcttttaggtgtacgatattcacactatgcttagagaggttgattagagcctctttgtccacgtgaataaaacattaaatcatcatcgaattggctgtagttgaccttaacaaagttattctagattagttggaatgtcccaaataattctacgggtctttgtatggatttgtacatatacctaagttgaacaaatatcctgaaaggggaacagcggaacagccacattcacaaccatcggcagtgaaacatgacttcatgggatctcatctgatctaaaagccaagcatcacattctaacaaacaacaaccgagaaaaaaatacagtaaatcgtagtacatctaacttctaagagactagtttaaccaaacaaactggaaaagaaaaaaaaactcacatcattgtgcgaagatgtagtagtagagtactagagttaccaatcgagctcacacgagaaatcttccaccaagatcgtcttctccacagcaaccaccaccacctccatcttcttcccctcttctccattgccttttgcgcgatccgaaccagcgattccttccctgatcccctcgacgtagccattgtgagaaccaagcttctcgtcccgctcctccccgaccaccagaaccctatcctcctcgtccccgcagcctccgactccgccgccgaccaccatgacctcgtcggcgccgctcccacggtcgcctcccaccccgacgagggcctccaggatggccccgcacgtggggcccgagtctatgtccgggagggcatcctatggcagtattgttgatgcgaaaaacacacactggcctggaagatctgcttaacttcagtgcaagtccaaaaatcttacctttaggttcgtgagcgtgctagttgatttgatcctgcaatcaacaagaaataaagatagaaaaatagcggttaaatccataaacgatagccgatcggccagtcgccgatgatgtattatttatctttgagccgatgtcatatttaagtcgatcggcaatcataaataggtaagaaaggactaaatgtattcgatcggctaaagatattaatgatatataatacttccatcaatatatacttaaatcatgtgattgggatagatcggtcgccatgccgagacagtataaatcacttagatcgaaatatatattaaaaaggagattatagcattcatagcatagccgatcagatagatttaacatgtatcggctaatactccgataccactctatattaagatattaaatcgggcaaaatatatcaaacatgaagcttaatatacctagatgcgacaagatcttagcataaagggtagatttaacatatcaatctagcacataagatataaggctaaatcaagtaagatcggctgaaaccacgatactacccaaatcggcaagcaaagacaggctagagattaagattctaatcacgacttataaggtcaaactcaactgatgcagctataagtatgaaaagaaagacaatatctagactatcaagccgttggatgtttcatagggtggtggatatcctatataatctgagtcaatattgatatttaacctaatcggttgcctttcaatgatagatgttcgccgattgagggttagatagcaatattgtcaaagattacataagatatatgataactcgacgaattacataaacaagattagagtatcataaagatagaagcactaatcctgagaacgcaagccgccataacatattttacctctagttgaagatcgaaaccgatgcagctcaacccgaaatcaagaactcgtcgaaagtaaacaaaagtaaaagggtggcgatgcaccgagattgtttgattacatgggttcgggtcatatttatacccgagatacaaactatgttcttgtcgtacacgactcttatctctaacaaactctaagataccataagtctttgcggcagacttttgcccaaacttatctctaaggaaattacataaaatatcctaactaatagatacaattgccttttcaggacttagtccgtgcgtggcaatccatatgaagcacattaacccaatctgacaacgtgtaccaaatcacattgtcggaatcgactcaatcgactacccttgtccgactcgaactctgccgatcctggtcgcggccgattcggactttagctgattcttgctctgtttccggaacgatctctaccttggattccgcttcggttttatctccatccctgtgatcgaaacgacaaccgcatacgtcgaaacacgtggtcactcaacagtagttgggaaagaagtaaagtgtattaaattgagaatttttcttaggatccccctattacatggtcctatggggctatttatagcatacaggttcttactactagggttttggttatacagaggaatttacatggttgcccttatgaaagggacatttacatgggtacatagtgtaattgtggtccatgggcccttagcgggccgtcaagcgattatcgacccaattagcccttaggcttgatgggctaggatggcttctttggtcctcccggggtcgaatttgctatggcgaagttgtcccccttccgcgtatactcttcgccctgcatccttcgcccaggaggcctctggcctggcaaggtacccgcgcgattccctgcctctcgcggtccttgcttcttagtctacgccatggggggcttcgccctgactaaacttgacgtttcgggcttgaatccttactggtttcagcagatttggtcgaaggcctcatgccatatcgccaacaatcccccatacttgaattaccaaatttggtcgttaacaagtatatatcaatatatgggtggtttcgctgatgtggcatcctagtcaataaaaaaaataaaaaaataggtggggtccacatgtcagctgcacatcttttttttttcttctctcttgccttcttcgggctagca

SEQ ID NO: 9404 - DNA, 1470 bp, Oryza sativa
cggaccggctcggtcacaatgtcgcaggtgtagtctctggcatccccgtctcactcccagaagcatatcggtagagtggtggaagcctggctgttcaccgccaccagcgtgcaccacagcatgtagaacggctcgtccgccgccctcatccgcgctcaaggattccgcccgctgccggcccgccctaatccgagatcaccgattccgcccaccgccggcccaaagaagggaagagagaaaggatataagagaggagaataaggagaaaagagaacgaaaaaggatgtgcatatgatatatccctgatggagggaccccttgtagtcacggttagtaaccccccattagtcccggttttcagtccgggagtacctatccgggactaaagatcgagctgaccatttttttttttgcatggccctgttgctgcatggtttatatatatatatagtttatatatatatatatatatataaaccatgcatatatatgtttcaatacatatatatgcatacatatatatatatgtatatatatatatatatattatattatattatatgtatatacatgcataatatatatgtatttatacacatatatatgttatgcaaattaatgcatatgtatatagatatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacataatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtgg

SEQ ID NO: 9405 - DNA, 4370 bp, Oryza sativa
tgaatctccattctacaacgataaaagggagtatattattttctatagtctacttatatacaaggacctaatttattaaaggagacgtatagtaagaaatctaaccgaacgatatacttacaaaatccagcaactataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctgttttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtccagctcctcttgcgtgcaatcgtaccccgggtccttgttcttggcggcgtcaactttcgcccttttcgttgcccttgtgtgggcaggcggtgcagctgggggggcccttgactttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcatgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcaggaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtctgcagggcgagtgtcagctcgtccctatctctgtcgggtcggaacgtgccctgagaggaggcttccactgcatctgttagtcgttgcgcagcctctcgtatctgaacgccgaataccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctatcttatatgcaacgaactcgtcccagtgatcccttagctttgggaatgtgtcgaagttcggtgtctgccccttcagtatatacttcttgtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctcctcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagccacgagacatttatgttttaacaatctaagtcatgtatgctaagtgtaaatgtcgtacattagaaccctacacaaacttacgtgctaagtctaaatacaaatcgtgatataagctaagtctaggtgacgtatattatacaaccctagctagtaaataattatatactaagtctaattacaaataaagtaatcttatattaaaactcaaataatattacatgctaagactaaaatagtcatgtatgctaagtgtttcgtgcatatatgctaagtctaattaagacaacaatagtcaattgctacttgtcgcaccatttccgtagtaaataattatatactaagtctaatctcaaataaagtaatcttatattaaaactcaaataatattacatgctaagactaaaatagtcatgtctgctaagtgtttcgtgcgtatatgctaagtgtaattaagactgcaatagtcaattgctacttgtcgcaccacttccgtagtcaataattatatactaagtctaatctcaaataaagtaatcttatattaaaactcaaataatattacatgctaagactaaaatagtcatgtctgctaagtgtttcgtgcgtatatgctaagtctaattaagactacaatagtcaattgctacttgtcgcaccacttccgtagtcaataattacatactaagtctaattacaaataaagtaatcttatattaaaactcaaataatattagaacactacacaatcttatatgataagtctaattacaggtctaataatcttaattaattgcattacaaatataacaatcatttatattattacgtcacttgcctgctccaattccttctagggctagctcttccactcaggcttgacggacgactccgacaacacgtcttttctgcaagatacaaaaagatgtatatagtcaaatgcgaagtaacatatacatatatatatatatacatatatatatatatatacatatatatacatatacatatatatatatatatatattgcatttcacgttaacgttcgtcctcgttcgttcgctcgttcacgttccctagctcgttcacgttcgttccctcgttctcacttgtcttcgttcgatcgttctcgttatcgctctcgttcgttcgatcgttctcgttctcgttcacgttctcgcggcaacatacattgacgtgttcgttctcgctctcgttcgttcgatcgttctcgttctcgttcacgttctcacggcaacgtacgttgacgtgttcgttctcgcttctcgttcgttcgatcgttctcgttctcgttcgttaatggcggtgtggcggcatcggggcggcggttggcgccgtggcgacggcggcggcgtggcgacggcgtggcgacggcggcggcgtggcgacggcgtggcgacggcggcgtggcgacggcggcggcgtggtgacggcgtggcgacggtggcgtggcgacggcggcggcggcggcgtggcgttgcggggccgtggcggcatcggggcggcggttggcgccgtggcgacggcggcggcgtggcgacggcggcggcgtggcgacggcgtggcgacggcggcgtggcgaccgccgcggcgtggtgacggcgtggc

SEQ ID NO: 9406 - DNA, 2875 bp, Oryza sativa
ataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatcctctagtcaattataattagcatatgaatgctagtaaattaaatgttaaaaactctaattaacgtacatatgaaattgccacctgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacagcattacatcggcggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacttctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaaca

SEQ ID NO: 9407 - DNA, 662 bp, Oryza sativa
cattgcgggctccacacaaatttctcttctttcttcaacaactgtgtcatgggtcgagcgattttggagaagttctcgatgaatctccggtagtatcctgccaaacctaagaaactgcggacttgagtaactgtcttgggttgcttccaatcggtgacggcggtcactgtttcggggtccacagcaactcctttagcagatatcacgtgccctaagaatttgatttcggacaaccagaactcacatttgctaagcttggcatacaattgatgttcccgcaactttcccaacaccagacggagatggtgctgatggtcttcctctgattgtgagtatatcagaatgtcatcaatgaaaaccacaacaaacttatccaagtattccatgaacactttgttcattaagttcatgaagaaggcaggtgcattggttagaccgaatgacatcaccgtgaattcatacagcccgtatcgcgtggtgaatgcggtcttcggaatatcttcttcacgaatacgtaattggtgatatccggaacgaagatcaatcttggagaatacagtggcacctttaagctgatcgaacagatcatcgatccggggaagagggtacttgtttttgatggtgacttcattgagagctctgtagtcaacgcacatcctctt

SEQ ID NO: 9408 - DNA, 872 bp, Oryza sativa
cgtcgtggcgttcgtccctccgtcgagccgttctcgtccgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcatcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccatggaccgactctgtgtactcggtctaccgcggtcctttaggttgacatgtggggtccgcatgtcaacggcgcagccttcctgtcttttccaggctagcgcttacacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcg

SEQ ID NO: 9409 - DNA, 644 bp, Oryza sativa
aggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactct

SEQ ID NO: 9410 - DNA, 2193 bp, Oryza sativa
ggtgttgacggccaggggtgcggccaaccgcgtcggcgtcgccatcgacgtcaagggcggcacatgcaccgtggcggcggctgcattcctcctcatctcgcgtttgccgtcggtggtacggagccccgctcacccacgggtcccctgcaggggcggggacggggggatatttcccacccgatcacctgtgcggggccggggttggggggagaagtcggggagcgggtgcgggggcgttccagcccaaccgccccctgacccgcccggttgacaaccctaggtaggaggtaacgctttttcaatttattcctcaactcctaatagctgttgtaccaatggaaaaaaacaccttttcccattgcaatgcacgggcatcttttcaattgagaaaaaaaagccaagtttccgttgtctgtaaaaaaagagaaaaaacctaactcaaaagcaagaaaacgccatttataaaaaaacctgttcgaaaaaatctgtcgactcaacacgaggaaaagaagtcttttataaaaatacaggttcaaaaaaacgtccaactcaacatgagataaaatccattgtgtataaaaaaatggattgaaaaaaccgtccgaatccacgcgaaaaaaagataaaaaaaaccatccaactccatacgagaaaaaatcatcgtttataaaaaaaatcgctcggaaaaaactgtctaacccaatgcattaaaaacctcatgtttataaaaaaaaatccggtttagcactgtgcaatgtgaaaaaaaacatctaccttatctacctcatcggtttcaggaaaaaaacatccaattccatgaaaaagaatttaatcttttgtatcatctacctcatcggtttggtttttccaaagcgttcctggaatgttctgatgtgtggatctaaaacaagtcttgcttgggccttttttttctcgaagcgagatcaaattgatcgaggcttgggtcagataggatcatcgattttttccatctcctagacggcttgtgttccacgatctattctcgtgtattgaaggcacttcatatctctgtatggaattatcagactactttgttaagtatagctaatatttttgatagcatatcatataaaaataatacatatattaacagaagagttcacagtggctctgttttgtctagaattgaccatgtgaccatgtgagacagtataggatttgattaatcctattattagttgcaagaatgaaattgaaaaagagtttttcagattatatgtgtacagccacacaaataatccaattcttttgggtaaatgagacaaacttcctccgttttataatgtaagactttctagcattacccatattaatttagatgtaaattaatctaaatatatgcatgtgtttagattcattaacatcaatatgtatgtgagcaatgctagaaagtcttacattgtgaaacggagggagtaggtaattatgtcgtcgccgaggttggggtattacaatattgaagatgttccaattttccttatgacatgtctgttgtcgaatagacaacagcgtcacaccgaaaggcgtggttctctaaacagttgttggaaaagtaaggcaattgtattgcttagtaaaaatttttttggggatcccccattacatggcctagaagggctatttataaccttattacaggttctctccccttagggtttaggctttacaggagaatttacatggttacccttatgatagggagatgattaggggtacacagtgtcctttacacgtatggccccaattgggctaaatggctcggccaattgatcttggcgaatccccacagggtcgcaacagcccgctgggcttcctcacagtggggtatggtaccttggcgaaacccatgccttcgggctgaagcttttcgcctcaccatcttcgcctgcgtggcctcctgacggggtccctgtccgacgaagcacgcgtacttcccgagccatggctttcgcccttatggtatccctcttcgaccttcgccgcttgcttccggtttgaacatgtcgcccaagttttcggtttcggcaggcccggccgaaggcctttcgcagtatacctccaacaagcccctcacgagcaagggtgagtagggagcttcggccgagaccgtgcaaatcgtatggtataccgcgaggcgccccctttcggtcg

SEQ ID NO: 9411 - DNA, 9026 bp, Oryza sativa
gaattcctgcagccctcactttttaccacttaacacgctccgtgctctctgcatttgtttgcacttcagctcttcgccacctctgtactctcactttctttcgcttctcaattcctccttcgccacggacctgatggctcctcgtaagcccaccaaggccgggtcgactggcgaagaccctagcagcctcggggaggggtggtcatgctttcttggcaaatcgcttgtcaaagaggccgacttggccgaattggtctcctccggcactctcgcggagggccaagggacatgtgggggcgaagccgttgtcccttcgccaggcgatgggcgaacggtcgtcttcgccaccttctttgccgccgggcttcgtctcccgtgtgacgatttcctggcgtccgtgctggcgacatacgaggttaggcttccctagctcagtccgtcagcaatcccgaagctggctgtcttcgctaggatgtgccgaacctgcaggttctctcccaccgccgagctgttcgccgtcctatttacagcatgtgccacgaccaaagacgtgcatacgccagccggaccaagaaaaaccgttttcggttgcgtgaacttcatgctgcggctggaatgttcggacgcctggccggtgcctgcatcgatgggcaaatgggaaaggaactagatgcaaaagtgactctacatcgccaacccctaccctactaaagacaacaaggcgaactagctccgcttccagtgctccgccgtctccattgtcgtgaagccaaacctagaggtcgatggaaccctcgagtcccggctcatactccttcgcaaggtcgcacggcggctaagtacccgtgacctttccgaggagttttgccttcttccgatctccccccttgctcgtgtctggggggtttccgtcaatgaggacaaagaggttctcgggcttccccgccttgttctccccaccggggccgaacgtgagtttttgcttttgctccgtgtcgtatacttctttttgcggaaatatacttcggcctaattcatcgttttccttttcctctctttttcagttcacaccttagaggacgccaaaacggaggcatcgaaaatggttggcgtcctaaccacagccaaattcgcccgcctgcttcagcgtcagaccgatggccgggtgaaccgagtttatgttggcgaactgccaggttgatcaatcccctctagggccggcgacgaggatgtcggtacgtcgaagaagtgcaaacgagcggttgcaaagggtggccaggtgcgaactcgtcgcgccgctaaggacgcggccgaaagcgatggtggggaggaggaagaagacgatagggaggccggatctgaggatgatggatcgcatggttatactcctagcccagctagggtgaaatctggggtgggctctcatgtttcgcccgtgcgcccgcaagacattgctggagcgaatgcccttctggcgatttctagctctgcggcgaagccgggagctgttgccaggaagaagaagaagaaggggaaggttgtgcaagttggctgtggcttttcggacagtgaggggtccgatgggatgcccacttcgccgattctgcggcgcattcctcctcgggggagactgtcacgtcctgataaattcatcccgaattaaaaatcattcgctaaaaggaataatagagttaattaaaattcgaaaagaatttggcaaacactaaaatacgtacaagaaaaattcgaatgtggcccggagaatttttgttaaattatccttggtctaaaaggagccctcaaattttacttgaattttcagagcaccggaaataattattaagcaacaaaaacaattatcaaagtttatttaaaaagaaaaacctaaaaataaccctccttcctcctttgggccaagtctggcccaaagtcctccctctctcccctcggcccgcggccgaagtctccctctcctccctctctttctctccctctccttctctccctcctcctcttgggcctcctcccctcccggcccagctccctcccctcccctctctctcccgggcctcctctccctcctctcctcctgggtcgcctcggcttcgcccggcccaagccgagccgcgcctcccgcccgtgccgcgcgcgtgcgcgcgctgacgccgccgcctgaccgcgtggggcccacgcgccaggccggtcgtccccttccaaccgcccggccccttcctctctctccctcccgtgcgaaccctagcgccattcctccctcaaatccgcgcgattcaagcatgggattcccaaattgattagggggaattaatcccctttccctcctctctctttcccccttaatttccccttgaatggtgcccccaatcgccggaaacggccgcgccattcccggccgccttccattgccgccggccggcttttccgccgccgttccccgctcctcccgtgcccggctccctcccccatcctataaaatagaaccccctctttgcgttctaccgttttagtctcctcccgggctctcccgtggtccctagccacctccccgccgtcgtcccctccctcccgtgccgccggccgcctccagccgcctctccctcctcgccggagcgccgtccggtcgcgccgtcgcctcctctagcatcgcagccgcctcctcttcgccggcctaccctctgtctcccgcggagacctccggaagtgcctccccgccggcaaccgtggtgttgccgccacgattccgcctccggtcgcctctgccgcgtccccggtgcgccggccgacgtcgccaccacctctcccggcaccggagtgccgtcctctttcccggcaaggccacggcgtcgcccgaatttcgccggaacgccgtcgcccgcgtcggcctctccttcctcctcgtcgacgtctcctccggcagcccccttccgccgggcccgtgcatcagccggcgctgccgtccctccctcggcatggtggcgtagccctccacctcgtccacccctcggtttcgcccggaagccgccgcacatcgccgcgaacctctccctccacgccgtgcaccggtcggccacacctccaccatcttcggcatcgcagccgcgacgtcgtcctcggcctcgcctcccctccgaccgaacaccgccggtgtccgtcgtcgtcttcaccgttcatcctcgccggctcgtcgtctcgcggtgccgcctccgtcgtcggattcgcagcggcgcgttccacgtcgtccccgtctccgtgcagctgccgccggctgccctcatcgtctcctcgccggccccagtcgtcgtcgtcgtcgtcctctcgtcgttctcggtcgtcgtggcgttcgtccctccgtcgagccgttctcgttcgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcatcaaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggctactcgcctcggttgacacacggagtccgcttccgtcgacccgtggaccgtctctgtgtacccggtctaccgcggtcctttaggttgacatgtggggtccgcatgtcaacggcgcagccttcctgtcttttccaggctagcgcttacacatgttttatggttgcaaagcctaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcgccgaaggttcggaaggccgttctctctgagcaaggcaagtcacatcatccttgaacatattgaatcccagtttataaaattattttgatttaaattattgcattaacgctttatttaaattcccgcgtgatcactgttttatttagccatgcctatttacctttgttatgaccttaatattattgttattgatattattaccttgttcaccctagattaaacaaaaccccaactagtggacactctattcatggttccacaagtatgaatttaggtagatgcttcgctgattaattaggcaatattaggtggttttataactttagactttgggaattctcatatcacctggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacctagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagcgcctttgtaataatgtaaatattatcgatataataaagatgtgtcttttatatcatgtttgtgtggtgtaccccggcttttcctgggacggggattaatacacaagcgttcgggaaaaggcaattttcctggtcgcgacaagctggtatcagagccatctcgacggtaggataagccaagtggataaaacctaaggacatattttataaataaaactattggcgaaagttcctttttctccttcccctaatgctatttgcaaaatggtttacttttttcttccttcttcaaatttcaactagtactagatggtcagctttgcgaagaagaagatgtcgccaattgtttgccgaagctccggaagactgcaggatccgctagcgaagtgtaggaagcagtgaagccagctgtgaagaaggagtgaagatcttggagaaccagttgcagaacctaagccgccctctagggtagagtcgttagttgtgtgtttccttgcttgtgtgtgtagcgcgtggtttgcatcagtggggtgtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaatgatggatccgatgactcaagaacccaagccaatgggaatgagaaaagcataaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcgcactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaacttgaaagtgagcataatcggatgacgaactgcaagagaaggattgtcaacatcccagtatttccaggtggtaaccaaagacagcgcactgagccacttcagatcaccggatcttctgttgtgcatcaagaattcctgcccgaagaagatggacgcaatgcagacaacaacactagcaatactaatgatgatgataccaccaacaaccatggttcttgccccattagtgaccacccgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgtgaggcctcatgttaatcctaacccatagtagaaacaatgtaccgatgttaagcatcttcccttttttgtttaaggtagtgccttgtattcatgtaataagggagacatgtgtgataaaaacaagttctatgaggattattttggaagatgctgatatgggatcatgcgtataattgtttactgtcaaaggagacctagggtctcattccagaggaactatgttctaacctcgagttaataaccaacctgatgatggaaaagaaaatcaagcgattaaccaaagaaacatttgttggactaagagtttcagatgtgtctttttcggatcaaaggcaaagacagtcagtatagcttttggcgaaacacttcaaggtttcactggaaggcagcaagccaaaggacctcattgtcaccagaagcatccacaactctcggagtggagagtacttggttgacaaagtttaaaaggtgattgatagaagataccagcaaaggtgtttattaccgggcaaagaagtaggtcgaaaggtgattgataagagaaatcgggaaagaacacatcaaggttaaaggtgtaaaggaatacgttgaatgctaactgaggacaacctgaaggtaatagtgggaagtaaactgaatgtaacgaaagtaaatccgagctgcctgttcgtgggaactattcccagttatgaaccaagtgaaatgttcgaagatagtctatagaggtcagattaaaatcacacctaacaacgaagcttcagatttggcaggaaaatgatcagacaataacaagttcagcagtaaagtcatttgggaagacgtcaaagcatgtcaagtgggataatttggttaccttgggaaacataattcaaaggcaaaagttaccgaccctcacattgaatagaggaagtatctagcaccggagactaggaaagctaatatgaggcagttggtgcaagttagaagtaaatgacaagcatgatattcttatgatgacaaacatggtatcctagtaatgacaagctagtgttgacgcatgacatgaagtgggtaagttgtatgaggttgacgccaaagatatgaactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaaggagtcagacaagaagagaagaccgcccaacctatcctcttgctagcctcctcgaatctcggggacgagattcctgtaaggggggtg

SEQ ID NO: 9412 - DNA, 4984 bp, Oryza sativa
aatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttcccctcttcagtaagagaagctttggagaagatgtcttaggtggagtcctggcttataccccagttgagcgcctgtgaaggtggagccgtaggctcgctagtccgctgctgtttatttttgattgtcaggcctgaagccctttgtaataatgtaaatattatcgatataataaagatgtgtcttttatatcatgtttgtgtggtgtaccccggcttttcctgggacggggattaatacacaagcgttcgggaaaaggcaattttcccggtcgcgacagagacgcatgtccccagcgcttgctagtgacgccgaagctgcaacgagtggaagtgcctcggctccggccgctggagcgaacgtctccggggacgaataggttgaggcgattccttcgcaagctcgtcagcgggaaggaaaagctccggcggtcgaaatgactttgtcggacgtgacgcttactgccccgcacttcgttcccgtggatttcgccacgtggccggagatcactcctttcatggacggggtgtgccaagttatcgcaccgtccgatggccttggcctcttcaccgagctgaacaaatttggcgaaagttgcacggccgtggagagcttgtttgtgcgggtatgaattttctgtctgcagaattttctcatttcacctatgtcacgccataatgtatttggttccccttgtccagggcctcgccgcgcacttgagtgcggaaaagtctgccttggagaggccggacgggtaccgtcttcgcctccgaaaaaccgaggaggatctttgccacaaggaagacgaaagacgtgttgtggcggagaccataaaaaaggcgaatgcggaaaacaaggctcttacaggagacaacaagtctctccgcgccgacctagaggcggcgaactagcgggacgcagaacgagatcgccaacttgctgcggccgaggagaagatcaagtcccttgaggcccgtcttatctcggccgaagctgctgctgtgactttggcgccggcaacagagtcccccaagcaagtctgttatactctcaagctggctctgtatgacctcgggacacgggcggagggcgctccgggcgacgacgggacgacgttcgacttctccgagaggacgcaggaagcggccggctcagtcgtcgaagtggcaggtgcttatggtgactgttgtgcgcgtgtttcggcgggcttcatccttagccagctacactcacacggttgtgaccacattgggatctttcccgacctcgtgaaagaagaatgtcctgacaattcacagtgttccggaacggccttaagggccttccgaaaaggtttctaggaggatggcggccgggattgcgcgaagacacgccttcgcgagaatctcgagaggattgcaaaggacgaagccactaccactaacaccggaggggaccttgggccgtcggaaccgggcgccggacacgagggcaaaggcaatggaggccaagaccaccctgaggtgtgaggccctcgtgtgactcccaccttttttttctttgtccttttaggctttttggtagtcctactatgtatataggcgctttgcatgttcggctttgagccgttttcatcttatagccattatgacttttttattttattaatggaaaagttaatgctttcgccaaccttatgattttgttggaaagtgggattgatttcgtccacatttttccttttgcacttgttcttttgtgctttgtcaggagattcgtggccgaaaaatgggcattcggcccccacctgaaagttggcgaaacaagaacgagaagttcgtggcggttaaaggattgctgaagaccaagtgtcgttttcggcctgtttaccatgaaatgttaataaaaggcaacagctacatggttatacgggttgccgaatggatgcgtgcacaccccggtcgaactttgaaagactatgacaggtatcgtgtaacgtatcgcgaagatagcgcaattttctagcgaaactttaagaggtcgtttctccaagaggctatcgctcgtcgccgttacagcttagtttgcttttggccaccgtcccctttaagggttgtgtataatattagtagcaacgatgaacctaattcgccgattagtaacttaattgagggcgaacatgtaactggtgatgtaattttttatgaggtttttctcacgtaaatagaaaagttttgtgattttgtccgctcgaaactttgtgaattattgatcatagctttatgccatcgttcgcatagtcactctcgtgcttttgttatgtcggaacatgccggcccccactacgtactatggcgaaaaggtatgcgtcacaccgaaaggcgtggttctctcaatagttgttggaaaagtaaggcaattgtattgcttagtaaaaaattatttggggatccccctattacatggcctagaagggctatttataaccttattacaggttctctccccctagggtttaggctttacaggagaatttacatggttacccttatgatagggacatgattaggggtacacaatgtcctttacacgtatggccccaattgggctaaatggctcagcccattgatcttggcgaatccccgcaggggcgcaacagcccgttgggcttcctcacggtggggtttggtaccttggcgaaatccataccttcgggccgaggctttttgcctcgccatcttcgcttgcgtggcctcctgacggggccctgtccgacgaagcacgcgtacttcccgagccatggctttcgcccttagggtatccctcttcgaccttcaccgcttgcttccggtttgaacctgtcgccaagttttcggtttcggtaggcccggccgaaggcccttcgcggtatacctccaacgcaaacatgacatcggccgaacttcctccatcgatgaggatgcgccgaacttcaaaactagccatttctaccgaaacgatcaacgggtcttggtgcgggaaaagaactcctttggcatcttctggtccgaaggatattggctgtgaaaagtatcttggaatgctgtcagctgtagagacaatgctgagacaatgcctttgtgcttgaacattgccttgctgccgaatgtttcgactctgctcggtcgtgtgcgaagagcgtccgtgaaaagcgcattataagttgtcacgcccggaatttctatccaaaattccaaacgcttacatgtgtgttaaaccctcgtccaggaatcaaccgaggcacacaatgacaatttgataatagagtacaaataaataactatttaatactcgcaaataaaaattattacagaggtagacagttcctctcaaacaaaaataacattctacgcagcggaaatataaaacgataacaaactacggaacagctatggcgactccactccacaggcatcttaaccaagaacaagcctaatcctccagatcatcaccttcactgagatactcctcttctgatgaatgaatattgcaagaatgagcgtatgacatactcaacaagccacacagcaaatatgcaagtgcacaggataacaaaggatggcataatatagctcatttgcagaaaacagcatttaataaatatataagagaataataaaaacagttgaataattgatcaatattaaataacaccatacaacacacccatgttgcataggcccaaccacatttgaacaactaaccccagttgaacaaattaaacctccaaaccaggaattaaccattccaaaccaggagtcaaattatttatcacattattaacattgatgagtagtgtgaaactaatcacgaaaaacattgctcaactcacccataaccgcgggtacggctattcgaatagtttaaactctaatcagaggtgtaccactgtacccacaagacacaaccccacatcatgtcaccatgtgcctcaataccaccaccgtacctcggaaaggagttgtgacaataccccttgcacaacataacccattacagcgcacctttcctggatcataatcacccccttataaacaaggcatggactccccagcgacccccgtggacttctcgccacttctcagtctggcgcactataatgaatcacgttatacaaaagataaagccgttgcccacgctggcttgtggttggcacgataaatgtttcacaacagtagctcgcgaaccggtccttaattgtcatgagcacaaccatcaaaaccatatgctcacaacccaccttagccaggttttaattaccaattaattatcatcacacgatttaccatcgtgagctaccattgaatcaccataattgaataataatataatataatttataattaacccctttagttagctaatgtttctaagcatggctaagcaaacttacatatagcatttagctgaaccaatccaatatataaggttcatgctaatcaaattataacccataggaaaataaagtcatcttcggccaataattaactgggaaaggttcaccacccgatgacattcgaaaacaatgcatagttgaaataaaataatagctttaaacgggttcaacatgctcaaagggttgtttgggatctgtgtgacttgccttgggcttccacaaacgcttcggaaccttcctcaacggaaacgctctcctccggaacgt

SEQ ID NO: 9413 - DNA, 6582 bp, Oryza sativa
tgattttccgaagttttaatctattagaaaattggaaaaaggaaaaagaaaaggggatgatgacgtcagccctgatgacgtcagcatgacgtcacccacggccgattagggtttgcgagctcgccggagctagggacttcggccgggcgattggaggacaccaacgcgaagaggacatcgagacgaacccgatggtacttaccacgacaacaaacgatgcacgatgacggccggcgacgagaagaggcggcgcggcggctcggcttgacggcgtcggcggagctccggtggtcggcggcgaaggggaaggggcggccgagattcctctcaccacggcgcacctaacggcggcggcggcaagcggcggcgacgacggacgcggcggcgcgacgtggccgaaagatggccggcggcggcggcgactaaaacgacgcggcgacggcgctacggtgcacgggaaagctcgggagagggggcaaacgaaagagaacgacgaggtggtcctttatataagcttggattgaagagatcgaactccaaacgagagcaatcgactcgggaaagattaaaactcggttttagggataaaatcaaaacgaactcgattcggatcaaatcctcaacgattctctttgattcttgggggaaaagaaagaggagaacgagaggaacaaaacccctcaaaaacccggaggaatcggggtcggattgaggcgaatttgagaggagaaggaggcggctcgtgctcggactcggctagggcagccggccggaggtaggggaaacacctgacaggtggggcccacctgtcagtgtcccacgagagagagagcggcggcggcagctgggccggcttgggccgcgcgggagagagagagagagagttgggccgaattcggcccaacggcttaggaggggatttttttaaactttttgaaataaaacaatttgtgaaatgttgtttcaattattaaaaatacttcccttgctcaaataattcccagaaaaatctagaaaataaaggagcaagcatagtatttaataaaattttatctagctcatttttatgttgaaaattttcctagaaaattagggtttagcttgtaggcttttaaattaatttctaaaaatgatttaaaatatgcatttttaatttagtcgatttttagggcgtgacataagtctttcttgaccttcttgtgaaaaggctgttgttgcccgcccgcttgctgggtgtcgaactccttgcggagggcttgtacctcttcgaccgccatcaccgttttgctagctcactcagtcctgaatttcttccatgtcatgggtgcttggttcggcctggggtgcagtacttggttcgccagagatgctgggtgaacttgaactggtgctgaacttacagcttgagcttggacctgagcttgggtgttggtttggacggcggctgctgcagctgttgctgccttgtcatactcggcttgaatttcttccctccgcttggtatcttcttcacctcgagcatatccatcaattatgcaaaagaggtgttcaagtgttctgggttctttacgcgcgagtttccttgtgagttctccctcgagcaagctggccaaagcggcatggataacatacgcttcggttatatcttgcacttggcaacgcgcttgcgaaaacaggcaaatgcactcccttgttgattccccttgcctttggcgaatgcccataaggtcttgttgtgttttcggctcctcgcataggtacctcgaaagttaagaacaaaaacatcgcgcaattactcccatgagtaaatgctattaacatgcaaattgaaataccaagacctggctatgccatcgagcgtgaggtgaattaccttctccttggtgttctcgtcaccatgagcggcttcaattgcagatgcgtagatggacaagaactctttcggatctgtttctcccgatataccgtgggaccggagggtacttgaactggggtgggatgggatgattattgattccccagctgaggggcaggcccttttcggtcctcggcttgatcatagccccttgctgagcaggccaattcaaatgtgggtacggcagcgcgaacggtgaagccatggaatccacaggctgttgtgctgtgggcatcgactgaagcgctatgttgaacatcattgcctggttctgctggtctggagaagtgacctgcgctgccgcggttgggttgaacgtggtttgattccatgtttgattcggtggtggggctgatccgtatcctggaggtatagcttgtgcaaaagttgtcagtgcttgggccattgtgcttgggtcaaattgtgaagatggaccttgaggcgaaggccctcgaacttgacttggctgggcgaactgtccaaccagaagccccgccaatgcaccttgtcttgggctcccctcggtctgaaccggaggtgaagctctttgtacgttgttgctgcagaaaaacttggaattgagcttgcaaggtcgaagctgcttccatcattgcttgcggtgtataagtaggcttcgggtactgggcttgaggcgccgccgggcgaaccggtgcttggatcacttgatgtgttgggtgaacggcagcggctagggctggcctggcgaagtacaccagtgcttgcgcgacataagaaggaatgacttgacgctgagcataaaactgctgggcattggccttggcttgtcttgctgcttcgtatgcttattgcagctcttgcatctggcgaagcgtgtcttgaagttttgccatgttttgacgcatggcccccatgtcagcttcggcttgtacttcgagagcggtgttggcttgtgaggtggtgatcgctgctgacgtcgaaatcggttgggcgaaggccgtggctgagggcgtccctagtacttgggaggacaagaccacgtctctaacctgaagggccttcgccgctgccaccgccttcgccgcttccgcatcagtcgaagttttgggcgccgaagaagggagaggtggcagccctgtcgaaggcagtgctgctccggcttcacccacggaggccgaaggatctgctccctattcaactaccatctctacttcacttccgccttccttccgcttggcaactttctccttagtgaccttcttcggtggcatcagtggttttgctcagtctcagtggtttcgctcggaggtccccacggtcggcgccagctgttgtcgaatagacaaccgcgtcacactgaaagacgtggttctctcaacagttgttggaaaagtaaggcaattgtattgcttagtaaaaatttttttgaggatccccccattacatggcctagaagggctatttataacgttattacaggttctctccccctagggtttaggttttacaggggaatttacatggttacccttatgatagggacatgattagggtacacagtgtccttcacacgtatgggccccaattaggctaaatggctcggcccattgatcttggcgaatccccccagggtcgcaacggcccgctgggcttcctcacggtggggtttggtaccttggcgaaacccatgccttcaggccgaggctttttgcctcgccatcttcgcctgcgtggcctcctgacggggtccctgtccgacgaagcacgcgtacttcctgagccattgctttcgcccttagggtatccctcttcgaccttcgccgcttgcttccagtttgaacctgtcgcccaagttttcggtttcggcaggcccgaccgaaggcccttcgcggtatacctccaacaatgtcttagctataacaatcgatacaaacattatcattgatatagttatatatgtgaagcgtatattgtcattgaactgccccccgcacagtgttaaaccgccctccctaagtgcggtaaggggccgcctgcaaaatggcaggtcccatatagccagccgtttggcatgagccaacggtcgtctgccacgtcacgaaaatcgccctttgggaggttgattttaaaaactgccctcccaaagggcggcgggcgactagttttgtcaatttttgaaacacaaaattagttttgtaaatactttaataaaaaaattaaaaataaaaaaaattcgagaaagttgggtagtatcacgagaatattaatggcctagaccatgggaagtaggctttcaaccggcccaggtaccgccgatcagttttaatgaattttatggaaattgaaaagaatttctatcgaaattcaaccgtttcaatgtaacccacgaagttttaaataagttgatctagatttctccgatccttcatctgtttattaattttagtagcacattaaccattgccacgtatacaaatgtgagaacaacgaccttggccatgggaagcagtggaggtacagctagttttttttggctgcgagcctgcgatgtctctgtaaaatgtagcaccacttgttatatataagtttcttgtgctagctattggttattataaattactccctcgtattttattttattttaatgtatgacgccgttgacttttttacaaacgtttgacctttcgtcttattaaaaaaatttatgtaattataatttattttattgtgatttgatttatcatcaaatgttctttaagcacgacataagtatttttatatttgtataaaatttttgaataagacgagtggtcaaacgttggttaaaaaggcaacggcgttatacattaaaatatggagggagtatattgtacgaattgtatagcaacaactggagtggagcgccctccaagcaaacgaattatactgaattagacaggctgtgccttgattactacaaggtcaacactctctggcttgttaacgaacgagagcatctcgactgccctataatatgcagagctaaattaatgggatatgaagtttgatagtttggatagcatgttcaaagctatcagtaaatagctagttagcgaactgatagattaacttggttggttagctaaacttttcctggcgaaacatgcctattggggttctaagtcttatactttagcaagggtgttcatttttttctatgattagggttaagaggtagtgcattacatatgtggggtatgctcagttaaacttaacataagtgctcgtatgttcgtaggaatttttcagcaagtagtacatacagtttagtgttaaactagctgcatgtcccgcacaattgcacggccagcacccatataaaattatctatttttctttatttgacattacttagaatttgttaatagccattatattgtcctataaccttaaaagatcgatccttatcatccttaaattttttaaatttttatttaaaagttacaccagtcattgcctcttactcttttatcacccttttatttgtttacccaatctatcatagcttttgtatatcttcctttaaacctttaaaaaatacaccttctaatttttagactcaattgtctcgttaggttcccttattataatttttaggagtgttgtcaaatgtcaatattgtatttatccatgatccgcctgttgtctcccatatttattgttgttgggatttaaaaattaaatataactattgttggggttcatcttttactttaaatccgcccaaccgccgccagcttcgccatactatactcatgtatttttattatcattgagattttaaaaaccgaacatgattgtcattgtgacttactttttactttctagaagttccaccaactgtcgtgactatgttgtttaacggcttgtctatcgtctctcctcttaatcatcattgagattctatttgtagttttgtttatagtttttagatgtcgcatcaactgccaacaatttacttctttacaggcctaatgtttctctcctatttattgttttctatcatcgttgagttctaggtggaccttattttgaaaattccatatttttcatttcgatattttcttatttgtaaagtgtcagggttacgggtaaggtataccctctacccttcgatatacgccacgtattgatatggtatgctcgcgcgtatatggaagttttcggcatacgttaaggtaattcatcatggagtacataaatggaaggagtcctactcggtcagaactgggtcgtcattatgtcgtgtccggtccggcgtctccgagtcctacttgaagacagttgacctgcgatataaaagggaccctcgggaggacctaaggcatcgaatcttagagctaacacatccaccacagcctacgaagccggagcttatcggagccaagtcaccgggagatctagtcggatcaactcgactacgatctcgtcggtatcgtcgagttccactattccctttgtatctgtggtttcgatcatataatctcatatcaactgaattagggctatcatctaccaaggggcctgaaccaatataatccttgtttcctgtttgcttgatgtcgtactacgtagatcctcgtaccagcgtaccctaataccctctatatccggtctacgggtatccccatcgacataaagtatattca

SEQ ID NO: 9414 - DNA, 4702 bp, Oryza sativa
  unsure (1)..(4702): unsure at all n locations
tgtctcccctggttattggtattggaaatttaaaaataaaattgattgttattgcaatttacaagtcccgccaaccgtcgtgactatgctgcttaacatcctatctgtccttccaccacttaatcgtccttgggggttctacttgtgattttgtttacaatttttagatgccccaacaacgtgactatgctgcttgacgtcctgtctgtcgttccacccaacgtcctgtctagttccatctcttaatcatccttgggggttctacttgtgattttgtttacaacttttagatggcccaacaacggttgaccatcttattgttttacaggcttattacttctcccttctttatatataattttttatctataaagtgtattcctatttgaactcttataattatttttctattttaggaattaattttattttttattttgaatattacttatttttatttttctattttaggaattaattttattttttattttgaatattacttatttttaattttttttctcctaaaattttattttttattttgaatattacttattttaaattattttaaatttcgaattcagatatttctaaactgtattctacttgaacttttcttttctttttgtccgattaatgtgagaatttctcgcctccacagcgagaacgtggtgtcttatttcaaggttgttttaataatctatatctatacctattataaatattcatatttttcctgtcgtcacatcgctcccttcgtccggcgtccaatcaagtgtcccacttgtgcacgcgcccaaaaaaaaataaggaaagtccgattgaatttgactcggtgaaaaaattccgtaaaaaaggcaataaaaaacaaaaaaatccgtaaagaaaggcgaataaaaagtccgattcaatcaggtagataaggcattcaatatttattcaagatatagaactccaacaatattttgattttgattgaaaactttagggatggagaatgcaccggagtcactaccgcaacggacgagcgccgttgttgctcccccattctcatcgcgaagtgtagtccgctgtcatgccgatgggggttggggaagtgtagtcgccatcgagccaagggaggatgagcactgtcgccgtcgccatcacgccgaggggccgccgccatggagctcgccatccaacgagaggcagatgacgaggggagaggcgagcgctgacgctgaccccacggccccacgccgccgctgccgacggcttgcaccgcgcgtctgctcagggaccaatctggacaacaacgtttgaggagggacaggatgggagacaggattcgctaccggtctgcgtctccctccgactccgcttctccactctccggcgctagcgtggcgtggccgagggcgaggggcgcgggcgcgcggcagcaaggcggcggcccgtatggcgtgggggcgaccggccggacctcgcctccgccagatccggtggagtggaggcggctgctaaccggcaggggtaggaggggcggtggcccggacagcgtggaggcggccggccggacctcgccaccgccagatccggcagcgtggaggcggctgcgtcccggacggcagggaggcggccggccggacctcacctccgggcggccgccgctcctcccgccgcatgcgatcgccgccgctgggccgcactgtctccacccgtcgccaccacccatcgcctgccgcctcccctcttgcgccgccgcctgtcgccttggctccgagagagaggagagcgagagaaaagcgaacaagaggaccgagagagaggagagcgagagaaaagcaaaccaccagatctggcgaccccagcctcctcgctggctgatgcgacaatggtacacgacggtagcacggtgcgcctcagcggtgcgtcttggtggcggtggagggaggccggaggaaggagggtggagccggggcggcagaggagccggcgatggagatggccatggcagtggctcgatccaggcgaggaggggtgaggccaccccaatccgcttgacatagatcctcctcctcctcctcctcctcccctgctccctcccgagatctcacactccatccaacattttctctcgcgagcacaccaacgcaggagctcgccagccggccagatccagcgcctcatcaaagtcaagccagagacaccgagcagcggcatgaggatgcatggggaaggtggtggacagtggaatttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaagcccagtcgaacggctggcgttcgacacgctcacctgtcgaacggagggagttcgacagggcccaccacccggcgccacgaggcctgtcgaaccgggggcgttcgacagggccctccaccgaccctgtcgaacaatgggcgttcgacaggccggtttaaagccccgtccacccaggccgcgagttcgatttgttttgaggaccacatcgccagccaccaccgagagtcgccacatcgtcgccgtgagcgccggagggagcgaggggaggggatagcaggccggagaggaggccgaggaggcgccggccgggagcaaagggttggcaacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacggttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgattctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactgggagttggaggaagtttgttagtaaagtaagggagaaaggctatagcctggtaatagtggtgcagaagacaacatgtgttgatcaatcgggggagtcaagtcatgccgtggtggaagaaactccgttggaaggtggacaagatgaaaatatttggcggactgaacaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatgaaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgaaaaaggtcacttacaagatgcggtgaagaggtgggcatttgtccagaagcgtgagttcagggtgaaggtttcaaataggacgacgtatgatgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagaatacggatatgagatatcgtacgacaaggcttggagggcaaaacagaaagcattggagatgaggtttggaacttatgaggattcttatcacaatcttcacccactattggaggtgatgcaggcaagaaacccgggtacacacatggctattctcgatgaggtgaatgaatatggggagaatgttcttcgtcgggctttctggtcatttgggtccatgatagaggcctttagaaattgcattcctttgctctgtgttgatggcactttcatgacaggcaagtacagaggaacaattctaacagcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgtatgaccgacacgccggtttgctatcagcgatacagnnnnnnnnnnnnnnnnnnnnnnnnnnnnnnnnnnnnnnnnnnn

SEQ ID NO: 9415 - DNA, 425 bp, Oryza sativa
aggagggaggcggcgctcggcggcccagcgaggagaggcggcgcgcagcggccgggcgaggagaggcgacgcgcggcagccaggcgaggagggaggcggcgctcggcagccgggcaacgaagggcagcttcgacccggatgtgaccatcgaggacgtcggcggaggcggccgggcgaggagggaggcggcgcgtgcggctaccgagtgaggaggggcgccgtcgtccggctaggcatcgcggacggagcggccgacggagtgtagctgtcgcgctcgccggcgacctcctcctctgcctcttcctcctccggcaacctccgccgccgcggcctactgccgctccgcccgccccttcgccccgccgccgttccgtccgccggcatgctcctgccgccggtccctgcgaggacgactggatgaggga

SEQ ID NO: 9416 - DNA, 1128 bp, Oryza sativa
cttcaagtggctaggagggcatcctcccttttaaggaggtcctcctctcctagaataagcaaggtggtactaaactccacatgcatgccatcccatgaggtgggcttttgtgattttccaaagaattaatcttcgagtgggctaaggtccattcattaattccaacagttaaagcatagcccgaggcggcgacgctcgtcctgctccgcctgagagagccgcttcaccgggcgaccgtcgatgaggacagggggcgatgcggccctaggcgccggcggctggggcggggcctggcgcggacccagcgtcggcagtatcccgtggccaggggctttggccagggtggcagtgcactgctccatcagctcgaactgccgagccaaactcatggcggtgacgagggactgcggattctgcatctggaccttgagactgagcggaggaagcagaccgccggtgaagagctgaacccgttgtgccttcgtcaggcggccggcgcggggcaggagcgcttggaagtggtcctggtagtcctccacggtggtagtgcggcggcagtcggctaactcgaagaggggagccgaacggagtggcggcccgtaccgtaggacgaggagttcccggaagcgacgccacgacggtttaccctcatccgcctggacttgcatgtaccatagctgtgcaccatcttcaaggttgtaggacgccatccaaaccttctcttcgtccatgatccgttgttggtggaagtacgactcacaccaattgaggaaggtgagcggatcggacttcccatcatagcgcgggaaatccattttctgaaatcgcggcggccggacggtgcggggttcgccggagtctgtcgtggcgcccgaggatgaggtgcggccggaggagagggcggcaatggccttggcgttggcggcgatcgaggcctgcatctccttcatggcggtggtgagagcctccacggaggtcttgaggtcattggggtcacccatgccgggtgggcaggacgcgccggaggacgagtccgaggatggtggcgcggcggctggtggtggcgaggatgtggcgggtggtggggagacggcgcggcgcggcgaggatcgtctggaacgtgatacc

SEQ ID NO: 9417 - DNA, 7242 bp, Oryza sativa
  unsure (1)..(7242): unsure at all n locations
atttttttcagttatctgcttccctgtcaaatctgtccttataaaatgttttgtccgaaatgctagtttatttgaacataaccacgactagagatgcataaaggagtgcatttttatcatgaacgtggtaacaaaagcaggagcttaatacctttatgctcaggttttcagaaaactcactgcgctgttcaagtcgatgggcgtaaaggcagtttacgacacaagttccagtcgagatctgtccctaattgaagcatgcagtgaatttgttactcgttatcatcaaaaccagttatctagtggcaaagaagctggaaaaaatcttcccatgctttcatctgcatgcccaggtaaaattgtttgcagggtactatgtaatttaggtatcatgaattctgtacttccacataatgcttgtactctggtaaaaaatatttgatgtttagaataagattcactcaaacttttaaaattttgaccatcaataatttctcatcgaatgcttagtttaaaaacaaaacaaatgatatacatagatttacctcgaaaagtactatcataatatcataaacttattagattttataaactaattctaatataaaattgattgttggaattttaagttgggcaggatcttgtcctaaatgtccctttttttttttaccgtagggggtagcttattagttgcatcttattttataaacaagagtaagattagtgcacaaatatattcaaacctcttcaacttgcaggttggatatgctatgcagaaaagactctcggttcatttatcttgccttacatctcagctgtgaagagcccccaacaggccattggtgctgctatcaagcatcatatggttggaaaacttggtctgaagtgagcactttgccatagttgatgtaaaggtgttaccttcatattttatatactatagacccttaaatatttggacttacagttgtacatgaatgaatttgttgtgtaggccacatgatgtttatcatgttactgtgatgccctgttatgataaaaaactagaagctgttagggatgattttgttttctcagtggaagataaagatgttacagaggtagattccgtattaaccactggtgaagtgttagatttgatacaggtaactgatttttttcccatgtcctgtcttttgatatgcatttaaaaaactatgagaagcttataccattttcatgcttgtgcagtccagatctgttgatttcaagaccctagaggagtctcccatggacagattgtgagtccctagtgtgcctttagcccctttgggtgaagtcctaatagaattcaagttggaaagtaaaatcagtcattatctgttcaaccgatatttcagatttacaaattttgcattgaatttaatcactccttcaataaaaagtcaatagaataattcatgttgctttggataacatgctgtggtatatcacagttgttttatctgtcatatctggaaactcacatatacttacgttcattgttgatccagattaaccaatgttgatgatgacggtcaactatatggggtttctggtggctcagggggttatgcagaaacagtctttcgacatgcggcacatgttctcttcgatagaaaaattgaaggatcagttgatttcagaatcttacgaaattcagattttcgtgaggttacactggaggtgaattcatcctgcatcatgttggcctgctttcaattctctcttaagcatgattcaagtggccttagattaattttgtataacgtgtgttgtgttaatgcacaggtggagggcaaacctgttcttaagtttgcactttgttatggattcagaaatctgcagaacattattaggaagattaagatgggaaaatgcgaatatcactttattgaagttatggcatgtccttcaggtactcccatttatgatacagtgtggcttgcccgctttaagtaaatggttttgagccataggatcttgattctatgaccttaattgttcgcttgcaggctgcctaatggggaaggtcaaataaaacctgccaaaggccagtctgcgaaggatcttatccaactactagaggatgtgtacatccaagatgtaagctagcgaaatctctcgctaaatttcatgctgtttgtttggaacttgcttttctatgctatgttatgttgtctcagcattggttggattcttccatgtcaatgtggagtagacctgaagcttcttacttgatgtatcctagtaaaaaaaaacagagagaataatctgacctcacagttcatttatggtgatccatcatgttgctgttaacatgccaatcaagtataactgtgtggtagtatgcaattcatatttaccgatcatcacatgtgcatatgaaatgctagctgtgatgcttctaggatctaattactactgtgcaaatatgttatgtttgctgtatgccagaatttccactaactgtaaagcttatggccttatgtaccaggtatcggtatccaaccccttcgagaaccctattgcgaaaagattatatgatgaatggcttgggcaacctggttcagaaaacgcaaagaagtatctacacacgaagtatcacccagtggtgaaaagcgtggcatcgcagttgcagaattggtgataacacagtggtggaaagcatttcccagtgtgggcagttgcttgtgccatcttggtgccctgcccacactaagcaaacactgaacacacagaaaagaaatacacgtcatcaaagattttgcatgcgggcaaatgaattttgttagattgtaggttttaccagcttttcttggtaatgtttgtatactacctcctcactgggaaacacagatgagattgtaacatgtaaaaacgaagtgaaccaaatagtagttgatctactcagctgataattccattgcaatttttcaaacagggcctattcgttagcatttatcttatgattccttaatttgttttatgtacaacagtgatctttttctcttcttctatgacgtgcgtgaaacagacgtttgtcttcttcattgaccttgatacagctttgccccgttgacatttgatggtgaagacatcaaagtgaactttgcaaagttgattaaaaattaaggagaagaccaactccgaggtgtgtttggaatccgcaccttcctggcccgtggttttgcatttggaatctctatataactctggagattctttggggaaacaatattttttagatgaagggaaaaacaaaatactccaatttggcagactgacattgcacagaaacaaagagaaggcctgcagctgaccgccgtacgaggctcaaaacagcaaactttatccttatcaagaaggccaaaatcactcaaaaataaacgatacaatttgtgctgcattttcatcagcaaatcagtagtaaattctacagaggttgaggttcagatgcaggctggaacatgtcggggagcgtctcgagcaggtaggtgaacagcccgcccagcaagaagatgaacacgaacgcgagcacgatcttggtgatgtacgctgccatcgtctcctggtcgcgaggattcttcgccgactgcttcgtgtcatctcgtctctgcatggcaaccgaaaattttattcagagaggaaatcgttgctcattttgttcttgatttccgagaagaaaagaggaggaaaaaaattttctgaacttcttgcataccgtgtcggacgccggcgtctggtagtaacccggcgcgtcctgctcggtgatggtctgcagcttccatccgtcgccgtagtcggcgagcggcgcggcggggccgaagctgacgggctcctcgccgtccttcacggcctcgacgtgcagcgccgccggtgcgccgggggcgagcttgcggttcacggcgtgcagcgcgtaccgcgccgtcgtcccgaacgcgaaccgccgcacctcgccggagctcctgcacttcacctccaagaactgcgagcacacacacacaccacccacattgagccaatttccttctcctcgttctcaagattgaggacactctaccgtagaaaaaaagtaagcaggtttaccggcggtggaggagggtcgccggcgccggcgccggaggctgccttctccggctcgtcgggcttccgctccatcgcgccgccgccttccgatttcgcgatggtcgcggcaaggcggaggaggagttgtggccgactgactttggcccgtgcgcgtggagcagcagcgaggaaaaaagcacgaaagaatccgctaccgggttgactttttcctatccgtttctggtccgggccgaatcgctcagagatttcggctcaataccacgcgggatccaccgtgatttcggcccaagattacgcggaatccaccgtgatttcggcccaagatcacgcggaatccaccatttcgcgagcacacgcgatgcgcacgcgcgaggcggagaccaaaccaaacaccaccgtcgcggcgcgtgcgtctcaccagtcgcgcgagcgagccgcgtgacgcggtggtggtgggcaccagcgatgggcaagggcggcggctgcatcccgagcaagaggcaccgcgccgccgcggcggcggcagcgccagcgtcgcactcgcaccagcgcgagaggacctcgatcccggcgccggcggcggcgccgcggccggtgcgcatctacgtcgtgttctactccatgtacgggcacgtccggctcctggcgcgggcggtggcgcgcggggtgggctccgtcccgggcgcgcgggcgatcctcttccgcgtcccggagacgctgccccccgccgtgctcgcgcggatggaggccgacgacggcggcggcggcngctactgttaggactttatccccgtcgtggaccccgacgggctccccgacgccgacgggttcctcttcggcttccctgccaggttcggcgccatgcctgcgcagatgcaggccttcttcgactccaccgtgccgctctgccgccaccagcgcctcgccggcaagccagccggcctcttcgtcagcaccggcacccaggccggcggccaagaaaccaccgcgtaagtatccgccgccgccgccgcgagatcgcatccctctcgcatcagatcatctcactctgctccgtgaatctctctggctgcatgcatggatgaagctggacggcgatcacgcagctggcgcaccacgggatgctgttcgtgccgatcgggtacaccttcggggaggggatgttggagatgggcgagctccgcggcgggtcgccgtacggcgcgggcgtcttctccggcgacggctccaggccgccgtccgagctcgagctggccctcgccgagcaccacggcaagtacatggccacacttgtcaagaaaatggtgcacggtgcctcgtgatccgaatgctctaccaaatatggaatctctcgatcgagaatccttgcaattagactgagatttcaagccgatatcctccagaaattcagtggcattgtgcgaattgtgacctgactatcttgcattgccctgcctgttctagcatgatcagacccaaatgtgatattgggattatggaacagaaaaggatgcagacggtatgcataatctaggtttgtctaaaagaattacagaggtcatcaataaagacatcaataactgagaacgatagtgagaattaggcagaggtgacaatatatcacatactaatgtatagcaactcaaaactatgatctccaactccaagtcaaagaggactaacatttctaaagcagtaatatttccagttttggatgtgataaatgtaaacttgcaactacaccaagaacaaggggaaaaaataactcaggttcatcactctcatttcatcattgtgcactcctaaagagtttttaaaaaatcgcagattctagttgtacaaagaatatgtccaggaaaaaggtcaggggtgtctacatttctgcagccccaacaaatctaacattgcccaaccaaccccatacaacaaatgtctgccctacttttctttccccgaggaactattcctaatatatctaaagaaacactcgtttcccatgaaacatatctaatctgaaaacagtcttacacaatgcagcttgtaaaattaatagcatctcacttagcaggggtagcatttgttttattttgcatagtacttgcttgggggtcttcagttgtcttggatgaagcaccgtcaatggcaatgttccccaagttcacagccattgcatctctctcttcattctcaatcctctgtttctctgaaacaccatcatcggacgaattctgtgtcaggtctgatggccgtttaggctgccggcgaaggggcccgacatcaagccatggatgttgaagcagttgagcggctgaaggacgcttttcaggaacaaaatcaagtattggaacaagaaactctgccatgccatttgcatctatatcactgaattcatatttctcaaccaaaaccttgttgagcggccaaaaccgcaagcgccgaatgtgcctcaaatccccataacgattgaagaactcacgtgaatatcgaccacccaaggcaatctaggaaacaatgtctttgtattttatctataattcagaacaatttacatgaaagcttacgaagatggaaaatttgttacctttcgaggcatcattcctaatagctccatcatcagcgcgaggtgatcctgcttcaagcaagaattgatcagaataaacttccaatggaaagggatggcattctgtactatagggaagacaactagatttcatatctatcattatggttttgctacttgcccatatctatttcacacagcatctccaaacaatggcaggtgtttaagaattataaaaagattactcagagaacttttcaattagtaatattgctaaatgaaaagtttgaataaattcagcagttgatttcccacaaatatgaagtggtcaatcaactaggacaactgaataaaaggtttgagcttataatgcaacttgacaaaaaaaagcaattggcatcatgcattcatgtagtcaatgatatgttccaataccatataccacaaacttgaaatgtatttatcaatcacattcagaattcattcaatcaagataaccatatgacatacctgaaaagaactagcttagaccagtccttaacattacctttcatctgttgccgatcatttttagaaga

SEQ ID NO: 9418 - DNA, 3252 bp, Oryza sativa
taagcaaacatgaacaagaaatgagctgtatcaggccggtaccccacaatgttttatgtatatcaaccttaccattgtccaaacatgatcgccttcaaaacgaaatgttcttatttacaatatttaaaatttgattatcattttttttctggaataattggttagattcctaccgaatcccacaaatctgagtcagaagatgcatcgaaatgctcaagctttattaagaaataatttctccaaaacaatctttgtagctttcattttatttgcttttggttatgagatcatggcacaattagatgttgacaaatatcaaatttcagagtgatgttccttttaagtattgtcacaaaagaaaacctaggtacatgccaaactggagttttgggctgtagccagtagatgtcatttggcttgatcactcaaatttctattgtgatagactcctatttttttaagctaaagtgttgacaggtgatagtttgagttaagttttgtatagatatgaaatgtcttggaaagaaataaatagacatacctcatccctgtcataactgtcaccactgtgcggatcaaatagcacatctcctgtggcaagctcaaagcatatgcatgcaaaggaccacaagtcagcagatgtagaatacttggatcccagtatcacctcagggcatctgtattgccttgtttggatatcacttgtaaactgtttgtatgtccaacatgcatttccgaagtctaccagtttgcacttcaggtcagcctccaatgccatttttttcctggtccctttgctaccccgtctactcccttcaccttcttctttcttgtctccatcctgattcggactaccctcgtttgccgtactcaaatttcccctatcatctgacccatccgtctccccagatgcaacagtcccacttccttctgaagttgcagcggctgcacgcttggctttcctccgaatcttcttcttttggttcctggtgagaccaccattcactgatggtgcatgtgcctttggaggaggatcatcagttcttgcagaaggtgccaccagcggcacacctgatttccgggggtccttcgagggatcaatagtggattcaagcaatatattctcaggcttaaggtcagtgtgaatgattgaaagtgtgcggtggagatagtcaaggccaatgagcacatgtcggcatatctccttaaccatgggaagtggaattccatggtaatccgtgtactttatcagggtcagcaaattatcaccaagaaactcaaacaccatgcacacatggttcccattaggccccgagtgcttgaagtggtcaagaagcttaacgacgcaccgagagtcatcaggatcaccatcggcaatctgcttcaagatcttgatctcatccatggccgcctctgtgtagtgctgtgcactcttctgcaccttcagcgccacatatctctgcatatatataaccaacaaattcagaaacacaaagggtatataagaacagatacatttcgtgtatgatgatggtgggattaacgaataaaacagtactcattaacaacgaaattagccattatgataccaccaaagcaataaaacgaacaggttgcgggtacaaacgaaaccgcccgcaatacaccagatgattaaaacgcatccaggtcgagatttcccacaaatcatcacgaatctaggaagggaaaaggggggaacgcccattccacgaggaaatttaaggggggggggggggggcaaaagggattcgaacgcacggagtggccggtgtcccaggcgagccagacggtggagaagtggccccatccgagcttggactgcacgacgtaggcgccctgcttgaacgagtcccgacgcggacggcgtggtaccctccccggcggtagtcctccgtgccctcgtcctccgacgtgtagtcgctgctgccgccaccgtcgccgtcgtccccctccgtccccgcctccgcctccatctccgcctcctccgcccgccgcctcgtcgcccttgcctccgccatcgccgggggatgccctaaatctgagcgccgcgggatgcggtgggccgcgcggattaaggttttggggcggcgccgcgcggattttggtggtggcggaggtggagagggtggtggtggcgctcgccttccgccgctgctgcttccctcaccgcggctcgaggggggtcagttttattatggcaaaatttatcggtggggacgcaactaatttaattaccatcttaataaattttaccaaacgacttttaaatttgggttcgatttttatttttatttttttgggtgagaggacaggctaactaaatatcctccgtgaatctacacgctttgagggtacattatagtaatcatagtaataaaaagcaagtttaatagtatagctaactactaactctaaatcatgtataatcaatttagtagccaatttatatataatagttacctataaacatatgctacattattaatgcatggtcccacctgtcatacaatcattgtgtcttgaaatctatattatagctggctataagtctataatctagtgctcttcttttctctattgtctccttaaagtatgattatagttggtttataatctactatttgtacatgctctgaataaataaaaaaggccaattgtaaaatggtcccgttcttctcatcatattgtaattcaagattttgagtatggctcttagttcctccattcaaaaatattgctacctagcacgtgattggatatttcctagaacaatgaatctggacaaattcaatcacgtgttagatagtactccctccgtcccaaatataagcatttttagctatgaatctggacaactgtgtctagatttatagctaaaaagttgttatattctgaaacagaggtagtaatattttaaaacgaaggaagtagtttatgatgggattttctcagcatcatttttttaattcaatgacttgtgctggtttcataacattaactggtaacatggtctgcaatcaatgactcgatatgttggggggagggggggtacgagaatttcccatggatttgtgagcggtatagatacatatactaaaattgttaaaagttcatgccaatatcatgtattcaacaaaaatgctgaaaaaattttgtaggttgttttgactttaatcaaaatcaaattgtttcaaatttgatcaagcttataaaaaaataacattttcaacc

SEQ ID NO: 9419 - DNA, 6701 bp, Oryza sativa
atttcagataaaagcatagcttgctgtctaccaagctttatttttgcaagaaagataaatgtgtaggacgcctgctacctggaaaagcaagttcatgttcaggttcatgctccctgtcaagtgcaaggtcaattccaagcatcaataattccttgaaaaatataaacgcatccactatgacatggacatgttggagagaaacaagggaactgacctacactgatgaataatcctatgcaattgagacacatgaggaatagtgaaaattgttggaatgttgggtctacactctacacggccgcaacttatatatttgtcgcgtataaacttgtaactctatttgcttgacacggtaaatctcttcactgttttttttgctttgattttacagagatttcagcaacgagcatatgaaaaatgcggaaaattaattcaccatatcgccttggaatattctagagaacagggaagagcaggcttggccatgtgaacttgtctagaacttcgatttggttaattagaagctttgtacggctcaaaagaatcactaccagcagtataatattaagggcatgttgagttccaaaacaaaattttttacgctgtcacatcgaatatttggacacatatatgaaatattaaatgtagaaagaaaaccaattacacaattcgccaggaaattgcgagacgaatcttttaagcctaattgtgctataatttgacaatgttgtgctatagtaaacatttgctaatgacgaattaattaggtttaataaattcgtctcatagtttcttgacagaatctgtaatttgttttgtcattagactacgtttaataatataaatatgtatctatatatccgatgtgacatacgtggacaaaattttttgccaactaaacaggccctaagcaaacaatattacagacaaaaagcacaaaagatagataaagtaatcaactgcttgttttaattaatcatttttctccactaagttgttttaattaatcattttcctccactaagtcccatcacatgcatgagctcgaattctgaataagaaaacaatgtctccagaaacaatgttgattttctacagtactgtttagtgcagtagccagggactgatgtatggatccggactcacatatcagcctatcaatagtactgctgcagatgatctgcatccctccagaaaatgctactcttgtacccttgcaaacagtagcacacacagcaagaaactgttatctgcccgcttctttacagctcattgtttggtttttgtttatcagtcaaactaaaatttagattttaattcctactttatcgatagaaacgacgcactatcgaaacgacgcactatctaaaaatagattttaaactcaattaaatattgatttttattttttatgatagtttatttttcagctataaatataaaaaagttttatttgtatttttttacttcgtttatttttgtgctgttgttttctgacgaaaattaacgggcaatgtgtctgctgctccctccctgcgtcgcagactcgcagtgcagagaggcgagagctggaccagcggcagcgcggcgcatcagcactgctgccaaatcggtgcggctgtgtgcgtatccctgaaaattcagtgcattagtaggggctgaaaattaggtgacatttattattattatttatttatttagagaataataatttttacccggtctctacatctaatcggatataaacaacctttttaaattgagaatttagcccctcgtaaaacccaatctgaaaattaggtgacattgtggtgtttagtagcacaaccgcatatactaccagctgcacacgtacggataatcagtggaaaacaaagagcaatctgagagcaattcatctgtgtcgcgggagcagcagcaatgatgctagtaaccgtatagtttagggcccattttgaccaaaggatatttggagaaactttaaaggattctaattctaagataatttttcctatgtggaatgacctaaattataggaattttggaaaaaaaaatctaccatagcttagggcctctttgatttgtagaaaaattataggatcttgaaggatttcaatcatatatgaaaatttactatgaagacctttgaaataaaaaaatgaaccatatcctattattgaaaattcctatgtaatggacaatcctataaagaatttgaagaaaattttgcaagagcttcaactttttgaaaattttcttttgagtctatctctctcatccaattcatgtgtttttaaatggtatttcctgtattttttctacgttttgcaatcctctattttgtatttctatttctattataattgagttttttatattctttcgttttttttcatttctatgatttaaagggtcctcaaaactcttagaaaaattccttgtgttattccctcttcaaattcctatactaatttcctgtgaaacatccaaacaacaagattgagtaattcccgtgttttgacattctaattcctatattcttttattcttgtatttttaaatcttgcataccaaaggagccattagtctaaattcttaggccttgtttgcaacaaaagaaaaacaagagagaaggatttaaggatttgaaaaaacatgaaccatgaaaattcctttgaaaatcatatgaaatgaatcatttctttaggattggacgatattttaggattttcaaagaattcaaatccttagaatttctgtagtgtcctttggaatgaaggaatgcaactttaaaaatcttatagacctggttttctatattccatgttttatctttgagaagtttattctcacctcgtggatttcttttaacgtgtctttaattcctataattttgtcgtgttatgcaaacgactactattttatgcaggaattttataaggcatgagatttttatccccgtgtttcaaaatcctatgttttaaaggaaccggtaagattagcaacgtaaattttgatcataggaagtataagtactgcctctgtcccaaaagagtacagttttgcattgtttatgtgcaatgtttgattgttcgtcttatttgagaaaaaaatattattggtatttttattgttattagataataaaatataaattgtactatatgtgactatttttaattaattttttaaataaaacaaacgatcaaacattggacattaaaatccataactgcacttaaaataaaataaaatgagatgtagtagtaaagaataccctccaatatcctaccgagatcacaatgttcttttctcatttcggttccgttcgtttgggctattagggaataactaattactatctccgtcccaaaataaacacagccatgagtttctatgctaaactttgatcatccgtcttatttaaaatttttttatgattagtatttttattggtattagattataaaacatgaatagtattttatgcgtgattattttttttagttttttcaaaaaaaaaaaaataaacaagacgaacgattaaagttggacacagaaacttatggctgcacttattttgggatggagggagtaagttttaattagtataaactttaaaattaattatatttgatattttaaagcaactatcacatataattttttttgcacttaaaaagcgtgagaacggaaaagggatattttcgtcacatgtcaacctcaaaacccgaagacactgctgacacacacaggtacagatagagagaacttgcagtctttcagataaggctacactgccactcgaccaattcttgcaagaattggccatggcgttctgcactcctactgccaccactcctcctcatgccactccacctcctctcaccacctcatggaagcagctcgccttctgcaactcttcccggctagccgccgccgccgccggcggcggccagagggcgcggccggccggtgcaagtgttgaggcgcgcgcattggcgccggcgtcgacggcggcagacgcggcggcggctgcggcggcacccgcccctcccaacgtggactacctggcggcggagttcgccggccacggcgtcagcttcgaggccgtcggcggcagctgcgccgtcaagatggagctgcgcaacggcagcgccgcgcacgtgctgctcccgggcggcctcgtcacgtcctacaagccggccatgtggcacggcgcccccaccgaggtgatccacaccaccgtcgccgagggcctcggcggccgcgccgtcatccgcggcggcgtgtcgctggacctccgctgcggcggcgccgccggcggaggcggtgacgggatgccgccgtggtcgccgagcggcgcatggtcgctccgcgacgtcagggggagccccacgggctccatcgaggtcgagctggcctccgccgcgccgccggaggcgagcggcgtcgaggcgaggtgcgtcgtgacgctgcacccggaggcgctggcgacggagttcacggcgaggaacgccgcctcgccgtcgccggtggctctgtccgccgcggtgtccacccacctccgcgtgagcacgccggacgccacctacgccgtggggctccagggctccgactaccgcgccatagatcccgtgctctcggagttcgccatcgtgcccccggacttcatgtcgcggtcgtcgtcggcgacgacgctcgcgcggcgctgggccaccaagggcgtcgacgcggtcctctccggcggcggcggcggcggcgcgggggcgcaagaggccgacggcgaggaggacgacgactacaagcggatgaccgaggagatgtgccgcatctacagccacgccccccgccaattcaccatcatcgacagggtacgtacgtaaaaccaaaaccaaaatggtgttcgcaaaatgaggatgaaaattaaggacagataaaacgagaaaattatcagtgattaattgaattttgtttattataaatttgaaaaataaatttagttaatattttaaagcaacttttatataagaaagttttgcatgaaacgtatcatttagcggtttaagaaatgtgttaaggaatactgaggtagaaagaaaataatattactaaaaaaacacaaaaaattcacacacgacagctcaattttcgtaataaaagtgaaataaatttctcaaattcgatctgaacttttgatcaaattcgtttgatggtgcaggggaggaggaactccatttgcgtgcagcggagagggttcgaggaggtgtacgtgttcagcccggggtcaaagtaccagtggtacgggaagtacgcctacgtgtgcgtggggcccgccatgctggagcccatcgtgctgtcacctggggccacatggtcaggggctcagtacctgcgcaacccaaacctctagatagacaagacaagacaggctagctggcgactcaatgctgctggggaacaaaacaatggtcattgtacatgttggctcacaataagcaagaaaaacatgtgaaacaatatatatatgtttgcaaatgtgtttcactgattactgtggtgttctacttatgcaagatgcgatgctcaaaagagcagaatcatgtgagatcagtggagatgaagcttcaccaactatggaaatggatacttggtagccaacatttgggagactacagcagctgcactgagcagtaaagcatttcaccactataagaacaactgtctcacagggagagatttttgaacaagtttatatatatagtcttactgttgccccttgcatatacatggacaaactaaagtaaacctggtgaaccaacaaccttaacccactgttaactgtcaagtaatgcgcaccctacaattccaaagttgtcaccattttgcatcctaccaactttggaccaactcattactgaggattccctcatgcatcttctgaaaccgctccgagcgccgaactaacacatgagcagtggagccactgtcctgcttcgcactgttgagccaacatataatagttaggaacttaggatagaaaggccacttcgtaaatacaaaatctgaatctatccgatcaatataacatgagctggcacatcaaacatgatcatgtgatgattaattacaatttaattggcttcccgttgtgatcccacagttggattgatatgttttttcctgcacaaagttaatcaaacagtttttgtttggcaatggaagtatttaaagatggggcattatgtgttgactgcaatgtgctacatgcgacctagttaacaattatgtgatgtatgactagcaagtttctctagacaagttcatttttgttgtacctatagctttgccttttctaagtctttttctccccctaacttaccccattcttttcactacagaggccgacattccaatttggaattctgatactgctagtgcactatatatttgtaaaaggaaaaatctgaaaagcaaatctttggacttgaatgaaggattgagtcatatgacgtaaattctcctttacacctctacactgttctacaacaatgaatattcatttggaagatggaatgaattcaagagcttctataaggcaaattaggatttgtagaaagcaaaagcggcaagtagtatgcttcttaccaactttggagaacctctcattaaagattcctgcatgttgggcacaaccattt

SEQ ID NO: 9420 - DNA, 48175 bp, Oryza sativa
aaccgaaccacacggcccatattttgctaatatggccggctaaatcaccaagacaggcttcggtgatctggtattctgtcggcctcgaggctttgcagaccgaagcggcgtaataacctaagactaacatgcaatcaactttctaagctactgacgtcgtgaattttgcacctaccatgcatggctcgatccttcgaggattttattcacaatcaaccaagaattctgtgctgcagtatacatggtaataatatatatatacacacccgtggatcctaatgattatgtggtgtgtggattcgcaatgcagcccaacatctgacgtcttcccacattggctgactgcccatggctacagcccaacattcgctgcaaagttggcattttatttttacatgatggacaatgtgtaattactatcagtttgttctagtagagctgaataaattgaccgaactgaccaaagtattattcagttaatcaggttctgtttctattttttattccgctaattcagttttccagattgttcaacagaaatatataattcattcggtgtaaaaaatattataactgaccaaatcagccaaacgatcacccctaagcagtgaggcatgtcctcattctggatggcagcaagtaagaacaaatggtaaaaggaaattacaagcataagataagatgatcaccgccaccctagcagtctagccacaacatcatggatccaatgctatattgcttgaaataataattaaaatcacaacaaaaatcacacttcagaatgttctaaagcttctctaaaactacctgataaaagtgaaagtagtaacttagaacataggaattaaactcctccaaaagaaaactatcattacttagcaccataaagacttacgttatcattgtcacaagcaatcatatcaccatatgaaatctgaaatatcaataagaagcagaggcacctttcagaaaacatcttagaaaaagtttgatgtagactaatttccaggaaaatcgctatacattccaagctgacctggtggcatatacagtatgttggttcatttggatcaattgtttgatccacatccataggtgcagttgttttcttgttgctacctggagggggcattaagtcgaagtccatacccctttccctgtcccattccctctctctgaacttctttgttgcttgaggtgtactgaaaccaggcctccgtttgtcatccctgctaaatgctgaaattgcaggaaggattgatggttcatctggaggtatctttccttctgcaaatgagatcagctcattaatataacaatattctgctcaataggatgacctttctaagatacaagtaaatgctagggataattgtgattcagaccctattctgaaggctaactaccaacttgcccccccccccccttcctttccaattttgctcatttgaccccacttttcaaaaacgaacctgccgtctgaccctcttctaaccacaccattaggagtgttattagaaaatgcatttagagaatgaacaagaccaaaatgcccttggaaaaataaacaagaccacagtatcggcctttcccgtttcagcctcaaatctaggtcaaatttgttaaactaagtcaaatatgtcaaacctgtgtcaattttgtctcatattttagtcaaaaattgccatcacatttttatagggataaggtaaaaaaaattggatcaaataaacgaagattttgagaaattagggtcaaatgagcaaggatataaatggtatttttccctgagttaaccccgttaggttgtcttcatgaaacaggttcatgcctgatcttcatttttgaaaaaagagggtcaaatgagcaaacttgaaaaaaacagggtcaaaaacacaattgctcctaaatgctactatctcttgattataccttgcttcaagtcttctgcaaactggcctaagtcttcatccagacgtttgatatgactctctatctgtacaataatccatccatggtacttacagttaggtattaacaaaatattataggatataaatgacacaaattggaacaaatatcaaaaatggattttgtttcgttagtctgggtccctgaatgggacacagtgagttgataatgtaattgagattctagaattaggacatgcaatttagtatatgattctagcattgatgtaatttagtgtcaggcatccgaacattcaatttagtatatgggcagtatgagacataacacagtatgacagacatcaggcttttcattaaatctcatgagataatctcaagatgccagatactattagtggtttgtaattgtaacaaaacagagtttttagactgcaaacattagtcttcctgtgtgatacttctaagttcgtaactattcattatggaatctggagttgaacttgacaaacgcaaactgtcaaaataagtttggactttaatatagaacgatcaagtttgtttaggtgtatcaattaaagggtatctaagatctcgtctaaaagaaaagcgggcaactaagatggcacttaacatgaaatgaaatgtacaagttccttgagttacgggactagaaaaaaatgaagggtgcatgcagaaccaggtcataagcttggcgtgcaagcaacactttctcggtgcagagactcaacgcattgtcctgactagcttcgatgtcctttttcattctctctgaggcagattcatcatcatccatgtttgacctgtcgaacccatgggatggcactccgagtagatactttatctgttctttggtctgtcccataatgcctgcatcaacagaaacataatccgtacaactacaaacttgagaaaactatcaatatcacataaatttaatctataagtgggcactagccctatacaaaacaatcacatgacattatagccttgtatcaactattaaaaattactacatatcagaagtacccaaaatgattattttttaaatttttttttggataatctgtattttagaaaaatgaaaaaggagtgtaaaaaagatcatcaccatgagccctctcgtcgagctcgcgcatggtggagagaatcctctgcaggtcgccggccagcgtgctcgaatctgcgacaagaaatggagccaataaacagaagcaaatcgaaggcaaccgcaaaaaaaaattcgacggcctctgacacgggagctagcaatctcacactcgaggtagtcgtcgacgtacacgccggtgcgggcgatcgccatggcggtcgattagaggacggatccggcggcgtccctggctcaatccttcgatttggggtcgatttgaggaccaatccggcggctcccgatccttcgatttggggattagggtttcggggaggacggcggctagcaaaaaaacattttttttcagagaaatccactgggctagtgggcttgtctggttctgtgggctctgaaccgtcgggtggaggcctcatgggcctttcctgttccctgatctgtatgatatttttcaccagatcttgataaattaggtcgaattttactatttcaaatttgaattcttgaaaaccattcaagttttacgtggaatctacttccatcccaagtaaaacttcagaacctcaaaatttgacggttttcaaccctaggtaatatagagttggtgggtttggactataaacgtgaatctattggtgggtggcggaagagatgatgcgaagttagcgagggacgacggtggctcggaagtcagaactcagaaccatagatgatgaggatgctttcagataaccttgagtattcttttatgaaagatattatagactattgattttgacacaagcacacaatcatccctatgaatatgcacacacactttacatctatctttgtttcgtaagaacacctttaaaaattgagccagtatatattgaaattgatgaagttattaaggtgcttcaacatcgacaatacaataatgtctccaagtgttttaagcatccttgaacgtgatgtgggcgtgtgcatgataacacgtgggtccatatttagctaatacttcctccgttttacgatgtaagtcattttagcattttgcacattcatattgatgttaatgaatctagatagatatatatgtctagattcattaacatcaatataaatataggaaatgcaagcatacaaccaaaatcaagaagtgaatgcaagcatacaaccaatgagtatttagatgactctttgggttctaataaaacatttaatttatctcttcatttaagtcgaaaaaaatataaagactataaataggaacaacttttttggaaaaaactcaaatctatttataggtgtaacttttgtggatggagggagtatcataatattatgaatctggacagatagtctgtccagatttacagtactaggatgtgttacatccgtccaaatcccttatattatgagatggagagagtacatcactagttatagtactccctccatctcaaaatgtaaaaaagttttggttggatgtggcatatcttaatactataaatttgggcatatggtctgtctagatttatattactaaaacatgtctcatccaacccatccaatctaaactaatacaaccaaaactcattatatttgggacagaagagtatttgtcaagatatttttaaaaaatatttaatctacttttatgaatataagtagataattcgtgacgacaatccgatatataatgtgttttcaaatagtctagtcgatcctttctactcaactagtcatcaattattatagtagtttaacagtttactaaaataattattaggtggatccttttggttcttaaaaagttaaccggaagattatcgtattttatagcgtaaaaatcatggtacttatagagtaccgtgaaaccactcttacattgaacgaacaaacacaagttacaacgacgacgacgaattttagcatgtagctagcgcaactattggatgcatcgcatcggcagttcggcaccgcacacgaacacggaaaggatatacttcatccgtttcacaatgtaagtcattttaacattttccatatttatattgatattaacatcaatataaatatgggaaatgttagaatgacttatattgtaaaacggagaaagtagcgaggatacatggtcctagctgattcgtcttattcaaaaaaatttggaattattatttattttgtttgtcatttgctttattatcaaaagtactttacatatgacttatctttttttatatttgcactaatttttcaaataaaacgaatggtcaaacgttacaaataaaaagttaaaaacgtcacctattagtatatcaaaaccgaagtaaccattccaaaaggacagagaacaaacaggtgctcataaggtgaccagaacattcagacaaatactgtttataactgtcacgcacaactctcccaagctgaaggtaagagcacaacgtgtaccaggataatgcaattcatagccagaaaatctacttcaaaatatttcaaatataacaacctagctagcatgacatattctaatattataaatcttacgtttaaatttttagtacatgatatatcttttttattttaggttgttatattttagaacggagaaatcatttattttggcgcgcaggccagggtagctagatagtgccgccgttgcagcggatgacctgggcgttgatccagccgccggcgtcgctggcgaggaagccgacgagcggcgcgatgtcgtcgggcatgccgaggcggcccagcggcgcctcggcgatgtaccgcgccatgtcctcctctgtcttgccggtgtacatcatcggcgtgcccgtggacccgggcgccactgcgttcgccgtgatccccgtgccgcgcagctcgcgcgccaggatcttggtcatcacctccaccgccgccttgctcgccgcgtacgccgcgtaccccggccggagcgacccgacgcccgacgacgagaacgtcacgatgcgcccccggccgccgcgcgccagccggttcgcggcctcgcggcagcacaggaaggtgccgcgcgcgttcacgccgaacatggcgtcgtacgctgcctcgctcgtctccgccagcgccgggtacgcgaagtccagcacggccgccgtcgtcaccaggatgtggatctcgccgccgaacgccgccgccgccgcgtcgaacagcgccctcacccgcgccgcgtccgacacgtccgcctccaccgcgatggcccgcggcccgcgcttctcttcctcctccgcgcgcaagtagccgtcgttgatgccgctcaccagctcgttcgccggcgcggggtccccgatgtaggcgaccgcgacgcgcgcgccgagggacgccaggtgcctcgacacggccgacccgatgccgccggcgccgccggtgacaattgccacgcggccgtgcagcatcagcggcgccatcacgccggccatggcgttggtgttcgacgacgcctccatccagtccagtccagtgtgtggcgttctctagctagctaggagagcagcacactacactgtcagtgtgtatagctcacacactgatagttgatttgatttgacgtatatataggcaccggatttactataaatagactttcacggcgaactatatatgtgaaagaatctcaccgactcgatggccttttctcgattgagattggagatctactacagcactacagacaggagtggccgagtgggtagatccgcacaagtagtgtagactgtgcacttgtgcagcatgtatgctgtgtggtccagccagaactttgatcgctagctcttgattatatttggaaaggactgtttgttgtctatttttttaatcacatgaaaatgccatcaaaatttagttacttttggatttttggaatcgtgtggcccttcacagtgttcctacgtggagcatggccacggctcaccacgtaggatagcatgctatcgtggcggtgagagaccattacttcgtgggtaacacaagactaacttgagagccgagagcctcagctgaaaaagctaagaaaaacaaggaatcttactgcgaggctgcaacaatccccaccatccccacctccccatccttggaggagaagagaggggagccggcaatggacgacgaggaggacgccaatccactaccgagctccattactgctgtcgccgtcgccctccgagccctcaagccccatctcctcgtcgtcggctgggaggggaggggccccagcgagctgactaccgctgaggcgcgggaaaggagagagttggctatggtggagctcaagttgccagccactgtcgctgacctttggctagatccaggcggcgccgtcgagctctaggccgaatcccgctcctcctcaacgcttgagaggagagaggcgatgatggtggcagccgagcgcacacgccgctgttgtcgaggtcgtcgtcctttgaggaggggcttcgtctcctcatcgcgggccgggagaggaggggcactggcatgcgccgcagagcttgtcgtcgtcctctccctcccccccctcccgaccgagctcgtcacgtcgccttccacttggtggctccgccaccgccgtgtccctagcctcctaattggttgctgccaccgtgaggagagaggaggggcaccatggagctgtcgtcctccccccccaacccccgctactcggtggcttcaccaccacctcggcctactcaatccgccgccgcgttcccagcctctttggacgtcgccgctgcgaggagagaggaggggcaccatggagctatatatcgccggcctctagtggatcatggtgggtggagtaggggagccgtcagttggtgctcgtttgccactggctgccatcggtggattgaggagagtagaggggagagattttatatttgcttctggaaattagggtgtgtgtagggatggcaatcgggtgtgacgggcacaggtagtgcctacccatacccatgcccgtgagattatttgtgcccgtgggtatacccattactacatgacgggtaaggatggttgcccatgcccattgcccgcgggcgccttatgcccgcgggcgtgcccgtttacccgccacaacaaaagcagtggaacaaaaagtctacaagctactaacttcgaatcgaacttaaaacatcaaatattctccacctcggtgtcgtgtctctcctctggcggcgatagagtaagaggagagaaataataagggaaataaaagggaaaccgtagaaaacaaagaacgtggcttatgtattctagtggattttactcctagcctacatgtaagttagatttcgcgggtaaacgggcaaagcgggcatgggtagtgattacccatacccatgcccatttacccatcgggcatagcttttgaaccaataagatacccatgggtataaaatggagaacaaacccaaccctaatagggtttttacccgcgggtaaacgggcaaacgggcacaattgccatccctaggtgtgtgcgtgctaaatttttgactttatgtaaattgaaaacacattaggactaaaatacaagatggcaagggttgacatgaaaaattgaaaacactccaagagcaactctgcattgtgggagaggaggtgtgatctcggcctacatggcacatgaggtccattattttgagtagctcgcactggtattgcactaagatctatacaattacagtatcaccctcaacttgttttttctctcctcctcccaaaagcccaataacagttaggtgactcggccctattgtgcttttcattttcgacagttcccccgtcatcgggaagtcatcactatcctcacctcttaacaattaggatctagcacatctttttcctactaccgacattgtccagcaccctcctctatagtcgtggtttcgtcaccacctcacctcccgtgttcattggccacaccctttccacctctcccaaacccctctcccaccttgaccccaaacccataaacctaaactctacgttctctatcggagttccaacacaccatcgtcatagctggaaagtcatcgctaccaccacttggaagttcatgccactatcgctattgctagtgaattaccctcctgcttgtctttccaaattcagtgctaggttaaaaggtgattgcagttcctatcttaaacctagcaatcctttatttggaaatatggaaggtatgtgactgaaaatattctcatactaaatgactttgaggttgctcaaggttatttatctttctgttccacatgggtcttgtttagctagtggtggaaccatcggttggtagcttgaggttctttcctatgtttggagaggtacgtatataccttcgcactgcatttgagatgtaaataaattaaactaattattttgattaataaacaagtttatgataagcaatgacaagacttttctaattgttgaggtatgagagttatatatataccttatagtgtgtacgttagtccagaggtatctctacctctagatataccactaaaaatatatcttaattggcacaaatatttatacgcctcaaaatgtaagataaattaaaaaataattagttctcaatcctattctaatatattagattagttttggtatctttttttttagaaaaaatatttctcaagtataaagaggtatacaggagtacacctctataagaatgggagataatatctcacaaatgctttctaacctggacatgtcctccctgcagctctgagaacattttccagactccaatacgaatactgaaaaggatactctcacttattctcctctaactttgagtcactgatgtatgggtccgttgggtagagggtccacgtgtcagtgacccacgtcagtgggaaataattgagttagagaatctcaatctactgctatagtgtgtactgttgtccattaaatttattaagttagagaatctcaatctgctgctatatgtgtactgttgtccattaaatttattgcatttcatgcaaaccagcctgtcataggcggttccccatctaacactgaagttacgatgcaatatcttgcattagcacctccacatttatatatacacactatctttatttaaatttttatcttaaaatatagttattcttcacatacctcctcatctcgattaaccgtaaccctcctctctataattttatctatttttaaatttatgtgcaaaacctcaaacgtacatattttaagatgtagtgagtaattaacagtctcacacaattatgtgttcaacatacattggacattatgaaccttttttttttctattcgtttccttccgatggtgaaatcggcacgcgtgatattcaatactcctatttgccttgtttattggcaggtttatcttttgtgcaacagtgaattgatacctgcttctcatctaggcagtgtagagcctctccttgacgaaggttagagctttgcatgtgaaggggccgcgtcatagctaggatttgaaggtcctgttcgaaatacatagtgaggtcttaaaatttgacagtcaaatccccacgttcttgttatcatgattgacaagatataacttttagaacgggaaaaaacgaacaaatggtcaatcacaatgattcatagaacataataatatctagttcagtagatttaactttatgtattaggcatgcatgttgtgttattttacttttcgttctaagccttaattctgaccttacgggttttatgggctttatcattctagttatactgctaattatattactactaattataagtatacttagcacttcacgtaattattaagatttgggaggcctgaacaatcgaacatgtcatgttccgacggattccgagttctgcatctgccactctgcgtgtgcctgaactgttctttgtttttatggggaatcgatgtctgaactgtttttagccatgaaaaatcttgccggatctatatatgaacttgtaatctgtggaacgatgtcagtcgattgagatcacatgcaggtgaacccgatcaggacaatgatcaggtcaggtgtcagtagaactcgtcagaaacgagaagagtttggcactgcaatatccatacatgatacatgtgcacagcagactctgtaaataactctagctatttgtattgcttattccctgtgattgtaactggaattgtaattccatttgtaagttcagaagtcggtgtacaaatgaaaattaataaatttaaaaataaatatagtccatgtgtgttaagaggaaggagttttaatatgctcaattccctttcctttgtcaacctgactgtgttcggcattgcctgtcgttttccatgcgcatgcttttcaaactgctaaacggtgtgtttttttttcataaagcatatatataaaagttgcttaaaaaattatattgatccattttggaaaaaagctaatacttaattaatcacgcgctaatggactgctctatttccacgtgcactattccacgattgggaacctccagcagctaacagagccacaatcaggtcctgattctgctgagattttgattctcatggagaaaaaggctatacaggacgtctctatggcatcctcgatgtataaatgatcaagtgagtaatggatctgttcgttagctggacactacagccggctgcggcaatagctgcactgcctcaacagtacaagcagtgcaatttctactgctatattgtagctgctgcagctgaacagccgcagcaaatctctaccaaacaggcccaataagagcatgtacaatactagattataagccagctataaacacatacgaggagataatacataaaagagaatggcagcgggctacatatttatagccagttgcagtactgactacaagacataatatgtgtataacaggtggaaccatatattaatagtgtaatatatatttatagataactattgtatgaattggctattaaattaactatagatgatttggagctaatagttgactatactattaaaaaacttgctctaagatgaaacccacgaaactaggttatagttattcctaactcctactccctccgtcgaaaaaaagataaatttatgtccagattaattgtactagaaaatgtcacctccaatactaagttaccttttttgggacggagggagtacaatgtgtagatagtagtaagctagggcccacgtctaaaacattggttggttgaaaaagggagagtagagagttaagtgttttttattgcttcttaccaggtactagtaatgctcttgccggatggaattactacatcctctggtacccacctccacaatagtaaaaaaatttccacatacctctgaaaagtttcgcaatcttttctatacctctgaattttgtctcatcccctatatacctttaacttttcattttaatctcctctatccctattatgttagttgcctgttaattttcttttttctaaaatgaccctatcgtccatttcccattcttacagttatatgctatctactctactttataattcaccaatgtgaaaaattgtaattcatgataaaatcaaatgggacataattatttattgaatagaaaatttaaactgttgaacaaatttattttttttggacaaaatccatagaagagttttagcaagaaattgtgaaccaaaattatttatttgttgggttcaaattttgatgatatcataaaagttaatttaattttttttatttttaaaatttgttgtcaaataattatattccctttgtttatttacaaatagattttttccatataagaattgtgcttttatcattaaactaacacaggtataagagaggggttatatagttaatttcaaaaacatttaacgattacatagagaagatcaaaatgaaaactcgagagtatataagggaataggcaaaattcagagcatctctctcaaggatatatagaggattttctccaattgtaaagtaggtagtaagacctcttctcatgcacatcgtggatgcctaaaatgcacgagatgattgatgccattttggcacattgacacttgaaagcagatagtacacaacacaagggaggaccaaccaaaaccagagttcttgtcttattaccttctccagtgctgcaaaactcggaaaactaccttactgttgttcagatttatcgaaatttggatgcttcgctaacaataacaatagatgaaaaggctaaaaaaaacaaaaaggataagggttacataaaacccgatgtcataagagtaatatatgagacctaacgacgcaaaaaaccagtcacacgagctaaaatcaaagtaagaactgacccactccccaggcaccaagcctatagaaagtctgttacgaaatttagttgccaagtcccaacccaagtagctatcgctcagccacgccgcgaaccttcagaatttgcacaatctgactgctcggctgtggcaattaacgcagaaaatatatcgcgctaattgccatttgttacactgctttcaactgcagattttgaggcgttcagcatttcgccgacaataggggtgccctccttgctcaatgcctgcttctgagctgtggatttcccatcaattgcattcttctccttttcatgtgaagcattgtcaagagagccctgtacaaagtgcataaaaacagaggcatcagaacctatcaccaccaatagctctgagtggtgctaacattctgaacaggttttttaaccacacaaggctctatgtgtgaatagaatgcttgcctgtccttgaagcagttgctgcttagctctcttctcctgcatcagcttttgccggttctcgtaaaaaccaaaatcatccaagattgatgtcttgctgatgtggtccttgaaaatcttgagcatttcaagaccttgctcaagcttaacctgaagcattacatctacttggtagtaacgcacatggagcatactgaaaggatcatcacattgtcatgccatatcaatagataaaaataaaattcatcagcttcttatacatgaaggtccactcatgaccataagcatgatgaagaaattgatatatatcatgtcttaagttctcatttactgaacgactaatctggttccacagcaagaaatttgaattatctcaagaaaatgacgatgaaattaactatctaaaataacagagacattaatagtacccttaatggcccgtggcctgcaattgaccattgtacaatcaacagaacttggcaagttattgagaaaggatacctcttgtgtgtcacggctgtttgtcacaggcttattgtcgttgttatccaatgtaatgtgcttcaagatgttgttgggtacatccttgacaacatgccacttgattggaaaacacccattccacttgtcttgttgccaataatccactgtcttctcaaaatcaacaggaccaaccatttcagcaacaccaacaaactggccacttgtgtttacctatattccatgcccaatgtcaataaagagtgatatgagggacaaatggatcacataatgtggtaataataatacttacagagaagaacaagaagactgggcattcactggatttctcctgcgcttcacggtatccagcatccagcttcttgtttccattaggagtgcttgcccacacattgtattttatacttttgtgcacatcatcctcactgtaagatttgataacaaagaactttgcatctttgtatgttactggaaaaccttcctggttgaattggcccttatctggaatggcactattctcctgtttcccgactgaggggagggcttggcccttcacagcaatagtgacagaaggtccaaactgtttttggtgcttgaatcctccagatcttggtcctctgttaagctcagtgaagccatcttggttctcactgccaaaaccaaaagatgcacgacctctaggcttgtacttgctatcaacaattccccaccgtccattatttctggagttgtacatatttgatccgaaaccaagcccagttttaagtgcgttcccatactgaccatactgcccatataatctgttgtctgggtacatcctggtatgataactaggagatgtcaaacccattcccgacgaaggtatctgtgcatgcataccctgaaacaaatggatattttaggctaatacttgtactttgtgagagccacataatgcatcactatcatttttgctatgtgcaacttaaggggaaggcagttattgcagaatttaatactaggtaaatgcctttaattagcaagaaaaaaaattattgttaagccattaatctgctttgagaagctatggaaaaagaagaagagtgggggaaggaggggggcaatggagaattggacagtcctagaacataccatgaggtttgcagttgggcgctggctctgattttttgctgaatacgagttagaaccataagatgtggaattagtatttgatctctgatgcccattagagtagactggcccatcataccactgaactggagaatgaagaccactgtgaccataattgttagcagatggtccaccttgcaaagtccctcctccatatgaaccattgtttaatactgatacattttgatgggtttgcttacgtgctaatgaactactgttagtatttgccatcccattagcagtcccattggcactagcttttgctgattcaaccggaacacgtgcctggtgagcagcaacagagggcatctcagactgagaattgacagcattgacgccatggcttgcattggttggagctggttgctgataatattgaccagggtactggtaatgctgtgcgccgtatgactggccatcatgcccaacagttgggacaggagaaccagaaggatatgggccatagggagcatagccatatccatacatgtcaccataaacactctgctggatcattgtaacagaatcgagttaatttatctccaacacatagcatgagtagacaagcaattcattaaattccaaattaacaacatatgtcccccacggtttctatctccatatttggtccttagcctcctctaggcacaggtgaactcgtgatatcacattacaccttaaaatacctatcgcaaagtgatgaactaactataaataactgcattaacttacaggaggcatctccgttccatcatgggcagcatatctggagtcccattcattggctgagccgtcataacctatatacacgaacgcacaaacattaaaatcagcacttaattagactacctgattatccagcaaagtactaggtgtttgtaccagtaggatagtaatatgctgagggtccatatccattggtctgatacaagatgttggcattcacggcctcctggagcaggggagtgatcgacctgtccaccggcgacgccgcattctgcgcatcgccggcgcttgcagatccatagggcatcccggcaggctgcaattcacaaaaaggaccataatttttagctacctctcctccaaacaaacaaaaaggatggcacaagcaacacatcacagacaagaatcgccagcaaaagctaccttcttggtagcgtcaggggtggcgccttccttcttgctctccaacgacagcttctgcatcatgtcagtagcctctgtagcttgcgaatcaaggaagaaacacttcgattcaaaagcgagcaactaaacaataatacagccataggattcgaacacgagaaaaagaaaaaaaaaggctgtttaaattatcaccccagaaaaaaaaagaagttcaaatctttacgaagaactgccgcacaaaccgcaaccccccgctgctaaaacagattaaacacatcaaagaaaacaaaaataaaaaggatacggtcgccagcgccaggagcaacggccgccatggttcctcctcctcctcctccctccgtcccagttcgatctaaacccgccttctttccctcctcgcggattggatcccaagaaggcgaaaattccaggaggtacggggggcaaagaaggcaggggtggaatatagatggtaaaaaaaattcttgtggtaggtagaggcgataggtggtggtggataaaccctaggagagggggaggaggagggagagggacacgaagatagccgccacagacgcgaggggggaggggagaagaggaggagacggggggaggggtagccaaagaaggggggttttaggcgattcagaggcggtgattcaaatacctgtcccggcacatccccaccgctcgtttatcttccccacctctgctccgggcacccacccaaaagtgtttcattactctcccaactctacttgtctcatgtattaatgattaacttaggatgtgtttggatccaaagtttggatctaaacttcagtctttttccatcacatcaacctgtcatacacacacaacttttcagtcacatcatctccaatttcaaccaataaacacagccttattttatagtctatactccctccgtttcataatataagtcattctagcatttaccacattcatattcatgttctatctagattcattaacatgaatatgaatgtgggaaatgctagaatgatttaggtggtgtttgaatctcctaaagatgaaaatgaagatgaagattaagtatttcacgtaaaatgaggtggtaataacgtgtgattaattaatttttaattattacaaacttgaaaaatgaattaatctaatattttagagcaactttcatatagaaagttttcgcacaaaacgcactatttagcagtttgaaaaacgtgccacgagtatctattttatcctcagattgcatgagaaacgaacagggggcttacattgtgaaacggagggagtagaacggaaggagtataatatatgttgttattacgacataatggtcatgtttagattccaacttttttcttcaaacttcctacttttccgtcacatcgaactttcctacatacacaaacttccaatttttccgtcacattattccaatttcttcaaacttccaattttagcgttgaactaaacacagccaatgtttgaggcaaaaatgtagtactagttgatttactggtcagaagtgtcatgtataaatgacaactggtggtagtaaggattttctattattggtggtagtagttcttagggagatatctgggcatgtgttgaaagtattgatagatgtaataggttatggaagggcgtaaattaattgattaaatgttaggaagttgatatgtcaatttttaaagagtttttataaggtggaatgaggaagaaagtttgtgtaaaaacaaaattgtttacaaaattgagaaatgcgtccgtgataatctatagtcattatttttgcagtgtactaggatggaagaagacgtaacggagtttggtaagtttgtggcatgccatacacatccaataaatgtgtttttttatactaggaatattacagccttaggtggctcacaatttttagggaaatcctatcccaatatatctacttgtcataataaaagttaaagatagttgtagttaggcattgagggaataaatttaacagtggctagtggagcaaactaaatcatccagggctaataaatcatccataatcatactattcttgcaatttcagttcaggtatttccaaacatcccagttttgtagtgtgttttaattacaaagtgggagtggctgtgtggccatagcattgccccctattaaattacttccacaaaaagcaagagaaaccctagcttccattgggccagcccatgacccaatcaggcccatactgctatgctatgctgctcgttcaactgccatactcataaaggtccaatttttgttcatatctggaagatgtttgttgcttgacgaaaaatctcagttgtttttgtcttcttatcatccatcaattcacggccacgtatattgccccgaactccaattcaacatgaatattcagagaatcgacaaggttctttttttcttttttcttcttgttacaaaagactgttcaaacaccataacaaaggcaaacctttattttttttcttctttttattagagaaggcaaactctgttggacgatgtcataagcatccatactatactgtataatcgatttttgactgacatgtaggatagaaatcgtaataatagaatatgaccagaattgaaatgcctagtagagaaatgaagaaagaacataataataattttcctgagcaattcaaattcttaaagagaaaaaaaagaaaaactcttttgtgccatcgtggaccagagtaaattccaagaaaaatatgaaaagaggtaatctcagtaaattccagaaatattcaaataagaggcattccagagtaaattccaaaatgatattataaaagaataaagaagtggacctgaactttgtttcctttgtttccatgtgctcatgcgttagtactatttattttaaaatataacaaactatctaagagcaggtacaatagcagactaatataaaataagatagaggagagtaacatgctatatatttgtagccaactgcaatacaaactttttaaaatacatgtgtatatgacatatgggaccagctatgacttgtgtagtactccgtttataggtaactattgtatgaatcggatatagatgatttggagccagtagttggttatgtaagttatctctactattataaaaattgaagatgtttttggcggtattttgatacatcatccgtgtatgatgaggcttttaagttcgtttgcttttggagatacatatatgtatttgagttagtttttaagatcgtttacttttgtcaatacataaggaatcatataagaaatctgtttaaaaaacttatgtgctaacttgagatgatcggactcctaactacagctcatgattttttaaaaaatatatatatccaaacaaactcttagagtgaatttcatcttaattaaactatataacaataataaaattaaaatagacttcaccttttgtaaaatacaaatatgtgtaagttaatagtataatttaggacgaaattggtaggagatgcatttgttgtagcagctgcgtgcctgccgctctggcttcgcttcagaggataagaacgggcggtcgtcagtgaggtcggcctggaatgaatgaacaagagaggacggcgacgggggagcgttgttggttcagcgtgttctcgcggcttcccccccttcaaatatctctcctttttctttttcttctctcttttctcgcgcatgcggccagcgccacgccgcctacgacgtgtgcttgccgtggttggttgtggctgggcctgggttggcctcggcgccgaccgaagcatccggcggcagctgcaccgcccatgagcttctcgacccctcctcctccggttgtgatgtgaatgattttttgagtccacatgtgattggactctgtcgtgtgcgccagaggaattgctttttgtaatgaactctgaactgaacagttcaactctgaaatactacgctgttagttggtaatagtaaaaattgtgtcccaaacatgaaaagttttatggttcctcaacatatctaaattttatattgaaaagttagatacatatataaaaatattaagttttatattagacaatatggtatctttcattatatttttttaaggatgaaaaaattaccttctaaacatatattagaggcaatcataccagaaatgcaccactctaccagtacatatttggttgggggaaatatacatatatataaatatactctcgtttgtacaaatttacacgaaaaatacatcttgtcaaacaatcagagtaaatgaagaatggtaagaattgacacactctcacaatcacacacacagaaacaatcatatcagaaattttacatcaggtttagctgaaaatatacatatatttactttcgcttgtacacttttacattaaaaatacaacctttcctctttcaaacaatcagaacaaatgaaaagaatggtaaaaaaatcttctatatttttctttcttgtaaaatctcccacctgaaattgccaacaaaaaaaaggcaagcctgcactcccataaaaaaaagggaaatcaccaccgaggaacttcacaaaatagcggaacctgtttaattatgttttcaactttgcattaacaaacaatgccatcagtctgtgtggcgtggtgctgcagtagaaagtggaactgagagttctgcctgagcagtggtgttggttccacgtcagataggtctatgtcaagcatcagtcgtgctatatcatccaacgatataggtatgctgcaatttgattcagtttgggtgttagatcaatggctactgtttctcccattttaggttcatatcttaatagcagtactgagcagccaatcatattcataccttgagtcgtcatctaacaagaacgaactatttggagtagttattgagtcatcagtggccattgttctcatctttccaatgacctgaaaccacgttggtgtgtttcacatcatatgaagattttatttttatttctttactttttttgcgtggaagtagtcattgtagttgaaaagggaaatatgcctaagtattgagaagtttgcaacttacctcctgagatagaccttgtgcaccgtatttatcatcccagaacattgttccaatgcgatatatttgagtgatgctcaaaacctgggaaagtggcactacgtttcatactatacgcttttgcagaaattcaagtatttacaagttagtcatattcaggacttactgggcaaagctcatcagtgatttcctccaaggttttatgtgtcttctgatgcaaaacctgcacgcgaattcacatgatgctaaccaaacatctatataatttgaaaataattggtttcaactttcaagcataccagaaatccaactgcctgtctgatgtgctgaaattcatcccaagacgttcctgcatactgcattatcacaacgcatttggtcaaatacttccttgccttttactcatttgtcaccaaacaaaattatacacaattttcacttcacctcttcagttgttacagagcaccactgctctaattcttgtaaaccagcctttaagaattccccattgctaaaggagcagcattctcgacggagtagcaaactgaatgagaaggtatagattttgttatagtccagaatcaaccaatttgttcccccatatgctaatgatatttcatatgactttgtgtagtcaaccagagttaactgaagttactttacaagacttagaggtggtgagatacctattgaagagttgaacgttcataaaggcaaatgcttgattgaatgttttcctgattatcattggaggtacctacgaatagataattcataaggaaaactccctgatcatgggacaactgaaaacaattattgccatactcacgtgattattgttcattgtttcgagtgtatggttcaggcacttaatgatgctttgccaatgcacacttgatgtttgccttgatagtgaattagaatgtacacttttcaacgatcccctggatgatctcacacgaacagcccttggagcctgtgaaattgacaaattgttaacgaaattgtatcgccttatattcacgattggcatggaaatgtctggggtgcatacctgtatgcacataatcaagaacgggtttatttccttcttcaggttatctctgatcattccatatatcttctcgacatatgctgttaattgctgtttgaaacgtagtgctgagtattttgcctctacctttgatgcagtgtcaggccttccaaccattccactatatccacttgatatgcctgatcctaatgacgacgatcgagcattctgacacgcaatttttgggatgtaagctcatttttatgttgtgaatatcactttggtcgttgatgtggtgtatatataagtaattggttaatcagtacgaaagtatgttgaaaacttcgacttgcaatgccaataaagaaccttgctttacgcaaagcatgagtatggataaagaacttgcctgcaccatcctactgaacaggttgcctgttgtggttcggctgcgatttgatcctttacctgctgaactgctagacttaagagtattttgtaataggtagagaagagttgatgtagtcgacagccaataagccagttctgtagaactttcagcgtgctgtaaatactcagataatgagtttcatgagagcttgctcaccaactatataatgtcactgcaaacggaaagttttatatagtattttggaagtaacaacctcaattgatgacctaattgtatggatgattcggtcaaatatgttagtcttctctgcttcaaatgagtgccagtgcaggagtgatttgtacacgatgcatgctgcagctggtctgccgttgtcaaatctcctgtcttcagccagacttttgatcaggacatcatgattttcctgtgaaagagcaggaaaaccaaatcgagaaaaaaattattttgaatgtgcacaatgcctgttaactaagaacgtggaacttgtttcttgcattgatataaaaaaattttgaaggcactgaaacatacttgttgtcgatccgtgagcgacttttgtttgcttaaattctttataggaggaacaaccacctcctcctgaaaaaaaaacaaagcaaatatataaatccatataaataaaatgtccaactgaggttttttttttgctctcatgttgggtaatagagagctataaaaacacgtacaatgaggattttatgttcttcaagctgatatcgattcacaaggccctggtgagatttttgatagaaaatttagtgcaactgtgtactatacttcagaaatatcatccatcttatcagataagagatgtgttttattaatgttaaactgacaggattatacctccattgctgatggctgaatcacttcaggagtaattactgcttgaacagctacagaagatttactgcggagcaactggttttctgactccaagatggcaatcttgctttccagactagaagaagagtttgttatgttaagttatgaggctttcaaaaacaaagtggataagaattgcagtgcaaacatttcaaaaattacctctctatttgctttgatttatcgtcatctgcagatgcaagtagtgactgttgacgtaggacctggttttcagattccaagctggataaatttgtttcaagcctgcaccatatatcataaggccgtgactgggtatcatttgtaatatgcacgagccaatttatgtaaatatttaaaataattaatacctttctatcatctcctgaagttgattaagtttggagtccttttctagaatttccctcgacaattcatcggactccttttgaacctctagaagtctcttttctagatcttcagcctttgttctaaatgtaacaagttcatcctggatgcaaacatgaatatggtaattagttaattagtctaagcaaaagggctgaatcatttttttagtaaaattaaagcttatcgagtattatacctcaagttccttattttgtctagtcagcagctcaacttttgcattgtccaccaccggcacctctactatctttggtggtgcctgttcaattgctagttttgcatcttctttctccttttctattgctgcatgtgcttccgaaagcttttcttgcatttcttgcaacacagatttcaagtttgaaatctcttgccccttggcttcttcaaggtcaatctgtcagcatgacaatatttagcaaactcattctttttagaaaatggattaaatcggcctctacatccagaagggatgtacacagccaatttagcaaattcatttgggtccaaggacagataaaactctacagtgaattaccctcaagtgtttctcaacatctaatcgccatgtgagttcctcaactcttttttcaagtttgtcttttgcttctttcagtgcgccagtctctcttgcttcctgtttaccatttcagatttttttacttgacattgcattaacatacacacaagaataacttgggtttcaactgtataattggacaaaccattttgagctttcgaagttcctttcttgcaatacgtgctctccacaggcactgaagaatcaaagtagctcttttttgctttttgtaatcaacataagctttgtgttggcgccatcgagtctggaaataatgaatgaagcggttaattgtggttgctgcttatttctgttcaagaaaaattgtggttgcttttcatgaaagttaattcagtgccatcataataaattaataatactacaaacctggattattatggaagctttggtctctcgtctgaatctgtgttcattgcaagccgccattgcacgtaatcctgtctgtattactatggctgactcatacatttgaaggtaagatttcctggctgaatgagtacgtgcatgcttctgtatcctgattgaagcagcatttcttctcatatgctcgaaaaatattctagctaggcgtgctgcagtgttgaattacattgtatgtcaatgccaagtcagaacttattactaatacggaagatatgaattactaaaggcacatcagtgaagaaatacccctccaaaacttctgagactgaattgaggcttttcttaagttgatgaattcctttcttgtaagatgtgtctttatacgtctctggataagccgtgcagcattggccaatacttctgctcttcgagcatccagctctgccatctgaccagctcttaggaatacctttgtttttcctatctgatcaaaacaaaaggttgcatgcaatgagttgcaaatatatattctgtgaattgttgctatatattccattttcacctctcacaaagattacctgatatcccttcaaacccattttatcacatattgctgcacaggcagccttctcatcagagctgtacaagcattagagtcactttattatccatttagaagaataagagaacatttgatggacatatttcagttaagagtgtttttcacatgtctcaatcccctaatctggttgcataacatcagtatccatacctgtcgacaagctctgctgcaagcattccaaaccgatcaatgaactcatcaaatgtcctttttgttggatagccagcacaactgatccggattgcttccagaacaccctgcagcattaaccatttttaacattttttagacaaaagaccttcacggtccagcttttatagaaagtaaaataacacaaaaaaaaacaaggcttctgaataacaatgtggagcaaaatgcacatcataccccgcatctcaattggttaaggacattgaaattctcaaagattcctggtttaagtacagcattgggtttcacacatctaatgtagtgtggttctgtcgtactcagtgtttccatgagagcttgtagttgttgctgcacatattgtagcaaaatgaagggttacagaaaattccaaggctaattcatataactctaagcctctggctacaatcatgacacaccttaaagcgagtaccgatggaagagaatttggactgtttagaggtttcctcaggtaatggaggaaagagatttgcaacaaaagggcaccttgaggaattaagtagagcctgatgttctgccaccacatagtctttgttcttgtcaagaaactgatcagcttgatatgtgacctgtttactagaacaattgttcaaaatccttgatggtaaatctaaacacgatatatcacatttcgctgattatcacttacatctcctgcatagtggttgattgtaaaggctgtccgagcaagtttgggtttgctgaagcgcttatgtgccttgtatgtttgatacatcttttgggcaaatgtttcatgtgtggactttggaaacatgctgcatggataggcagttaggcacatgtcatagggtaacacatggaaacttgcatttgatgctactgaatgttttttttgctaggaaaaactaccccaatgtttttttatggacaaaacataagaagtaatatttttaactgttgcaggtgtcagcatgcacatgcagagtttcttgataaaaatacttttttcttctggaaagatgactattcataccatgcttcatccagtagtgcaattattcctccaggtttctgcatggaattggcaggtgttattcatcaatagatacaattatcacttgtgaaatgcttcaggaactcactttctcaattaagtccagcacatcttgattgtccacaaattccacatagctccaatctatttcctcccttgtatagtcttcttgctccatcttgaatacatgctgtaacaggaattcaccagtctccttattagtcataaatattctgcaatattttttttcttaatatctactcccttcgtcccctaatataagggattttgacattttgcttggactgtttgaccattcgtcttatttaaaaattttttggacttttgtttgcactgtttgaccattcatcttatttaaaaatttattttatttgtgacttactttattacccaaagtactttaagcacaatttttcgttttttatatttgcacaaattttttgaataggacgagtggtcaaacagtgcaagtaaaatgtcaaaaccccttatattaggggacggaggagtagtaatctaaaggtctcgctaacctggttaaagtgctgctgcaacttctcgtttgtcaagttgatacatagttgttcgaagctgccagataagtatagtatgatttgtgtttcaggtattaagaaacaaaaccaatagcacacttgcataattgaaactagtctgctggcaaacctgttaatcttgaaactctcaaatccatatatatcaagtactcctataatattagttgcatctggatcttgaccgattgagttgttaatcttgtccacaatcctgttagctcagaaagaagttcctttgtcacattcagatctagacgtaccaggcagtaagagtaatagcacttgctatttgatcactgtccactgatgaatatgatataccttcattcttaccagtcaaacagtcgtgaatacacagtctttgctaaggcgtcacgactcagtgctgcagaatctggatcaagtggctttgtgatatttccatcaggtgttacaataacacgctcacaaagcgaatcttgaagagccttttcatcacacctaaaatatattttacacttgattacagcagaaatatatatttgcagatgatagattataaaccatgggaagaatttatacatacattagaagttctgctactattttcaggtgatagactgatttctcatccctcagcttcgatgaatcaatttcttgccccttcgagaaattgatgtttcccagatgaaggattgcagctactactctaaagattgcatccttgagaagtaaaaaggatgaatcaattatagcatccgcaacttatttagtacttactagtctatgcaaggacctttttttaaaaaaaaactctatgaagtatacctgctcttcttgaccaatgccaacaacatccatagcatttcttgtttctaggtattctcttgcgtcatccacattagctacttcatagcagtttgtttggttcaaataatggaatgatcttgggtctcccaccttaaactttttcacatcctgaaatcagttcaacattcagaagtaatcagtactatggcactctgagcatgcagatgatggaagtggtatttaagtgtttctagagaattacctctggtggtgcagaacatagcatgtaaaagcaatggtagttcctttcaggatcagagacctgacatactcgcgatctttcaaggaggtacgttcgaacagcagccccggatatcttcccatatttgtcgaattggatttcaacaaacttaccgaatcgactgaaaaattcaacatatcaaatttggaaattacaaaatatcaattgccatatcatggttgtagttgctgattcaaatctacacctcgagttgttgttcttcaccgtcttcgcatttccaaatgcttccagtactggattagactatatgcattgcagagaaatcaatagagtgaatggagatgttctaaaaaagatagtgaaaacaaataagatggtgagaaatggggagttctttgtacctctaaaacctgctgttcaacagtccgaccctctgttccagaccttcctcccatgaatgcaagatacctcatgagcatcttggtcgtctctgtcttaccagcaccactctcaccgctcaccaatatcgattggctcccttgttcattgatcattgccctgagtttgatagcatcacaatgaagaaaagaacatcagtcacaaactcacaattcgagactgacacggtccatagattaccaaaggcgtgaacaggagtacagaacacacctgtaacaagcatctgcgatcgcaaacagatgagggctgagctccccaaatgcagcacctttgtactgctccatcatgtgcacgtcatacagatgaggcagcctccggaaagggttgactgcaatcaagatattgccggtgtatgtctgttcgatatattttcatggtaaaaggaaagatggctaagcccaaatggtcctgaacgaagtactaaatatcaagatggagaattctgaatggtaaacactcacatatatctcgttaataccgtaccgacaagcgaggttatgcaagactccaggttcatggaggtaagccagcttcgtcatgtcgtcaactcctgcaggtggcgcttccgtatccttggggtaaatgcttgcgaggctcgccacaatctgcccacaaaaaagcaacagctgctgcttcagtagcagttccattcaggcaattctacaaacacctagcgcgcacggttcaacagcaaaatacgaattcagaaaatcagaacagttcgcttcgagctctgcaatactcggggttcttgatcatatcaagaaccggggacaacgaaagaatgatcagctagctcagtggcagggaagcaagcgaccgaccgttttgccatcggtgctgacgatggtggcgtcgccgcccctgatctcgacgacctccccgtcgatccacgcgtcgtcgggatcctccgcccagacatgcgacccgacgatgatgttcaccggcgtcccctgcccaagaaaaacgccacaccaaattcaaaccaccaaacccaagacccaacccaacacaacacgatcgcaagccctgcaactcgatgaacagagctagtagcttgctactactacaacgctagcggctgaccatttccgtcgtcgatccactccggccgatcgactcagctcgatcgccgccgcccaaacatgcaaaaaagaaaagaaaagaaaagaaaaggcaaggctatagccaccaattcttggcgccgcaaaccaaactggtagctgcgaatgcgcacgcgaagcgaacaactggaaagggagaaagcgaaggaagaagaagaggaggaatatacagggtggtgtggtgatggtgcgaaggagtggggtggcggtcgcgggggtgtgagctggttcgagctccctttcggtgggagaaaagaagcccggggattgctaccgccacctaaataaaaacttttttatcttttttatttattttctctgtgccagtgaagaaaccaaaccatgtgtgatttggaatttcttttttccttttcgaaagctgtctgattgagactttcaggtcagaaatcgccgggaaaagatactgtcaactcaacaggtcaaaaatccaaattttaaaattcagaattgatttggttattattactattaaactgttgccaagcatgaccagggacatgtttaaggaaacttttagtgattacagcttctttcagaatcaaaaactcctaaaaatagtcgagtttcttctagaaaataaactagaagaagctagctaccctcgctcaagaaaataaactagagtagcttcgtagtacgaccgcgctcgcgtgggctgaatctatgagcgggccgaattaatttatgcgtgttcttgtcactcgagcagcccagcaatccatggaagcttcagtagctaagatacacatttcagtatggaagaaagtacacatatgaactgctcatataacaccaggaaagctgatcgaatccccagactttgattgatgtatgtaagttctttattcagatcaagcgactacatgatggcaagtgcgaccaacatgaagaaatgcactcgggacgccattctctccaagccccctaaaccatggaagcacaatttgcacaatgctggagccgttcatggctcgaacaccatgttttcggcctccctcttgatcgattcgaagaggacagacgacaggtagcgctcaccgaagctcgggaagaccacctgcgagcacaaatgacggcgatggacatgttagagcagagaatctaagaggtttttgtaggttgcaaaacaatggagatcatgaacggtttaagaaatgcctggcaaaacagggttctgaggagggaacctacaactacgagcttccctttgttctcgggccgctgcgcgaccctgatggcagcgactgcagcagcaccagatgagatcccaacctgaaaaatatttgtcatggaattaaaccataggctatatgtgcagcaataggtggagaagagttgggtggattcttaaggggtactgagctcaccagcagcccttctttcaacgctagctgcttcgccatgctgatggcttcatcacttgagacctaccagagtagaattgcaagaaatgttcagatcaatttagtaattgcattccgtacatttgtttctatatacataaccgtgcgcatgtctggatctgtggatcaacaattgaattctaacgttggggttagcaaacggttcatcaggtgaactggaactggacattcgacagagacgtggttataagagagtttttatatgcaggccttgtggcaggtttagcagcacatactgcattgccattgtttacagaaaaatagaaacaatacaagatctttttcatttgattagtggcctggaacagaaaatttggatttgcttacttggaccacttcatccaggagattgacatcaagtacaccaggaacaaaaccagcacctataccttggattttgtgtggacctgaaaccaaaaacatggaacagtgataatgtcatgatggttcaacagaatcgagacagctaaattattacatcaaatacgtgaaccatccatactgtgcaccctatgtttcaaataatttttgacatccatagttatgcatcacaaatagtactagtattactaatgtgatttatgcaagttgagctatacaaagagcagtatcttaccaggtcttcctccagataaaattgcactttctgtcggttcaacaccatagatctttaagacaaaattagtacacagttaagtcaccatcacatatacacaaaaccataaaaacatgcaaacaagtactccctccgtcccataatataagggattttgagtttttgcttacaatgtttgaccactcgttttattcaaaaattttgtgcaaatataaaaaacgaaaaattatgcttaaagtactttggataataaagtaagtcacaaagaaaataaataataattctaaaattttttgaataagacgaatggtcaaaccgtgcaagcaaaaacttaaaatcccttatattatgggacggagggagtatataagttaccttgatctcagggttctgctccttgaggtactttcctgttccggttactgtaccaccggttccaatgccagagacaaggatatcaactttcccagcagtggccttccaaatctcaggtccagttgtctcatagtggatctgagcatagtccagtaaaacaaaacagtaattaaactattgtgcttttctagcaaggataataatatattagcaatttagcacctttgggtttgcagggttctcaaactgctggagaatgtaagagttaggcatctttgctgccagctcatctgccttctggattgcacctttcatgcccagaagtggatcggtaaggaccaactcggcaccgaaggccttaagaatgatcctcctttccatgctcatggatgctggcattgtcaggattagcttataacccttggcagcagccatgaaagcaaggccaataccagtatttccactagtaggctcaatcaaaacactctataagaaagggaggatcgatcagacaatacagtcagatgtattccagtaaaaaataaaaggtcagatacacacgcacgcttgtattaatttaccaaccatgacatcaccattcctctgtttcatattataagatgttttaggttttgaatagatttatgtatgagctttatatatatgttcaaattcatatggatgttagtgaatctagacgagggatggtgagaccaaaacatcttattttccttaaatgagaagtctgagacattaatcttctaatggtacgctactctctccaatcaaatatgtttgactagagggagtagattttattggtaggagttcttagtcacaaataagcaaagtgactccatcatattctaatctgagagttgatttatactttcaggtctcagtgtctcacctttcctggagtaatgagacccttctcttctgcatctgtaatcatgctataaccaatcctgcaaaccatggccaccagaataaaaataagtaaagcgcaaaactatcagcaggagggacagactggggtactttagatacctatccttgacactggagcagggctccatgatctcaagcttggcagcgatttgggcctcacatccatccaccaccttgttcaggtacaccaggggagtattgccgatcagctgacatcccaaaacgagcaccaaagaaaatcagcatcactaaaggcgaattaaagcacaattcagctagtcccaagcataaaaagggcgaattttgtctacatactgcagtcacatcactcgcaatcgattggcctgattccgccattgcctaaatctctctgaaaactctgcaagcctgcaagaaagcaaaaggttggtgagcccaaaacaatcagtgaaattttggagcacaacggtaaatatccgcgtcccctctgaacggtaaaccctaatccccgcgccgatcaccaaatgctactggattcaaggtaccaagttcagatctacccaaaaattcagcggatcatttcactcgcatggacacggataacaacagcataggcgtgcaaacacatcaaggtcttattcttcaattgccaaaattcacaactcacacaagaatcaaccgacgaacagcagtgtacagacacagaaaagggggagaaaacaaccaaacaaccgtatcaatgttctgaatttggacagaacgaaatggcaggaaaggtcccgaattgcgcaagattggaagcgaaaaaaagatatgaaaaggagggatttttttaccgatggagtactaaccagtaaccaactaaccactccccccgccgacggctgcgagaggaaaggcggatggatcaagaaactgcggagaaaaccggaggacgaacgaggcaaagatgtgaagcactttgtagcgcccgcatcatcccctcctgccctttttatgtagtgctgctccacttgtcagttgtcagttgttgtcactagtccctgtatctcctctcgctcagaaaatatttttgtatatatgtcacggtactcgcaggtcatactattatttctttaaacaaatgttaaaagaggttaagacgatattcagggatggttcactttgttaccattttaaaccataccaagttttggcattgtcaaattttggtagagttgccaaaattttggcaagattttatatgtacttattaaaattggcaataaactaaacgtagccaaaattttggcaactttacaaaaaaaaaggtatggttaaaaatgatgtcagggttatggataccatatacctaatagtagttgactaaatctcgacaggacctaccacatatcatgtcctatacggaaacaaacttcggatataggaggagttccgcataaggaatgatgaatagggttctacataaaaacgacaaggactactcggattatatccatattggtttccctagttctactcggataaggggacaactatgggtataaatacaaggccccctaggaggagaggggacacggaacaataggttaagacacaagatcaacatataagccaacatacgccaagacaagacgccggatatcgacttcagagatagacatggctagtcccctacggtgcctacgaatatcgtcaggagagatatagcgctgtctctgatctcgccggatatggattcgagaaggaaggctaccctgttgtcgactatgagtcagaacttcagatcgccatgtcgacaacagtttgataggctaccccaaatattgtacttgtgtgatctagatgaataaagagcaacaccggcttcggccaacaggatgtaggattattacctaacaattcaggggcccgaacctgtataaaaatccttgtctccgtctcttttacctaagtctcgcatatatcctaggaccaacgatccccataccatgcaaataccggaatcgcgacatcaaacgttgacaaatggcatcaaagtgaacaggcactcaagattccataggaatttgcataaatttgttcagtttccagataaacagagaaaaactattcttttctaaaacagcatttgcatgtatgatgtgcagataacggacgtgaattatctgcagtgctgcacttacagtagctgccactgacatgttggatccctacaagtgcaatattgcagacaatccccactaacagttaacccggtacgtgtacatttgacggaacccacctcctcccaaatcccgtaaggtttgttgcaattttgtttagaaacacggtacaaacaaagatgtccacaatgagcactttcgaaaaattgggctggcatatcttgagattgacgaaatcatcacagatgcctcgttatcgacaataatgagcatatttggaagattaggccagcatatcatgagattgatgaagtcactatggacgtctcgttgtttataggtacgccatctatcgctggaaaaataaatagctgtatatgtaagcactcgtctcaaatctagaatttaaatacgggtgaactgattccaccataagaaacctaatcgactgagctacgctcacttcgctattcgttgacagcttgattatattgttacttgtaacagtaggtcaaaggtttaaaaaataatcgaagcctaatttatgaaacatgagaaaacattcagttctctcaactgcttcctaacccagctgtgatatcgtattctcgtgtttagctataaaaaatattgcgaagaaccttcgaaaatctcgcagaaaattgcccggtggagaggaagggctctgctcgatcgagccgtgcgttctttctgtgtgcggcaaacagggggtcatccgttctgaattctgatgctcaagtggacctcgttgcagactgcagaaacaacacaaaagagctcagagcacacgcagatagtgctggttggttggtagctcgtgcaaatgtaagcaatgacatcatcccatcaccattggggattacaaagtcgtgatctgttgtacggagtttactcatacatcgaagtggttagggaggattaaaaaaaactactagaagtatcgctctatgactatctgtccaagccaggtaatggcggatcgatggagagggggaggggggggggagaaaacaagagagaggctgcagatttaagacctggaagaaagcacatatctttatgttggtccaatggcagattttgtcgaatctccttgaattccctgcgttcaaacttcaaacttctcaccgacacacacaaaataagggaatttttcatgttaggataatacttctttggagtagcagattttgcatattttctggctagtgagaatttgctgcgtcgtcccatttccaacaaattctgggcctccaaagaaaagcccactcaatttgcgagggaaatccctcgcgggccgggtcgtcttctcgcgccaaactcccaagtctctccaactcgcatcgcctccctcctgctcctcctccctgaagctacttgcagatatgagataaggtggctgtgctcgtgctcgagctcaccaccaatctctcctcgcccacctctcccatctcggccaccaccaccgatcgcccctcgcgtgcatgtcgcagccggagtagcatcgcatgcgtgcaatgccgtctcctcctcctcatggccccatgtcgctgatggccagccggtgctactgctgttcgtcgccgccttcgccgtcgccgaagcagcggagagacgccgagagcaagcagcagcagcagcagcacatccgtaacttatcgccgccgccttcgattttcgtctctcgcggttaatccacagcttaactctgattcctgcgtgattgtgtgtgtcgcaaacagtgcaggcggagcgcggctggcggtgacgacgaggagggcgctgctggccgccgccatcgtcgtcgtgggctccggcacggcggggcgcgccagggcgacggaggaaggcggcggcggcgagggggagggggtggtcggggcgatcaaatcgatatttgacccgaacgagaggaccaagtcggggaaggtgttgcccaaggcgtacctgaaggcggcgagggaggtggtgcggacgctccgggagtcgctgggggaggacgacggcggcgacgtggccaagttccggcgaggcgccgacgccgccaaggagtccatccgggagttcctcggcggctggcgaggccagcaagccgtcgctgctgaggtttggttcgcgcatctcagcgttatcattcggctgtaataatgccaattttccccctatttttgcaacgctgctaaccacattcacacacccaggaagtgatggatctaggaagaaatatagacaaagctatagctctcacttcaaaaaaagaaattaataagagctctaggaaactctcatggttttaatggttttattgtcagtagggaaggctgaatcctcacctacgtccatttgcttatcgttacttacccgtagtattttatggatacacatatagcccatgatttatcttctagctccatagtttaattctaatgaaaatcctccaaaattcaaactacctccgtccaaaaccccttacatttggcgacaaattttgaaccctgaatcaggacggagaagtatatttcaaaggaggcttgaagtgagttacaccgatcaaattaaaataaatatgaaaattaacacacaagtaaacgatcatgaaaaaaattcaaagcaagtttgaactcaagttcactcacctggggaacaggagatggcatgatttttttagttgcaattttgcaaacatcagaacataactgggttgcttacttgacgatttgttaacaaaattgtttgcctgctcatccaggagtcatacgttgcgctggagaaggccatcagatcactggcggagttctactccaaggcagggccattcgcctcgctgcccaaagatgtcaaggacaagatcctcgccaacctcaacactgcagacgcctttctgtagagatttattttcttctgtcagaaaaaaaaagtactatctgccaacaatcaacgagtgataattgcattgtagccagccttcactttgcctgcgaaaagatcattggcaaagacagaaaagagcagatagaacatatgattacaagtaaatgctttccagagtgattataaccttgcgatctttgaccacatctcacctgatcagtagttcgattcagcgaacaaaagcaccttgcatctgcatgaacacgaggatagatgccataacattatcagatttacttccaacatgagaacaggtggcatatctgagattttttttctgcttgcccatgcattagtgtcttacagatgagatctggctgcaaaaaaatgggctagcaaaaacaaagctactgtcacatagcaggtaaagaaacatgtacgaagattttgcggcacacgttggcctttggtactaagttaaccatccagaaaaaaaaaacacggaataaaactatcatctcagttctacatgctgactttacaggtaaaggtaaaccacttaaagttaggtgatcggagtccaacactgcacaggctggtttcaagtcaaaccgaaaccaaagagtcaattgaatcatcaatattgagcagaaccgaggtgctgctgctctgcaagggatcttcaaaaactcgccctctctatccaggctacttctgccaaccgacgaaccgcatgccgagtcaaaagagaataatagtaacaatgaaggatcggtgtgcttcatgtcctcaatagtatctgtcaatgcttgaaactaccagggtgcaccttttgacagggacaaaataatgcaaaggaagcatgtcaatctgcaaaagatattcaaaatagttagacaaacataacgatattgaaatcatagaattcaaatgtatgcgttgttctctaagaaccactaacataagtttgtagcctattgttcatgtcattaatcaatcatgtaatgcattcctatcttctcaaacaacaagaaacccagtatgtcggttcaagttcttcaaagatttgtagaagatgtcatgacatgttttgcaaaacaagtgggtattctgagttttcaatttatgggtcatgccatgaaaaggaaaagagaacatggagtaacattacatggattattgtgaaacattaccattgcaagcactagcatctttgctgttgtccccataacatggggcagccgaaccttgagtctcagcatttgcagaacaaagagagtcttcattggccacattggaagttttcccagactcgagctcagagaaaacaccatcaactgcacaaatggccattcaccattaaataaaagggggaggagaataactcattgatatatgagggttaaattttatgtgctgaccttcttgagagcttgaattttccccaggtgaagttttctttagcaatggcttttgaagaagacctgttccaggaaaaactaacatgctggtagacttgacttcttgcttttcagaaacatcaagtgaactaaatccaaatttagatgtccaggtgtccacaagttcagcgatagctggaattatcaacttctcaacattgagggagctgaggatctgaagtgtaaatatcagaatacgttagtacacacagtacataacaaatgctcaaacaagcaaaatgaagtaagcccatatataaactattatcaatgaggtacgcagacaggcaagctagtttacttattctcttcagagatgtaatacaaaggccaatgtatcatccgacatatgtattacaaattataccatatagaaaaatactatctaagatgctattttgtaaagaccaattatagcatgcctgaagtagtcagaaccacatcagagcactacaatttacaagctagagtctgttattgttcctacttttgtcacatatttcagctagcgacaaaaacgttgcataaattaagaagtcaggttttgagcagtgcctcaatgtcttgaaactagacacaatgcaaataggatttctgcaataaacagttgtcctatataatcaccatgaatcatgcctagatttgggctcagatcaatataccatttcaattccatctagcagtctgcggcacatcccttgacgccgatacatattccgagtaccaatgaatggcatctctgctaacttggttccatgtattctgtttcaggataagagaccaaatagaaaatcttattagtgcccagtgattcattgggaaaaacattacataaaagtaaccatagcaagcctatttcattagagagttcaggcaaagaaaaggcacaatgactgtatacaattgattgcaattagtgcgtgtgcactgcaatcaaagcacttgcagtacttgcaaccttgcaactgaaacaaaacaactcagctatgcactagaccatgatcagtatatgcggagaactagtgatggcatgcatctatgttatttttgaatagcacagagttcaatctagatgaaatatatacacaggacaaagcatccaaaaagggcaagaggaaggcaactcacctgaccgatgctgcggctattatttcatctccacgttccaaaacaaagatataaaacccatggaagtccatccgaacaaaatttgacctacacataggcaaaaacaggatggcaatcaaatatccttcaaggaataaaatttccatttcaacttgtcaaacacagaagaaattctgcaactattaaatatatcatggccacttcatccgatgtcaactaaaaatcataaaattaataacgtagtccagtaaatcagcaaaacgtgaactagaaggttgatacagtgtatactaaacagaaaccaaacaagtcgcagtatcacatacgtgttcagttaaaactaagcaatagctggtagatccacaggtcaatcataaaaaacactcaccgtgagctactacggatttattttccttactagcattaatcacatggtttcatttggataccttttttatatggagcacatatagctgatgcttcagtgggtagggacttttctgttgttttggtcatatatagtttagatttagcatatacacctttagatgcataaatatgtttattttgattagttaaatctcacataaggccacaatccacataagcatatatacagtgattgaatactcatctaccactcttgagttaaaaaacatttgattataccatatcatgcattgaagatggaggaaacaatgttaaggcttccataaacttttacttggctacagtagcatactattatattaggaaatatgccaaaagctcaaaattcccacattgagctgatgcatacaccagatccaaaactcaggatcgccaaaaggctcattaaagagtcatgcagtgaactagatcgacacaaaattatcttcagaaatttgcaggacaacagtgaacagtgtcatataagcactggtggtgatatgtgcactaattgcatacatagtcagcatggttacttgcaaatgcactcagttctaaatgaatttgcagatgttctagcaaatcagcctaaattatcccattcgtagtatcatatgctggtgccgtcaccagattgaatctatagcaataatgtaagataaactcccaccatagacccactcaccaaaagcagagaggaagaaatgaggggaagtgcgcgcaaagagttacaaagagaaaacaatatcaacatcacagaggtttcacaagataacctcaaaattgcatggagtaatgtgagcagtgtagaaagagtggtgcatacccacagttgtacacaacattacgtatcaagttgatgccagttctttggtcaacaatcggaagaaagcactcatccattaacgaaagagcaactgcaatcttggagttacactcaaccctctcatccaaagcaacaactgtttctggtacattttcatgaatacgctgaataattctgcatgaaaattctggttcaagatccttcttaacaacaagaggattaagcaatccctcaaacagctgcatcacataaatgtcatttcagttcctgtaaatcactcttagtaactccatgggtggagtgaggtttgaggaaggggatataagttcataatattttcccagtaggataataaaaagacaaagttatcacgtgtcactaaagaagttcaaatacaagatgaacacagtaacttaatatgtgttatgtgattagatttaaatggcaaaaaagcatactaaagggatacaaaaaagaattggttccatgcattatagtaaacatattatttatagtcacttcattgtaaaatatgattctttttagttaccctcatcatccaaagtgcattacctttcccctataatgaatatcacaggaaaataaactatagatatatcttaatgactgcatgagagcactgttgacagttccatagatatcattgccgcccagaaatctaattgaaaactaataagttcagtagcacaccatcctaaaacatcacttggtacagaaattcataacaaataacgacccgtgtacttcaaatagtaaacagacaccatgtagggaatattaagatacagaaaaaaaactaaaggagaattaaatgttaatgattttggtgaaattacatatctatattgctttacacaatgtcagttgcttatcaagtagagctacttggacacaaaaggaaacaataaaactgacgaataaaggtggcagcataaaccctaatgcactgcagatatttaacaggtgagttttgttcttattattttttggcaccttacttttaagttcaatcttttggttcgtgtggtttgacttggatttcatatctagcctaccctaacttagctgaaactacaacaaccagttctgaaatcatgctcggcgaaactaggaatgaaaaggaacaatttttttattagtattaccagtctgcaactttgttggcagaataaatcgcatgcctgactggagacattggatgtgttagtagtctcaggagagcaacctgggtgatctacagacataatcattgtgaagaaatcaaaaacattgtgtcaaaaaaacaaatgattggcaatcacgatatttcagtgaagttaatcaatagctaaacaaattgtgcatgtatctaaagtactgacacgctataaaagggagtacaagcagagattacatacatttttcttcgcactgggaacaagtacagagtgaagagtcaacctcagcaatgtcttgagcatcctgccttgaatgttcctgacaaaatttacaggagcacttagcacaacgccaatcatcagatggaagagcctgaaaataagaggtttatatccattagaaaacattgcatcaaattatcaagccttagtgcaaaaagaaattggagatcacgttatcaggcatttcaatcatctcctctaatccaggaaccacaaaaataatagatacagcaggcaagacaaaagtaaaagacagactgatgtactcgaaagaattttcatacaggtattgctaaagtaaatatgggtggcattaaggaaatagacttctatagagtatagaccgcatttacttgctcgatttaagtgcatacctcaagttctagacaactcatgtggaatgttgagggacatccatcacagcagatcaaattgcctccatcaccacaaataccacatgtgtcatcattggggtcatcagtctcagtgctaatagggaaaaaggcctgcctttcagaatcagactgcttatcccatgcattaatgagacaatgcaaaaggtcagtgtccagcccatctacaagaacatttctataaggtttgctgactggcccgccagcgtgagccacaaattcaagtactgtaaagaccttgctgcagcatctgcagttaattccatccctagtggttacaccttccagtaaaacttttgagtgggtttcatccacacatttcagttttgcattgatatcaataatatcaagatcaatcaaccaggataaaactgtacgtttccattcatatggaacaaaaccgttagtgctgcttccaccatccttatttgatccacgagcaagtagagcacaaccacctcgcttttttctttcgctgcctaaatgcaactttctagaatttgaaattttatttttggaaccccttgagttgcgcttggaagttttctgctttttcagtaaaccatgtttcctctttttcaacttctgaagttctactttggttcttcgtttattaacgactattctttttaatttgctaaggatttcctctgaaacatgacttttcccagggctacctacagatttctttgagggtcgctgatctttagctctgcccttcttctcagattccataccttcaaggaacacagcataagcttttgtgacagaccagtaagatcctttaccactaggaggtatatacacagaatccaagtaatttctgccattcctgggtctcagatcaatcgtccaaccagcatctagaagcatgcccttgatatgatcacttattttttgtttttcttcacgaagacttcctgtatttatctgctcacttggacccgaagatttcaaactggaagccttgacttcctttctattgcctttgggagctttaactttccttggtgtagatccagcccttttcccagaatattttcctctttgatgattttttctcagtatgatcggttcctcagattcactagaatcctcttgttttttggggacaacaccaccacttcgagtacgtcttacacaagtgttcttcaaggaagtatcactgccagttccatcatcatcggattcattctgtgatagcttagattcgtttttattggagcaattcacagatgtactcaacttagctgtttgactctgatgttgccgtcttgtcgacatacctttcttacttgagccacagttatttctggtaagtttctttccagaagacatttttggttgctctagctcagtgtctgaggatgtatctcttgccttctttagggatggtattgcaactggtgactctccactagctttatcaagtcctgattccaatatcctcttcttactggcaacaatcttagcgccaactgataatattgacttcctcacagcggccttgttctcagatttaactccttcagaatctgtgagctctatatcatttttatcagtgatggctgaactacagatattctggtctaacccagaaactgcgtcttctgttttatttactatgctgccccttcttgtgagtggttgagacttgatatcgatcttcatctgagtttttgattccttgttctgcgtgatacttggaggatcatcattagcaatggcatctgagtttcttcgagtggtaacagttccttttagtttcttctttgtatcagtgtcgcattctgccacccctgtgtgatgaacttttgagcgcacggtgctgcccactttccttgtataatgatgaacatcttccttcctttctttgctttccaagttagcatcgtttgtagcacctacgcacatgctagcagaaacctctctctgtctaacagtagcagaccttgtaactcgcttctcaaatcgaacctcatcttcagatttcacctgcttcgcttcacatgtttttctagttattgattttctccttataaaaacaatgtcaggagttgaatcccccttggtttcattcacaggactgtcgatccccttcttttggttagtgcaatcagttagcataatgtggttatcaactgcgagctcaatctgagaaatttcagcttctttatgcttatcgtcaaactggcaatggttctcaactttctgatcatcactagcgcacataacggtatcctcttgctcaatagattctcgtccacttgcgcttctgcttaaacccatgctcaattcatctccatttgctgtagccaatgggtctatgacctctccctggcaaagcccattaacccccttgttttcctgggagtcattgatgcccccaacacttgttccacctccagattcattctgctcctcagaaggtgtagacagtttgtcatctgccttatccatctcaccatcagattcctgaatgtcagcgtccaacccattcccttcagcaatttcaacctcagcaagacccaaactttccacattatttgcggaacacctaactgcctcaaccacagcatcgctcactaccgcaccagtcacttccccatcttcctcagcattgcaagtatcaactgtcagcacccctcctctatcaccctctgctatgatatcacactgtttcttctccaaaatgtcacccttgcaaacatccaaagccacaccccccgctgtctcagcatccacatgcattttcatggagttggacctcaaaatcctctttgtcgaggccccattctcatccacggaaccccttccatctttcctcttcctccccaccacagtgagccctccaccaagatccacatcaccatcaatggtagagtcgtccacctccaaggaggtagacttctccaaatccttcatcgctccgtctttggtctcaggcaccggactccgcttagaaccgttatggcccattccaattccaacaccctgtgcatgaccagaaactcatcaaaatcttaacttgttgtcatcaatttctcataaaaatgtaaatctaaacttagattcgaacagcatgatccaccctaaaccctactttggatttggacatgcctaatcaagaaacttagggcaatgcaacataaagcacatgaaatggccaaaattaacaacctcctccactaaaaaggaaacccgagcgggtgatgaactcagaatagattataccaccgagcagaacaacgattccaaaaaaggggaaaacaaaatcagagacgagcaactcacccccctcaaaaatatacaaaatccagcggaatggctcttgctacaacactcccgcctcacgcatgtcccggatcagcagatcgcgcggccgagcacccctaccccctcgccaccgcaaccg

SEQ ID NO: 9421 - DNA, 1245 bp, Oryza sativa
tccttttttaatagagcaacatctatttcccataacattatttcataaaaagcatattggtcatagtaaggataaacaagtgcgatgaagttacactcaaaactaaagatccattcggcgcatttcattatatgattatcccacactaatatgatgtatctcttagtttttgtctatctctaaatctacccataagtcatagcaagaagtatcaatggctccgtcgaaattggaattcagcaatgatgaaagagggtagcacacgagacctaaaagtaaatagatgcggagacaaggatttagatggatttagacaggttcagaccatctcaataagaggtacgtaagaccctactcttgtttggagattgtatctactgggtgtagtattgatctgacgatctaattgtggttatatgtgttcttgctcttgaaggactctcccagctcgtcttatataggttgggggaaggattacagaggagcctgccttttatataggctgggggaagaattacaaaggagaaacctagccggatacaacattagtttcctaatctattatatgatagtactcggtcggagctctatacctgccttaacatacaaggcaacataacaactgagcaactgagttctactctattatataatatatgaatccggtccacctactatctctagtcgaatatagaaaccgtgtggatgtccaatacacatattctctacagcctcatcgatgtttttagttttagtatatacgacattacggtgagtaataataagacttgcaaccttcaagttaaaagatgtaagataggagtgaattagcccagggcatggccttcaaatcgcaaccttatgaaacccctttcctaacccaaaataactctcggccttagctcctaccgtcactcccacgtgtgccgagcttgcgcagccaacgcatccaggacctgacacgtgcgtagttccacgtgtccttcttctccatgtcacgccggctgccaccaccacggtataaaatcttgcggcattgcacggcgcgcgctgcggcgagagccatggcgcaagttcaagcccgacgaccaagaggaggagaatgccaaggtcatcaggtagtacagcctgatggcggcgacggcgacgccgagcggcggctcatcgccccggcggacgcctcggggcaggccgcgcactgcggcggccccgtcgtggaagtcgacgacgcgtacgacagcaagg

SEQ ID NO: 9422 - DNA, 9598 bp, Oryza sativa
  unsure (1)..(9598): unsure at all n locations
cgtagaaaatgggaaagtggttttatcccttaagatatctcctcattttatgcttacggatacctccttattctttacatatattatctaaatacttcaccttttcatattataaatcttataacttttctttgtcaaactattaaactttaactttaattatgtttgatcaagtttatagtaaaaatatacaaatatttttaatacaatacaaacatattatcaaaatatatttaatgataaatttattgagatttagtgttataaattttgctaatttttctatgaatttgattaaaacttatcaaaatatatttaatgttaaatttattgagattcagtgttataaattttgctaatttttctatgaatttgatttaaactaaagaactttgaataattgacctctaatataaaatggttagagtattatcttaaacagttatcaattttttaaaaagaataataagaaagattaatataaaatatatctatcatatatatgcaacttcaaattaaacttctaaaattataagaaaagtacgtcagtattatttgatattatatatttataaatgttccttctaaaaaagatttttttccttcaaaaataatatatatttataaaatgatatatgttatattaattattttttaaaaaatatatctatttaagcggtatgtaaaagacgaggcaaaagatgaaaaacccatctccatctctttcagctagctaacgcagcagcacaacgctcactgtgcatgcagtccgtgaagtggctcaagcactcgaatctaccagctagaatcaaaacacgccgcatctgccatacccataccctctcggctctcgctggttacccctttcgaccgccaccggcgcgctctggtgtaaaccccccacgacgccacgtactctcggtctctcgccccgcgccctcacgttgtcacgtacaaatactctcgtcgcgccgcgcgccacctcgccgccgaggcacgacgcgcacttgcgccacgagaacgtgccacgtcacgtgtgttcttttgacgcaagcatgagccaggggcagccgaggaggccgccgcccgacggcagcggggcccggccggtgatgtacggcgacgtgttcgacgtctccggcgagctggccgggcagcccgtggcgcccagggacgccgcgaagctgcagtcggccgaggaggccgtgctcggcgaggcgcagaagggcgggcccgccgccgccatgcagtccgccgcggcgatcaacgcgcgggcggggcacgtcgggcgcgcgcaggtcaccggcgccatcgccgacgagggcgtcgccgtcgccgtcgccgagaccgagctccccgggcgccgcgttgtcaccgagtccgtcgccgggcaggtggtggcgcggctcgccaccccgccgcgggttgtggccacccagccgtccggctctctggacaaggaccccgtgacgatcggccgcgctttggagtggcggccgcgaccgccccggcggcgggttagccggtggaccagaacgacgcggcggcaatccaggccgccgagatgctcgccacggggcgcaccgtcaccgtccccggaggcgtcgccgccgcggcgcaggctgcggcggaccacaacgccgcgcccgcggcacgcgacgaggacaggatcaagctccgggacgtcctcacggtgccatccgccgcgctctgcgatgccaagtccgctttcttttgaccgtacagcagctatagctaaccttggatggtgtgtgtgtgtgtgtgcacgcagggggcgaggggcaagctgccggcggacaaggcggcgacgagggaggacgcggagagggtgccgtcggccgaggtgcggaacaggccggacatggcgacgacgccgggcggcgtggcggacgcggtgaccgcggcggcgcggctcaaccaggagcgcccgacccgtagcttttagcgagcatatgtgtttacggtgctaagtatgtttttcttttcgtttgttttattttttagcaaaaatgtgcgtgctaatatgttctatatactatgaataaaactgttatgtgtagcattctcctccgtataagagagtcgtcgcatgtgttaccgtaatccagagtgctaatagtttacaacgagcatatttgacatcaatcactactcactaatgatcgatcttctagacgaagcagcaatataatacatatatactccctccatccctaaatatattatataaatataaatataatagtactatataagagattttgtaagagattttggatgaatggtttgtattttagtactacaaactcctatataaacttctgtatagattcataatactaagatacgttcattcatccaaaatctcttaagatacgtcaattcatccaaaaattcatccaaaatctcttgagatacgtccatttatccaaaatctcttatagatatacgtcacattcatctaaaatctcttatggtttggttcatctaaaatctcttatagtttgggactgagggaacagtcattaacaaatatttatattcccagtcattaacaaatatttatatattaaaaaacccttatattttgagacgagggtgtagtcattaacaaatgtttatatattaaaaaaggagggattactagttacataatcctgacaatctattaagcgatatgtactgccaataagtgcagatataatcactccttagtgtatattcaccatatgctgtgaaaattgaactcattgaccaacaagatctcgccgctgcaagtattacaaaagaacgattcattgaactttgcatttaactttctaacaacagttgtgcactgccttcttttcaacttgaaacggagccagtgagacacatctacaagggggtcggtggtggagaatgcactttgagttgcaaacttgcaagagattttactctttcaatttgatgactctctaagacatacgcgactagtagcttgttgcagcatctaaacatctgtcagaattatcgatgatacaatcatgacatacgcgaggaagaagaacatgacaatctggatgaagaacttgggattgtccctcaagctcggagcggccactgatctactgcttgagaatacaagaataaattcagttatgtacagtcggtgatgagctaggtgtggtacaaaatgatgcattgcagcatatcttaccttgcaatgcgttgtgaaagccgatgaaagggtaggctctgtatgaagaccacgcctggtcctgtgagagatgctgtaagctggttacccccctgcatagccgatggttcatcagtgtaaggaaattagttattttcaacaagaaactttagttgataggcagtaggggggacggatgtactcacactgaagactactcttctcggttggttaggggttttcaactgaaagttgatggtggttgtcatagccacaatacaagcagcgtcaactgtaatcacctcacgaggggcaagaattttctgcatgactagcaaaagtgaagagcaaaatctgccagagttaggggctttgttggccagggttaaaaaataacttgcttatgtcaaaacaaaaacgatatgagttcaaaaggttccatgctaatttgaaacaaatcggagatttcatacttcactatctaacttatgacagaatatgtaaatatatagtgaattggatagtgccgcaggtattgccaatgttgacaacattaaaatcatgccagcataaactgtggcaccatattatgttcctttagcactagatagtatatatcctcaatgcatcctaaaaattttacagaacatcagaaccatagctcctaattatagtatgaacaataatatattctagtatttactccatagatcagaacagtattgcagtttcaaattccaaaatcaatctccagtccatgaaactgacacaaagggtgaaatgaattatacctgatccaccaccaacaaggaaagccatcccttgacccctaagcttctgtttgaggatcacctgtagagggaatgcacatctttcaattcccaacaaaaagttaacaagtactagcttgcaaagaactaacaggtcccacatgatctccaaagtacctaaataattagttaattaccctacctctgcaccaatttcaatgtttcgcggcctctgctcaactgtacttgtgactgacacatcattaactgagcagagaaaagcatctgcctgaaaggacaataaggtaatatgaggtttctgtgattgttttcagccaaacaactaacttcgcacataacttacctggcaaagaagttctccaccaaagtttgctagatccatctgtaatataataaacattttccatttatgactaagaaagcaggttggtcaataatataagtaccactttccataaaatttaatagagtaaattatatgaacactgaaccaggtattcattttcacggaaggcaatggtttgctggaataatatgataatatcacatctagtcatccagaacctacatctcatgcagcttactagattaactcatacatgttattatcatgctagtatgcacattacacctcattattaattgctacaggaccaaattctaatgtatgcacaatgaactgttgacctttttatctataggtaaaacatatggttcagattggaaacaactgagtgctggggagtgcatttgaaattttgaacaaaagaatgaagcaagtcctccacagtctaaattctgaatcataattatagaagaatgatggaaatttgtcagtttgtcactaataagatatgtaatcttgctaattgtaagaggacaacagtgatgattacccatgagcgatatgctcatatgcagttctgtacagtaagtaaagtaatggtgcagagagtcaaagctaagctacaagtaggtgaaagatgatactagggatttgaatgacataatgactctattttcaaaaaagatactaacaggcagtattctcccaggaaatggtgcagaaatcccaacatatccatcatcagagccagggttgaagaaaacactgctgcttatgcttttcccaaaaatccactgccacacacctccatcattttcaggcaagtagttgttgtccgtttgaatattaccagacatgtagcacattgtacctgaagaatacaacaatgatgaaagctacacactaacaaactctaagaacatcacaggattcacagaagccatatgacaagcactagcagtaacaactgcatacatgtttttttcgagggagtagggcaggagctctgccattcatctaaagaagacaatttgaaatgtttacaacaacagttttggatttactattacaataaccgcataaatgtatgtttggctccgttgcctatctatgagcatgtaaatccttatccaaatttaggtactcctgggtaggtaaaggaacccacatagccccttaatttactaggaatttcaggacaagttacagtaaattgcactacaaaaccatgatagtaatgaaactactcatgtatattagatttatctggttttatcataacatacaactaaaagtatggtggtaatctatagttctgcaactgatcccaattattacaaagttaaccttaaaaacaacaggtaattcagcatctgaaacaaagagtattcataaatcgggcaagctgcagatatttcagctgcaaaagagaagttcaatcaagttactggagagtacctggtttcacggtcaacttttcctgtgacttaaccatcacctaaaatatcatttcgacacaacaattccgaatgagcagggttcgattcctcttaaggatcgaagattaagagctagcaaacaagaataaccaggagctacctgcaggacctgcacatcgccgccggatatctggaacgccgtcacagatccttcctggctctggaaccaacacacacgattcaaaccaggttagatcagaggggattccaatcagcaaccaaacgctacggatcgggcggatccagcccgacgagctcgaatctagccctaacatccacgccgggataagaccagaccgtgtgtgcgaagggaaaaattgaaggatcagatcgtgcagcggaggagccccacctggtagacgtagggctggaaaggcgtggagaagaagggcgcggccatggcggggggtcggagccttccggaagcttctagaagcgatcagtgagagccgactcggagcgtcgtcgtcgggttcgagggaggcggagttgccattcgacgacctctcggggtccttccggttcagggcttaatttctcgagtttttatctcctcttccttttgcagtcatacgacgtgggattatctgggccgtcgatcgagttctggacggtgggtgatgcaggggaggtgcttgcgtggctggtctcgtggaagccctgtgcacgtatgcgtccgtgtaatgttggccggtatggcctggcacgacttggcaggttaatgctcaggtgaatttttgggattgttggctttttttttttacacttacccaccactgcacacgaatttattcccgtttaaatgaatcttttattttcgtcataagttggtactcgtagttgagttctactgtaaatgaaaaagatacgatggtttttgttaacaccaaaaatttaacaccttgacacgaaataggaaatcattgtcagagtttgaaaagtacgtttctttcacatgaccagtctgaccgacgacttgtgactagtcagaccggctaagtccgagtctgagtctcgagtttcattgtttggtaatctattttttcgagtcctaattgatctctaccctaagttagacgtggaggaggtcttatagaaagcaagataaacctctttataagggtcaagaccagttcgattgaccacacaatctgtttctagcacaattagccaattgaatcactttttcaatgtcgcatatactttctgcctaattctagcctagttttgtccatttttgtcggtttgaactaactgtcatctatcctcgctgtaagagtgcaaatacccttttgtaaacttttcatttgcccatgagacgggtgtttatccctgtttcatctaaatcggctccactggccgatttaattttacaaaactcatcttgatttaggctgtgttctttgctcaatgttccacccctcttcctcgtgttccgcgcgcatgcttttcaaactgctaaacagtgcatttttgcaaaaagtttctatacgaaagttgcttaaaaaaatcatattgatccatttttttaaaaaaattaactaatacttaattaattacgcgctaatggaccgctccgttttccgtgcaaaggaaaggagttcccaatccactgaaaagaacgcagccttagctttgtttagatcgaggtggttggcgactccgtgtcaccatatgacgtttaggtgtttcgatcgtattttgtgacttgttcaaaaaagttgccaacaactttgaatcctaaaaatatggtaacacacatcgagtgaggtatagccttgaatctaatgtctaaatacaagatgcaacgtgtgagatatgcacttctttctaatgatagaaatccaactaaattgtatcgaacgggtgcaagtgcacaagattaagagacaagctaatagggttgctcatgtgttagcacaaatggcaacgagtactaggtcgtgtggggaatggaggctgtgcgcccccgcatcaatcctagacttgttaaatcaagaatgtaaccctctatttagtcattaataaagttctctcttgactaaaaaaaactacataaaacccaacggggttagacattataaaatccacttatatataagaacgctataccattactcatccaatcgctttatggcaaatatgcttcaagcttctgtcggttagcaagttccacttcatctaagatataattaaaattcaagacaacaaatggggttgatacctatcatgccttgccacactcggttagaagggctgaattttaaagtgtattgtcagactgttggtaacttgatcatactttttcctaaattgctttaatttgggatgttttatcttctcgttatatttttctgttgttagtagagaggtgcaaccccttaattttatacatatataacacacgtcttatatgaatctcggtaaaaataatgatggaagatgaaccttagcatcccatatcattaatgtcctcctcacctgagatcatgaaacatgaaccacccctattcgatttattcaaataactgaaatatgcataactctcaagaaacatgaaccgcccctattgagtttattcaaataactgaaatatacataacgcttaacacatatgacagtttaattaatataatgtaaccgctgatgtgataaagtggcaatactatggagaagttatatggcaataatagaccatgtaaatgattgtgctttattcttagtttattaccatattatacaaaagttcaatgaaataaaaacaattgtctttaatatgtccggctatacttaaaaataatttatgtcgtttttcagaaagtagtaaaactacattttgatctcacctttagcgggaaaacttgttgctaataccggacagaaggattggaaaaagaaagatgtaattacctaaacacaaataaacaaggtattgtgatttgttatgttaaaagatgaagagttatgataactatattttgtcgtatgcgagggttttataacatacgtcatgccatgttgactcattggaatccgaaacttatagcaacatcaaatgtgaaatgatccattagattgtttggaccttttgtttatttattattaccattaccattattattattttttagaaaataatatagatatgtgataaggtctatatcttttcagacttacctaatccaccatagactgccacatcataaattctacgtgtcgtcctccgattcaacctccacgacacccaaaaaccctctccatgtacaacgtggcggtcgcgccgtgccagctggaccgcgatgtggcagaccaagtccagccaaggcccaaccggcccatatcccagcattaactcgtgtccagttttagccaaactcaccgtctacgtacgtacgttacgtatacacatactccatacatacgcccaccgtatatgatattggtagagtagagatcagtagacctgaccaccagcctcccccacccccacccaacggagagagaatacggctactcccattctctctctctcgcgtcgcgttcgttggctcgttcgttcccctcctcctcctcctccacgctgctccacctctcgctacgcttcttcgctggtaagatcgcaccaacccaatcctgaatccttcctcctcatcccccctcgtctcgccgattgctgatctcggatccgttcgttaggtaaaccctagatggcttgatcgcgcaatcgctcggagcaaaggcggnggggggggggggggggggg

SEQ ID NO: 9423 - DNA, 10469 bp, Oryza sativa
ggggcgaggagaggggattgggtggagggttcaattcaatttcgtcaattcgtttgcgcggcgcccgctgcggcccgtgcggtgtaggcggcggcggcggagcgctcgcgggggagcggcgttgtggctggggagatggtgaagaagaaaggcaagtatagccccggcgcgagcggcagcggcagcggcagcggcggcggcaatgcgggaggaggccccaggccgggcggcagggagacggtggtgtggtccgagaagatgaacgagtatctcatcgacgcgttgctgcaccagcaggcgatcgggaacaggggcgaggggaggtttcactccgcggccttcgatagcatcatctccggggtcgccgagaggttcggggtggccatcgacaggtcaaacatcaagaaccgtctcaagtccatcaaggagaacttccatgaatgcgagaacctcttccagaaccagagtggctttaagtggagcgcgatgaacaagaagttttatgctgacccaactgtttggagggagtacatcgaggtctgtttattttttgttgtcaatcaatcagcattgctgaaatttctcaagctgttttgaactctttgctttgatcttgtagaggaaaccggaagccaggaaatggatcaacaagcccattgatcattacgataggttactagagctattcggtaaggatagagaaagatgtctagcttctggcagcccaaagagtccaccggcaaaaaaggcgcgaagagacccaccaaaggagaaacctcaacggacaccaacaaatggtttggtgtcacccattgtcaaaagtttgaaagacatggaatctcaacggacaccaacaaatgttttggtgtcacccattattatcaaaagttcgaaagaaatggtgaatgaaaacgaggtatctatctctgaaactgaataaatatgagacatataattaattattttgctgacatgatttgttttcatttcgttgaatgagggtttagcattagtaaaattggtagggtgattggttgaatccttatttttccacctctaactatttgttatgctttcttatgcaagtgtttgtttcgtcaccaaaattgtggcatgcagtgtttctttagccctataaacctacatgtgataaacacagtattttactagcttggtcagaattattccgtggactatttggtcgcagctgcaagctacacttggcccaacagtaatctatgcaaagtagtctatgataaaatagggtaaccagatccttttgttcagtaggtgcatatgcatttttttaaaaaaaaatgcaaataagataaattgtaccttgagctttttgttattacctgcgtgctgcatgttctcataccgctgtacaatttctgtttgttattttgtgcatctgctgtcatcaaattgtctatcatttcattcatgcaaggttgtatgtaatccattgcatctcgccaaaacttcactgtacacaattgcttctctgcattgagataatccattgttctaactgttcttttggtctctttcacttgaccaaatcaaagaatgaatgcaagtctgcgcaatagtctctgagttcagtacatgagtaaaatttcggctatatgttcttgactgatgagattcctgtttctttcaggtccctagcgaggcggtaacagaaattaacatagctgaggagcaggatctatcagaaaagttcacaagtgagaatggtgctatgccagttgaaggtaattcatgtggtacaggtatgccctatgctcccgaaaactggccatgtcctggagatcaatggagctggaaagtgggaaacagggcttctgcaactggccactggcttgataggtaatgctgttttctaggcctaaatagcttccatctgaagttttttacttttgctataaggagaagaaaataaacacaggacactgattcttaattagaatcagaccaagtttggtaggtgaattcttctagtgtgttggaaggctcgtatgctattattcattattatttttagaactgggccagtagctctatcattccattaaggagaagggacactcatgctagtggtaggacttgaactgggtcgatggcaaggttaaacagcctcccaccaacaggccgctggccttccccaccaaaattgtttgagttatctatggttgttcggtctagaaaatgaattttagcagtactattaacttgtgttatggatacatctgtgaacaggtaccttacaccgccctcacgttttcgtgatgctactggtaaaaagacatcattcacaagtagactaaaggttgaagaatttatcaagacagagtttccagatatggatccgaacacattcttttctatgtttatttggaagatccctgctaaaggacactgtatccaaagaggttaaacctttctgttgccttttatgttcttttagttgctgtttccatgtaagattgtcttttacagtatttcctagcggtgctgtacaaccaccggaccagagactgggctctgacatcagctcactggcagttgtggtgactattggattctgtgcggtttagaatactatagcagaccattacagacgctgtagtgactagcggcttggactacatataataccaggtgcttatttgtagagatattcaccaagtagccagtgccatacaccattcatttcattgtgtgtattgggcgcttcttatgtaggattagaccttctttttggaaaaacattcatttcatataggagactatatttttttgtgacttactatttgattctcttgaagtaattaatatacaacattacttactaaaaatgcctacctgcctgaggacctttctgtgttcctttcctctatctaatagtgaccttctcgtgtaatcaaaatctgatttttgtatggcttacctttttcactgttattttgtataaacttccatattttgaatcttttatgttttaagtagctaacatatcactggaactctaccctatgtatccccgatccacatttttagactttcttttgacacagtctgtgccatcgattccttatcgttataaacactttgattggttttgtactttgatgcaccttcttcaataactttattcagctctaccacttagcatacctcctaactaacaggataatctagtgtagaaatgtgaaaacatcacaggttacctgccatgttacactggaaataaaaatggaaaaagtatacattggaaataataaagtcgataggcaacagtgcttctcagaatgcaatagattctcagtgtactaaccacacttttgatttttcttgtgcctatgcaccatcaatgtcgatatctgttatcatgtgataaatctcctgttacagtgcctctatagtgtagccaataaactatgttctcaatattgtttagccagaatgatatcctatctatttacaaaatacttttgttcatgtgtaatctgggaagtgcttcaagacttggttgttatttttggtggatgcgctttgaacattttaatgtttatcctgtgtataacacacatattttatccataaattagcgacaacgggccctgggctgctcgggcttcagccaggcctggtcctgaaagacccttgtaaccctttatagaaagtaaaatttacaggtatagagggcccataccaggatggtttgtttgcccagcctgggtaaagcccatttctggctccgccactgtatatataggttgttctacacagcttacctcttgcactctctgctcctaaaccctagccgccaatctgatccttgcttctgcctctacctcatcgtggtgccgatggatccatttgcgcgaaccaactcattgaggcggatccatgaacgctatctccttcccccttcggagagtaacactgacgctggtttttacgtctatattctggagtcaagttacagtaagctccattcttttctatcaagtggtgttttccattgattcaagtggtgtttttccccaaatcgtaacaccgataaaggaaaatagatcatttgcctcattcggaattcatatgtagcatataaactgattttgtcttacttttattcatatctaacctggtattgatgtgaggtttgatccaataccttggttgtaacatgtagccaaagggatttttttcttcacttgagatgtgtgttctttcctttgtgtgttaacgggttagaaaatgcatcctatatactgcctttgcatgttttctgctactttgttgattttcccttgtatttttgctgttctttaacaccaaaaatgtcttcaggaggtggagaagtgaggagggtcttttgtccttatgcaaggcaagctgatccagctggaccatgcaaggccaggaataacttgtgtaaacttgagagagagggattcattgaatcatctccggcacaggattgtgacctctgctgcaaaatgcctgatttctgccgagagtgctgctgtgttttctgccgcagggttgttgactattcctttggaggttatagctacattaagtgtgaggcagtcctagaagagaacaaaatatgtgggcatattgggcaccttgattgtgctctccgtacttttatggctggaacagttggaggatgtattgacttggacatgcagtattgttgcagacgttgtgataacaaaacgaacttgatgctgcacgtagaaaaattcttggaaatatgccaatctcttcaatcaagggatgacattgaacctatcctgaatactggcttatgcctagtgcgtggttcaagacaaacaagagcaaaaagcttggagagcattatgagatcagcaatggcaaaggtatggtcagttttatttttttagccacttgtggaaacttccattttggtcaccatttatcttctttttgatctcttataagtagtttgtggctatgcactgatggtttacaactatatgcagctaaagtgtggggttgatcttgctgaagtttggaaaatggaagataatggtatcaactcaactccaagtgcaggtaacttaattttgaatgcaactgatcatagagaactatattaggcaaatatattgctctagatatccagaggacaatccattgctcaaacagcgcccagcctagctgcaatggcccagatatttggtgccctcttatgttattagacagaacggaaactctatagattatgctgatatttggatcatactagtcaaaaccatctgcgatttgttccatacagaccatttattttgaaaaatgtaagtgatgttttggtagtttttgtaacatgtggagtctagctcccctgtcatgcccatggcttcattgctatagatatactgctgctaatcatgttgtctgtaattttgcacaattaaaaccatagaggactgacaacaatttggatctcagatttacttctgttgttgctttatgtattgctttgctgctataattgtgcataattgagttccatatgtctcatgcagaagtttcccctgctaccggtggtgtaacagtgcttgggatccagcaagctccagaagaggatgctcctccagggtttccatattatgttgatttggctgacaatgatttgcagagggctgttgaaaatcttccagcttacattaccgaggatcaacacacactgtctgtcaggttcgaagattcgatagatcatgctcttaaagaactgaagagatctcaggaagcagagtacaagctggcagagcagaagctttattcccagaaggatcatgtcctgagtctttatcgtcagcttgattctgaaagatccgtccttgcagaccctatgcccttagctgatgatgatggttcactatatagtacactaatcaccaatgttatgaagcgtgtggatcaagtgaagagtgaagaggagaagctcaaggtcatgctgggaatcgctgatggatttgggaaaacgccatcaggagtcattcaggagcatttcgggctacctgctgatactgccaactgagagtgcctgctttgttgtactgtcgtatgagtttgttaccaacccatctggtttggactaaaccagtaataccgtgaaactcgcggtaatccgtggacatgcctttaggaaccttcgctctccctaataccagttttaccgtttagcagtaccagttttaccgtacttaaagtgatcgttctactgtcagcgtcgtttatccttgtgttcttctgtcgtgtaagtaaatttacattacaggttgcttctgctgcagctgctgtgatcccagagcaatgttggagaggtaagcatttacagattttgactagaatgagcagcagcgcagcacggaggcaattttcctttcagtaattactgcttgtcagttgtaagattaggcgatattcctgttggaatcgcaatactgaagaattcatggagctgaaggaaccccggcgattgatgaaatctgcggtggctgagtaatctgatgaaatagtagatcagctggtgacatcaggtctcgctcgaagcagcagcctgcagcctgaggattgatttgttggttgcggctattaatatactccctccgtaccataatataagggtttttaagtttttgcttgcactgtttgaccacttgtcttattaaaaaaattattcaaatataaaaaacgaaaagttgtacttaaagtactttggataataaagtaagtcaaaaaaaataaataataattctaaattttttttaaataagacgagcggtcaaacagtgtaagtaaaaacttaaaatcacttatattatgggacggagggagtatcacttgatttaggactcctggtcatctggaatctcgatgctgtcagacgaatcttcagcatcatcgtgctgagtcattggctcattgcacctgactccattgttgcgctcgttgagttcagctccatatttgttctctcctgaattgtttcaaggaattgtgaatggattttccccacctttgccagccctcttctcaaacgtgttaaggttggaaaatgtgatagatgtagagatggatgtttgagcagacggcacagtttcattcatgtttcatgaccgaaatttagagttccccaaaccaatcttttttgttcttggttgaaattcgttgaatttatttctcttgaaattcacgaaatctaccatctcgctaaggctgacattttaacaccaaaacaaaggaaccctgggcatgagacgaatgatgggtctgggcgtctggccacacagaggggaggatgaagaacagtactatgtttatgtggcaaggattcgagtttgaaccgtacgtattttctcagaatacactaccaatcgagtttgataacactactgtacgtatgtaccatcgatcaactccctccgtcccaaaataaacataaccatgagttttcgtgttcaactttaatcattcgtctattttttaaaaaaaaataagtcacatataaaatattattcatgtttgataatataataacaataaaatattaattataattttttttaataagacggaaaatcaaagttggacacagaaactcatctctgcgtttattttggaatggagggagtaataatcaagatatgatcttgataatcagaataattcggcagttcttaccccgttcatctgactaaacatcacatcaatacaaccaaaagaacggatacacagtgtgttccaccatcaatctcacaggagatgagacgaacaaagcaaaagctaataaaaaccatcctaaacaccacccttcttcaagccagagtctttgaagtcaggtcgggttcgcctgaatcccgccggcgccgccgtggaaccgtcgcctggccagcctctggcgagcccgcctcgccaccgccgagcacctggacgccaccagctccgccgcggcggggatcagccgcgtcccctcgaacaccacgctcctctggtactccaccacccacgtctcggcctccagcctcaccgccggcgagctccgcccaccgtagctccacgagctgccgttgctcgccctcaccgtcggccacaccctcccgtcggaccactgcaaaaatggcaacaacgacgcggggctcagctagctagctgcaaatgcaagattggttttctgggagtttgtatcggttatgccctgtttacatctcgtcctaaaatttttcaccatatccaattcacatcgaatttttcaccatatcacaattcatatcaattcatatcgaatgtttgaatatatgtattaagtattaaatatatgctaaaaaaaactaatagcacagattgtgactattttgcgagacgaatcttttaagcctaattgctccatgattgataatgtggtgctacagtaaacatttgctaataacgaattagttaggcttaataaattcgtctcgtggtttactgatggatttttttttagagaagggtattttctacccggcctccatatctaaccggatatatacggccattgagatagggaagttagccccgcaaacaatccaatctgaaattcactccatagaagatttaaactcaggacttttgggtactactcaggtcactgtaaccactatattacatgtcatttcgtaattagtttttttaattagtttttcgtaattacttatggattctgtaattagtatttttattagtaccgaacacctcatgcagtatcctatataatatctgatatgacacgctaaaactttagatcctagtaacacccccttagtttacctcggtgatcttgccggagaggatggtgaggtgccgtgccgggagcgcgcgggggaggaggccggaggtgcggagtgggctcccccacacggtcacctcctccgccgccgacttgtacacggcgcagcgccagtagaacacgcgctgatcattctgcgcgagatcgagatggaaatctctttaacccaaatcaagaattcaacattctcgcaggaaccaaaaagggaaaaaatgttaatacctgctcgaattgccagacggaatcgtgcgagctgcagttggagatccccttctcgccgccgacgagctgcccgagcatccgctccagggcgcggagcttgtggctcaggccgcccggcgcgaggcgcgcctccgtggccagccgtgccacggcctccggcgagagcttggggccgaagcccctcgccgcgatctccgggacgaggccggagtccacccagaggaggaggaggaacccaagaaccgtggccgtgtagagggcccagtcatgcgatcccccgggggtcttcctcccggcgccgccaccgccgccgccggccgcctcctgctgctgccggggcctcctcgacttcgcggtggaccgcatcggcggcgtccacggctccgtgacggaggagccgtgcggcgtcgtgtcggcgccgccgaagagcgggcgcggagcgggcttcctgtccctggccgccgcggcgaaccacctccgcgcggaggcggcctccggcgggaggaggtccctggtggcgttgatgctggcgaggcacatctcgcacgcgcagttggcgtccttgcggcatcccgggtagtagcaccctcctcctcccgcaaccccatcccacggcacgactatggtgggcggcggcgtccgcgccgccgccgccgacacgctggggttggagttcgaggagcaggaggacgcggtggtggagcagcgcgtggcggtggtcggtggcgtggtggcggcgctcggcgctctcctcgccgccatctccctctcgtccatggcttggctggatggtttctcggagctgtgagttaatgcgaggcggcggcttggagaagaagaagaagaagagacgagttgaaaaattttgaaatcgcgtggtggcacaacggcgagcaacggtcgactcctggtcgtggggtgggagatctggtgattgcagtgtggctgacgtgtggggcccacggatgatccgtgggggctttctgactttggagttcggctttccggtaaatgaacctacagtactgaagtgttaatgggccacaccagacaccagtttaggcccccgttcgtttctacacggaataagttcatctaagatctcttaatttatcaacgaatccgattttcgtcattcaaccggaaaaccagatacaacgggtccctcaactatcaaaaccagtgcagatgagctccctcggtggtttgagggtagttttggctgacgtggcgctacgtagcaaatttgacttggtcttcatctgatgtggcattgacgtggcgcatacgtggcaatttgatcccgaaaaataataaactttgtgggacccacatgtcagtctcacacataaatgaagaatggtggggccct

SEQ ID NO: 9424 - DNA, 7862 bp, Oryza sativa
ggccccaccatttttttattaatttatgtgtgagactgacatgtgggtcccacgaagtttattattttttcggatcaaattgccacgtatgcgccacatcaatgccacatcagatgaagaccaagtcaaatttgccacgtaggcgccacgtcagccaaaaccaccctcaaaaccgtcgagggacctcatctgcactggttttgatagttgaggaacccgttgtatctggttttctggttgaaggacgaaaatcggattcgttgacaagttaagggacctcagatgaacttattcctttctacacatgtgcctgagctgaatgtgtcacgaagggcatgtttgaaggattttctagctgcggcagttttccatataattttcagtttccttaaacggttcaaattatcacctaaattatgagaatatatggtaaaattcagaaaatgaattataaaccataagttcaaaaactgagtttctcccgattctcataaactgactatcaaccagcagaattttagaattttaagctcccctaaatagaacagaagaaagagttgaaacattaccacatgattaataactattataaatttttagaaaatatttgtttgatttttgaaagaaagtttctaataaaatatcccatttagcaacttagaaaacgtagaaaaaggaaatagctaagctaatcagctaaaagaacagggctttacaactaatcccttcattgcttggtgaacaacaatctcttgaatgaaatttcgtaaaaactgaactaattcacaccccatcagttaaaaaatataacaacttctagcatttcaaatttgttcctagatttagcatttttttcacctatttcatcatcttcatctaaactatcatgccattttttttattttagcttcttcatttatttcctcatcctaattgatcacaatcatcatttagtttcacattaatttttagttcccgtgaaaaatttcagaagtgctttaggacggaattagctacctattgtacacaatttacatggaacggtcactgatcatcgctgcatatcgcctgtatgagtttctttatttcgtatcctctgttggtttcttctgggagcacttgtcaagggcgtcaggccctcgggtagccggccctcggctacgtagcacgtagcctcggtctgtcgtcttctccggcgaggttgccccctgccgcaggcttagttgagagagaggagattagattggtaattatttgcttaattcaatttttacccggaatacaagataagtaggccaccggccaacaaacttagaaactactaatttggaaataattaaactaggaaataactctcctaaaatcaaggctagctactatcctcggccctgccttcctgcgcgctgattgagtctgctacggacgctcgggccgcggctctcctgacgtcgtgggctcgacgctgacgcacataggtgcggccccacatgacatctctcccccccctcaagatccagctcgtcctcgagctgaaaatccaggtacacggcacggaactcctccaagtcttcccatgtagcagaagaggccggctcaccacgccagtgcacaagaagctggcggacaccgcgcgccaagcgagcgctctccacccgaatcggctcagggacaacagcaccatggtggatgtcggggagcggcgttggagcggaaagtcgatgcagaaacgtcacgacccgtcagccttcttaatgagaaggactggtgaagagaacgccgagtcgctacggcggacgatgccctgctcgatcatagcggcgcactgccgttccagttcatccttatgggccgccgggtaccggtacggacgaacagcgacagggggcgcgtccggcttgaggacgatggtgtgatctcgagcatgctgcaggggcagccccttgggctcggcgaagacgtcgccgaagtcggctaggagctcatcgagtagcgactcgctggccgctgttgtgactcggatgcgtggtgcaggagacgacggcacgcctgcccagcagatggtgcggccgtggtactgaaggacatcgtccgctccgtgaagtcccaaacaatcggccccagagacgccatccactgggtgccgagcaccatgtcgtaacctgcaagtggaatgacaaagagatcgacggtgaagagcgagccgtcgatggagagcacggcctgtcggatgacgccaggacatgcgaccttctcgccattggccacagtcgccgtcatgcgtgggcgtggctggaccggcagacccgtgcggcacgctgcctcctcggcaatgaagctgtgggtggagccgctgtcgaggagagcggtgagggtggtggcgccgacggtcacctgtacctgcatggtgtcggcgaccggtacgccggcgatcgcgtggagggagaacaccggggactccaagtcctgcggttcctcagccgcgtcggtgtcgtcgtcgtcatccatagcgcagtccaagaggaacaagtgcttgcagattttgttatggccacggctgtacttctcgtcacagttaatgttgagattatgggtatataatgatttaatttattccataaataaatcatgacattacagatgaaaactagcatgaacgcctcattagatctacacatgtaaactacgcagaataacatgaacagatcaaatatgcgcaacatattgaacacgtaccgaggtgacgaaaagaccggctgcttggtcgaaacatttcgcaggtgtctacgaaggcacgaaacacgcgagcgaagaggaaggcgagccgtcgcgaacgaacagggagcagtcgcgtgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaacgaatccgaatttgcagcaaaacaaaactgcaaaaggaggctgcatctgcgcaagggtgaggagccaatttttcggaccattcgacgcgtacgtcgtgcacgcacgccgcctgccatgccatgccatgccatgccatgccaggcgaggcgagcgagcgcgcgcgtgtgtttcccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccacaattccacagtacctttcagatagcgcattactcgctcaagcgcacgccagtgatcatctcccggattagaagtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatatagccaaagcgattcaagatcttctccacataatgggactgcaagagagtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcttgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactatggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccattatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggtgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgttgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcttgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaatt

SEQ ID NO: 9425 - DNA, 16423 bp, Oryza sativa
  unsure (1)..(16423): unsure at all n locations
tctagactagtggatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttaagaaaacaaaaaatggtaatagggatagattggatcaaagttgttgataaatcagctgttatgagcgttgatgcttgaagcacggacagtaatgcatattgtagaacagaatatgggaagggtttacataccttccaagaatatctattgcctaaataattattagtttcaaagcatgggattggttattttgtaccctatctatcagttaggacttaggaaggatctgatttagctggaaaattaaagatgttttttaaggtacttttacactgtcaaaatcagagtcataagaaagtaatttcaaacatgaatccaataatatccttttcttatggtaaaacctaaatattattggattaatagttcgtcaaagctcttcaaaattggacagtcaaaatacaccttatattcctgaacggaagagtaatgaccttcttgagggtcaaactactatttacatgaaaaatacccacgggtgtgtatagcagcagtcttgagttatccctataaaaggtaaggtttctgcccaaaccctagctaatcaaagcctctagccgtgccaggacaagcccacacgacctgagaagatcgcactatccttggtcttatgatcaaccatatcattagtgtgcaaagcaaaacaacaaaagaacacctcaccccttcattctctctctcaatttctttagttaagtggtgtacaaacaggtagcattaaattaattcaattgtcctccaagagtgattatatatagataaagaaatcgctgttgaatctagcttgtgtagatagaaatctttattcagccggccttgacaaaaggaatcacataaagaatagatggctgtgctggttatataataaaaaagggaaaaggtccatatgtttgttgatcaaaagaagactgttaagctcatcttgtcagataccaagtaggcaagtacaacaattcatgataatattccaaaaatggacaacatgttgcatgggtggtggagatgcagaaatcagggtaataagttagaagtggaaaagcaaacactcaagatggcttgcatgctttcaaaggcttactcttgtctaatgacttttttttttgtggggacttgtctaatgactttgacaagccactttctcttagctacaaccaaaatctagtttgcaacttgtaaagggttatgctctcctggctttgagcaatgagaggccagccatagcaacaatttcacacaatttatagatactatcatagttctgcgagaaagaaaagctttaaatttacatttatacctctaattcagtcttctcctcatgatactgattcagcactttcttcatctctttttgggagttccgaagagatttcacctctttaacaagaacttttatatctgctttagactttgcctcgaattctccaatatgttgctgcaaactctcaacttcttttcgtttagtttctagctcttccagtaacatttctttttcaccgctagcagttgttttctctgactgcacacgagttttctcattctgcaattaagtagaaagaaatgtaagaaaatacttgtaagatggatagtaagaaaccaagccatgatgacaaagaggagacaaagaggaaaaccaacttgttcaatcttcaggtttgactccatttcagagtacttcctgtagagctcatccttatcccattgaagttgggtaattttctctctttcggtcaaaacagcctgatgtagaatctctttgtcttttttcttcgtagcttccaactcaacctccaaatctttgacctgcacagaatagcagagaagcacaagaacaacgtacatcaataaagtatgaacaaaaaaacacaaatcaatttattttaaactcgtgacatataaaacaaagcatatcatgtgtttaagcataatccataggcatcacaaatgaatgtcaggtagaaaacgtaacctttgtcgcaagatattctttgacagccacttcctgatttagtcgtgctatgagatcctccatatcagtttttgctgtcacctgtcttctgtccatgctgatcaaaagtctagtcaacttcggcctttgatcagcaggaaggatgatttgtgcatccatatcatataaaagctgcatatctaaacctgtaaattgttctgtttggctatgtccatcaattccacttggaagatccacaggaccatcccaaagggaactactaactccaggaaccgataattcactgcccctcaaagaactcaaatcacttcctatactttcagcagagtccttcctggcatggccagggttagaatcgtgatcctcttcggaaaccactcccttataagtatctatggaaccattcctaacaccatgttccaaaaagacatggttctttttcctgtgatttgacatgctactagcccgctcattgggctgatctaagatagactctcccagcataccattaccagttgctcctgtcggaccgttaccatgagcaaaggctgaattcatttgactggactcagagagaacacctgaaccatgttcatcaggacgcggagaagaatctgcactactttttgctgaagaacccacttcagaagggcgctgattccaatcttggtaatctttcattcagaaaaatagcgtaattaaacatttgctaaaaatgttaagaaattttagttaataaatggatcaatgcacaatcaggaaaaagtgtcttcaatagaatatgtcaagcggaacatacatgagcgtgcagcagcttccagctcaagaaaagcagcaacaggtgcacttctcgacaactcaatgtcagaaagtagcttttgcatccactcctccaaagcgttccttctctgcaaacaaaacatttcaagaaccaccggtcaaaaaggctaagcacaactgaatgtagtatttgacatcgaacaaagcaaaaattaatcaatatacataacggctaacctcttctagaagcaccctgcttgaatttattcttgaaaaggcatgcttcggtggagcaggggggattccttttctgggaaattcctgcttaagctgcagtacgggagaatcttagaatgaagaaatgatattggattagaggtcgaatggaaagtaataatctttttttctcagaatcatatccaagatgagacttccaaaatgtccacattcattatagaaaccataaaattgcaaaaggtgaagtcctcattatgaagtcaccagcggaagatgcaaaaatctgtaaaaactaatttggcccaggtaagcataccgtatacactaagtcaagatttataataacagtatgttttaaagtatctgaagtctgactacctgtgtgatgcaatgcaccaaaaatcctaagttgcaacggaagtcactggagaagcaagcaattgtgcattcaatgcactagcaaatgtaagtccaattcaaaggtttgattacattttcaaatttaatgccagataaattaatctggcagaccactcaggatacgataggggattattcttatttaaaaatcactggaggttgttcttgaaaggtatgttccaactgaaaatgttagtgggcttctagctcaggaaagaaggtcggtacaatttaaagacacttggcatgtgaaagaagaaaatagcaaagaggtgtctcaacttacatcagaagataactttagaaagtcactaaaccttcgaagaactccgtggctagagctgatgccttctggagattgtataccaacatgtatcctgtaaaactgtcctttatgggcattaaaatgagatcataaacagaacagtatcaaagttcacaacaaacaggaattgcatgatatatgcaacagaattacataagtgtctcttgcccgtcgatcacgactaaactagtgagccaaaagagaggtaagatgcaccacagttaccaaaacaccaaaaagtatatttctgccagtaggtcaccctgaatcattagcacaatacttcctatggcatgtcatgttggcatacaccattgtggcatgggctgcacgtgagttaatgacttcagccatggctattgtgatttgcacttgtcccccatgagttttggccttacatagttctctctcacccccaactcaaaccccctgtgtactgagacaagtgaggcagttgtgcggagagggagaatcacctctagtgtactgcacgtcagcgattggttatcacaacaaaatttgcaccccatacaggggtatgcctcaacacgccatgttgtcattaagagtcaggacagtgtgctaacaaccaaaagtgaccctttagtgatctaaagaaaagtacagttttgtgagtccagcagcctaataaactagtttgataagtatggtggaatattggaaagtgacacgatttactcaaaatgaaagaacaataaaaaggtaatacattagaaagttggcatccactacccaatatgagatagttttgaaagaagctcagttcttcgttgataagtgctgaacttcttttgtcctttttattggtctaacaaggttttctcacttgtaatccactccaagcacatttatgttgtagcatagcggtaataccagagacacaacatttccaatctgtacgtcaatccaaattgactgacaaaaataacgtgatgataatataagcagtactcacaactatggatttcaagaagttgtcagcagtcgcactagcttcaggtgtctgagcgatccaagaaggaatcatcacacagtaactccatccggtttgagggttatgtggccatatggtgttccttccctcctgcagatcaataagcataagccgtaagaagcatcaagcaatggaacttttcatggtatcctattgatatggcatcatctttccagcgaaacctagattgagaagttatgtggtcttcatggaagtacattttctttaatacaaggaaacatcttcaaggaactttcccagttgtttgaaaattactgaattttgttaacgaggcatgtgatttacttgacggtgaaaaagaattgactaggactagtaggttaatcttcatttgcgttctaggatcatttcatgttaaatgtggtaaagatgttgggaaacacaccaagtgcaaagaatgaggctagcacaaggcaggcaggtcaaacaaaagagctaatcttcacaatgggaacaatgatgaataataaaatcaccatcagcctgctcaaatatgtatacgaaatcaattattgtacttatggccttatgcgtaacagtatgaacatgcctaattgcctaatatagaaatccaaagcccttatgtccgatggactcagacaaaaccagagtctttgaaataagcagcacatatacaaccaaatcaatccgcatatcatgaagctgaactgcactcggtttgtctaaacccatccccgcagaagtagtcctacctgaaacccatactcgactccttgcaaaagaaacaggaattcaaaaccctatccaggggaaagctctaaaacaactctgaatcagtagcaacgcaggcactccaaaccaacaaatcccaatgcagatcccaacccacacatgaattcctagccttacattccactactattacacaccacatagccgcgggcaaatccagctcgcgatatcgttacgatcgagaggacaagcattaaaagaaagaaagaaagaaagaaaatccccgacacctcgcaactaacgccgaatctgacgcacgcagcagcaacgccacaggatcgcaagctcccaactccaactcccgaaccgcacgtccctcacagatcaaagcagggagccaacccaaccgaacccccgatcaatcgagcccggatcgaaattagcgggggggaggggggggggggatcgcgcttacccatctcttcgggggcgggctccagtccatgccgaacggcagcccggaggtgccgtcgtggcggtgcttcggcgggctcggcgccttcttcctcgccgacgaaaacgacgacggcgtcgccatcgccgcccgcttcggcggtggatcgagcgggcggaagggtggggtgaggtgggagggaggaatcgatgcgggggtttggaggcgtcgcgccgacgattccgaggtggacggagtggaggaaggggagggggagtaagagggcggcggagatgaggcggacgcggacgcggacggggagggaggggctctcctcccgcggtggcgtctaaccgtcaacgcgcggcggtggcagccaagcgagggcgtcggtccggtccggtccgggtctaggcttttccaccgccgtgtggggtggtggagttggtggtgggccggcggggagttgtgtgggtttttcgcaagcccacacaagtgtaattgttggatgtggccatggctgccgacagataatggtatgcacttcttagtgacgaactggttcagtacatactactaggctgtgtttagttccacactaaaattgaaagttcaaagaaattgaaacgatgtgacggaagagttagaagtttatgtgtgtacgaaagttcaatgtgacggaaaagttagaaggccgagtttagttccaaattttttcttcaaactttcaacttttccatcacatcaattttttctacacatataaacttctaattttttctacacatataaacttccaacttttccgtcacattgttccaatttcaaccaaacttttaattttaacgtgaactaaacacacacgaagtttgaagaaaaaagttagaatctaaacaatatctaagtagaaaaaattatggggttcaatacatctatagttggaggaaacaatgaccaaacacatatttgagattgtattgatgctcgaaacaataacaaaaaaaacatgtatatctctatctcttctctactattataaaaattagagttgtttttgcaaaaattttggtacgttttgagtcggttttaagttcgttgtgtttgagttggattttaagctcgtttgattttgaaaatacaaaaggagtcgtataagaaatctctttaaaaaaactcgcatactaacttgagatgaaatacggatccaagcgagttcccacaaaccatatataatattattattattattattaaaatagcacttacccgttgcaatgcaacgcatgggtattttttgtagtttgagtaaaaaataacgaaggaagcactaacagggtttgcaatactagggtttacagtactgaacgaaaatcgctccatttccatgaaatcattggagaccaatttgtgaaaaacaagcagttttagttagttgtatagaattgaccaaaagtcgtcctcggtttttaccaatttttgtaaagcagccaagaccattgaactctgagcactacaagctatgaactgtagttagtactgtaacttaaaatctgagtcgcaacgactcgcactcagaatagacttcacatcgtcggctccatactcgacaaagcactaacatccatttcagaaaaagtgttgccaagatatagaaacggtgaacgaacaaatgcctgagaagggtgagtatgagtagctcattgcaccacgatacgcgtattcttagctaattaaccagtagccggcttactgatcagtataatcgtcatcatcaaggccaaggactgccaagaagtgcacatctcatgcaacaaatagaagtcctttcattcataggaagcgtagaaaagtaagaaaacaacagtttcttctacgggtgaatgaacatctttgatattacaaggttccctcggaatccacatacaacacggatagtaatgctgagagaccaggaacagcaggcatcagaaatggttccaagaactcttcgcaatgataaatttagtccatcctgcccttgatcacacactcttttacttcggttggtgtcctgaaaacccaaaagaagattatgtaaaagaaacgtattgatgctcaaatgaagtgctgaaacaactaaaatgcggaatgcggtaggactttgagctccaattatatttgattgggaaaaaaatcattactgatgaacttctaccaatttattgcagaacggtagataaaataatggtgcataacgtattttaattcaaaagctgtttaacagaagaaaaatgaagccactcatccaatcttgaattagtgaagtgaacttacacaagcagaacaaagcctccccaaccactgaggcaatcacgatcaactgatgactgcagagcttgtgagatagtctcaaagagttcttcaggttcctttgtcaagaaaaataatatgttgtcatgtaacatctatcattcaaaatagtggtagaaatctaaacagtacaatgcaacagaattataatatattatacagatccaaacagaaatgcgaaattgctatagcccatgatgttatcccataaagaatgttacacgggctaaatgtgatcatacaaacaaacaaatgcataccatgtttggtttgtacatggactcacaagcaccatatagagactccgatgctgtccccgatacaacgaaatccttagctagttccctgcacagaaataaacatcctcaatcagctcacaagaatatgagaaacaagcgttcaaacgcctaatcagacatatcaggcacacggacttagaccaaaaacttaaacaggtggcatgctattggaataatagtatcaaagttgtttcagtacatgatgaagcagatagaaaaaatatatcaaattcagaaaggaacaaaaaaggaatcaagcaaatctctgatagagcaagttaccaatgtcaagcatgcacacatttctctgggacagagacggagccaatcgtgtttgggtgtcatggaattcaggatagaaacaagaatggtgaacccataaatcacgttgttcattcacatggggtcttttgttaatgatgatttagaaatttgggaggtaacctttgttagatatgacaaacatatttataaattaaagatgtagataactccccacctaaccatctaaatgtggaataagactaaggcgggcatattaatcaatgcagtaaattgcagaacatgagcaatggataaccatccagatgtgtatgaatagatccaaaagaaattaatttgaataaaaacaaaaacacaattgaactgatacatactttgcaccaatgcagtccatggtacaaataaatggctcattgtcctctccaagtccagcgataacaggctggcagaagtatggtccaaatctgaattttccatgtatcgaaaaaagttagataaacttacccctaacccaataattgtataatacaaaatgaagaaagctgtttactaatagcacagagaaatcacaagtcttagcatgcaaactttacttactactatgccaatcataaaaaggctattgtattgttaaaatgttgagaggctaatgattatcaatcaggaatttcagctcatatttcccaactgcccagaagttatctgtcaacctgattgatgttgagctaatttctagcttccacatcatcataaaaaaaaatcaagcatttgcctataaatatttatcagggtaaaccaataaccgacataaatctcgattctggtgctgcccttggtgctaggctctggcaacaggctggtgccaagtgcctaaccaagtgggttaagcgcctaagtggcagcctaggtgaacagctataacacagagcacctatttcggcttggtggttgtcaagcggaacactactcatatgagtctgttaagtgcatatgagttactcttttggtgcaaacaggggaaaatctaaaaggttcaaagcatatccatcaatccatgtagagcttactacatcaactaaatcgagagtttactctttatgtgccatttgagcaatcagcaagctagcaaccctgcctacaaacaattatcaaaccaacggcggcagccatggctacaaccacaacattatggctttagcttcttagtatgctcatcgtgcaatatggttatacaagacttaaatgtctaagcataacttgggtggttgtaatgtgttttctgtctgtcacaagtagagcacacatatcctttgaaacataaacctgctgcctttaacaattgtaccttcacatagtcaagttattgtgcaacaagaacaaatctaactacttgacaggcgctttgtaacactataaacagtcagcatatctacaaaattctgcatctttccgcgaaattgaatactccaattggcatttgaatttaactctgcttcatatactactcaattcaactcgcgctgcgctagcaacatcctttagttcattacctcttctcgtagaggagagcggagacgaggctggcgaaggtctggggcttcatgtccctctcctcccgcagttgatacagcttgtgcctgaacaccaggcgctggtacctgcaccaccgaccgaccgaaaccctaattctcccaaaccggatgctaaaccaaaaaagcacaaagaggaggggacaaatctggcgcggcgactcacagcgtctgcgcgtcggtggcgaggccggagaggccgatgtagagcttgtcgtggatcttgaacaccctctggaagtccgtcgcgacggtctgcagctgcaccccgagccgccggtcgctggcgatcgcgaagcagttcttccccaccatcgccaccacggcggaaccattgtactcgaagatctgcgaggcatgggagaattaagatccgtggggcgggcggcccggccggccagggagcggggcggcggggggcactcaccgacatggccggcgcggcggcgagttcgcggcggaggcggaggcggaggcggaggcggatgcggatgcaggcgtcgaggttcgaagtcgaggaggagaatcggaggaggaggagctcacgcagtgggcttttgaggcccaacttgggcttcttgctgagcaagaaggtccggcacagggacgccactggtcgttgaatacaactctaaccacgaaattcaataaaatttgttagaattcgatttttaaatatattttttaaacacttaaccagtttgtacgtggtttcgagacctgtaatggtgtgtttagttcacgccaaaattgaaaatttgattgaaattgaaacgatgtgacagaaaagttgaaagtttgaagaaaaagttgggaactaaaccataaatcagacctaactcctaaggcagcatttatttgagaaggttggagcctcttccatcctgacggtgtgtttggctcccggtcaaggttggatgggatatggcggtccatattttgctggatatggcgatccagttttttttttgagtgaatatggcgatccagttttttgtttgggccttgtttagttccaaactttttcttcaaacttctaactttttcatcacatcaaaactttcctacacacataaatttttaacttttccgtcacattgttccaatttcaaccaaactttcaattttggtgtgaactaaacacacccttggttgtagggatgaaagtggatatggtaatccattttttttgtttggttgggggagtgggatggatgagtggttgcaatcaccctttcattagaggtggtgagtatacccctccacattctcacccaaaaaatatcaagagtaaattgcatccatggtgcatcaacttggcaggtgggtgcaatttggtataataacttaagaaattagcattctagcacaataacttggcaggtaggtgcaatttagtataaaaactttataagtgattgtataaatacaacaacttgcaagataggtacgattttgatacaataaattaaaaagttatgtgacaacttaattatttggagtattttttcaataaattcaatttttaagtacttattttgaaaatatactagcgcatatttgtataagtatatttatatttttatcctaataactaataactgaaggtcaactaaactggatgtagaaatttttatatttcagttgatatttgagaaggtgaagaccacaaaaaaaatcttaaaggtaattggatgtaaattgtactactatgtgtagtataataattcttaaagattaaatttaatattataaggtaatatccatatgattactatgcaataacatactgacatcgtaaaaaaaagctcacctagcatatgtttagccaagttgatacatcaaaatattaaattgttaagttcttgtactagaacacactcacatgtcaagttgttgcattcggacgttcaattctcaagttcttatactatatcgcacccacctgccaagttattgtaccgtaggtgcaatttattcaaatatcaatctactaaaaaaatctagatagaaataaaaaaacagaaataaataaaagggaaaggagaaaaaggaaaaaaaattcttctcgaaatcgccggccgcccctcgccaaaggtcttcgtcggcagcccctcgcctcctctctcgccggcaaccccaccgccgcacttcctatctctcccgccaccgccttgcctcctctctccccggccgccgccgctcaccctctctcgccggcgcccaccagatccggtcgtcgccggctcgcctcctctctcgtcgccggctcgcctcctctctcaatgccgagctcgcctcctcccgctggccgcaggcgccgccgcctcccgccgacgcagctctcggtgcctgcactgtcgtcatcgtcgggtccagatcgtcgtcgtcgtcaccggcatgcatgaggcattaaatgtgtcgatgtttgatgtcgtggttctggtatttgcatggtatggggatcgtcggtgctagggtatatgcgagactgaggtaaaagagatggagacagggatttttatacaggttcgggcccctgaattgtcaggtaataactctacatcctgttggccgaagccggtattgctcttattcatgataatcacaccagtacaatgtttggggtagcctatctaactgttgttgacatggcggtctgacgatctgactcgtagtcaacaacaaggtagcctcccacctcgaatccgtgcccggcgagatcagagatagcgcttttgtctctcctgacagtatccggagacaccgcagggtattagccgtgcttatccctgaagtcgatatccggcggcttgtcttggcgtatgtaggcttctatgttgtggcttctatgtcgattgtgttggatgttgatcccttcatggtggatgtctgtccccctgtcctcctaggggggcttgtatttatacccataggtgtccccttgtccaagtagaactagggaaaccaatatggatacaatccgagtaatccttatcgtttccatggagaactctggttgtctttccttatccataactctctcgaggtcagtttccgtataagacatggtatgtggtggatcctgccgagatttagtcaactactattaggtatgtggtatccataaccctgacagtagcccccgacttcgatgcaaatgaacgaattcatattctcaaccgcgcgcagacattggagtaactgttatcgagctcatgtgacatttctcggtgagtttagagataacgttggacttcctttgtcagccttgtgcgggcaccgaaagggtttgtctaagtcaatctctgatgtcgaccgagaaagtacagagcatacgactaagtttcccgtcttgctgtaatcgagaatttggattgaagtcaagaaattttatctcggcgggtacaccatctcttcattccgtattccttgtcgagatccagcaaccgttctcgagcgatcgagaaggcgtagagtctgcgacggaactttgtcaatatttgtcatactcgccttagtcgatcttggtgtagaaccatagagacatgcgatcttcgataatgtcaaatagaattttcctgaaatcaatactcagaaaagaatattagacagaaatagcccccgagcgaacgctctaagggtgacatgttataatatgtatggtaaattgaaaatgaattaaatttaccgaccaatattttgagtatgagcgtcttctctcttaccgacttcgatcagtcagtttgtagagtcatacactctccctagcccccagccttgtcgtcggagaatcgttcttggaggataaggctcttggacccttgacctgctgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcggtacagcgggaacaccactccacaggcatcctcgacggcacggacgaagcctactcctcggggaaaccttcatctgacacatacccgtcctctggggttgggaaaagtagagcaagactgattactacccactgtactcagcaagtcataccggaataggggtatgatgcagggaattaacaaagaagagctagagtggttcatttgcataaatactagcatttataaacaggaattgaatgcgaaaacagttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccggcatgccaccacgacataccggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgagtgcgaccagcaaaaccatgcacccacagcccaccatgtgattcattttaattaaccaacaccagagcggtggtactaatccaacattaccattagaattaacagtctaaacattaatatgattttccccattgtgaactagttgaactaagcatggctaagcaattcctagtccaaactctaatcatgttataaccccaagctaacaaaggagcatggtatcaaaatagtatggctgtaacaataggtaaccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgcgcaatattaaccagggctgacgtcagcacgggggagtgcggcgccgacaagcggggcccaccggtcagcggcacggggaggagagagggcgccgacacgcgggacctacaggtcagcgacccggggaaaaggatggggcggcggcgccacgtggcggccggaccgacggccccgatctacccaagggtaaatcggacggcggcgggagctcgcggtcgggatgcgcgggcacggcgcaagccgaaccggcgaccatggcaccggcggcgcggcgctcacg

SEQ ID NO: 9426 - DNA, 13722 bp, Oryza sativa
tctcctgatttcacctgcattttcttagggtcatttgcaaattaccattttgacttgggaggaaaacttcggggtgtgacacctgccttggttgaacaagcactgatcctagcccccagctgtgaagttggaaaactcaatttccgatcacacggcttggttaatacgcacggcgagaactcttacacgaccaggtcttacatggtcttttgtctctacaggatccgacaaggccttatcggctctgggtgtccccagccgaagttcccttaggttcctcggaggccttgtcaagacggcgtaaaaggacaataggataggtttcaacgctaggtgtcgtcgtggtaagggatctctgggtaaaacacttggcgatattgtatacctgctatcaactttgttgaaatagaggtaataggagattcgctacaccgctggtcgaggaccaggcagtagtcgtaactcgaccacttaaagtggaagtagtgggagagacgctacatcgctggtcgaggaccaggcagtagtcgtaactcgaccacttaaagtggaagtagtgggagagacgctacatcgctggtcgaggaccaggcagtagtcgtaactcgaccacttaaggtggaagtagtgggagacacgctacatcgctggtcgaggaccaggcagtagtcgtaactcaaccacttaaggtggaagtagtgggagaaacgctacatcgctggtcgaggaccaggcagtagtcgtaactcgaccacttaacgtggaagtagtgggagaaacgctacatcgttggtcgaggaccaggcagtagtcgtaactcgaccacttaaagtgaggcgagagagatcactgcgtcttactggttcgagaaccaggagtaggagtctcttaatcacctataggggcgctaaagttggtttattacatgtgcatatcatgtggccagcatgactctcacacacaacttgtagcatatccggatgtccgttcgcaatcatgtcgggtgatcaagccgacggcgttcgcgaggaattatccgttaacaaccttttctcgagtaatccagcgatggccggtgctatgagataggttgtcggtcttcgttggtaggttgggcgcgacgattctgcatttgtcgagatcgttctcgataatgcggtgtactcgaccacgacctactcgagtgctcaattattcctgaaaaatattttctagaaggcaggatatatagcagagaatatcgagtatgtattcgaaaaactgcatggatcttctagaattatcaggatataatgagcagatgtaaatatcaggcattatgtaaaccgtaaacaagcatgatttatacagaagataacagacagcgtcagaccgtagtcgatttaacatcggaaacactcgcataattgatattgtataaaaattgatattgtataacagacagcgtcagaccgtgcttatccctgaagtcgatatccggcggcgtgtcttggcatatgtaggcttctatgttgtggcttctatgtcgattgtgttgggtgttgatcccttcatggtggatgtctgtccccctgtcctcctaggggggcttgtatttatacccataggtgtccccttgtccaagtagaactagggaaaccaatatggatataattcgagtagtacttgtcgtttccatgtagaactctggttgtctttccttatctggaactccttcgaggtcagtttccgtataagacatggtatgtggtggatcctgccgagatttagtcaactactattaggtatgtattaggtatgtggtatccataaccctgacaaaatgtggggaaaaactaattgcgcagtttgcatgtaaattgcgagacgaatcttttgagcctaattacgccatgatctgacaatgtgatgctactgtaaacatttgctaatgacggattaattaggtttaataaattcgcctcgcagtttacaggcggaatctataatttgttttattattagtctacgtttaatacttcaaacatgtgtccgtatacttaaaaactttacacccaaataactaaacacacccttaaaacaaattttatatatttattttaagaaaacacaccgtttatatagcggtagaagcttggaaaagtgtccaaaccaacaaccacttgtaaggaactgtaatattttttttttggaaaaaagtttatatgattgtgaaattagagggatatttaacttttcgtcacttttaagatgtggcaattaattatctgccactcgctgtctataacatgtgagccctcacgtatctatgacatatgggtccagtggcaaatcatttatcatcactcctaagagtgacaaatcttatataccgattgtagggcccgaaaccagtaacacctggccacgtgtctccttggcactccttttgcaccgtttgattaagtatcgacggctaaagttcgttgcggtggacctcatcgtaaaactacggagttactgtattttttatttgcagaattgctcgaccctaatccactggctcctccgccacccgcgcgttgcggccgaccacccgcttcatgttctccctcaacggcgttgggctcgtcttcttcacattcgcctggccacctcgccctcccctgtgcttcccgccgccatgctgccgcccttcctcaacgcttctatctcaccgacaggagtcaccctcgagaacgcccgtgccaatacagacttgccagatccattgaacccggggagaaagaagagggacggcactggccatcggcccggatcaggagaagggaggggcgctaactagcggaggaggagaggaggcggcgtgtgcgagtgagtggtggcctgccggatcctccgccacctgcgcgtcacggccgatgacgccgcggcgaaccaccctctcgtgtcctttatttatactccttccatttagaacaccaaagaactggttaaaattacctgcaattggtgctaaattaaggcacgtgttgagatattttcagcaaagaaaatcaagcagtgtcttccctaggatcattggttctctttagatctttcgttgaacttgtagagaggaaaatacccaagtaggatgcatgcatgcatgcctgcaggcgagtaccaaaatcaccgagcctatactaagggatactggatggtgatgcaaatgagcaaaagaggcagagagtaagtgaatggacgcaagcaacgctagctgtatcgcacaactcacactcactggtgctttgtccagcaccaaagctcactactagatttttgcgccgataatcacatcggcttgggaatatgggagttgtcttccggatgcggagggcgaaggtatcgtgggctgcggatccggccgctggcccgagaagcaggagggattgcaggaggtgggggacagggagcgcatcacagacttctctttactgatgttgccggcgcaacttcaatcttacaaacacaggcgccttcgagcttcatgcaaagaaggctatagactgaaggccgttgtagtagcgacacggcggcaccgcggtgaagacggagacaccgaggtcgagcgaggagcagattgatgagtggagagcagcggaggagtcgagactcaagagtggggactgcggactgggaaggacaataataaaaaaaagccaggcctctttgcaatcttttattcaggatagaatgaactagcaaatgagattactgtgttcgaatctgacgaagatttagattaaatgcggacatgcaaaacgagataactattagcatataattaattaagttttaattattacaaacttgaaaaattgatatatttgatattttaaagcaacttccacatagattttttattacatgaaacacaccgatgtttgaaaagtgtactaacgaaaattaaggtaaaattttgggaaaagaatgctaccgacatcttttgctcccgcttgatgcaaacgttatgctccttgagtaccaaattttcaaacaaataatcaattcattagtttcctttactgtgtaacttgaactttttaatgttatgcacttagaacgttatatttaaggaataagaagataaaattattttttttgaaaaaaggatttcctcgattcttatacacatgtggaacatgtggagggaaaataagtagtttcattacattggttggttggaatttagaatttgtacgcacatattcgtcttccaacttatgtccatcatctcaatgtcttgctgctttcaattaatatatgaataaaagggtaaatttccataatttcaagcattaaatagatagagaaaatagatgtacttataagaccactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgttgaaatatttggtatttttaagtaggtatgtgtataattaaataaatttacaagtaaagcaagtgtgagaaataaaatgacatggttaaatttaattttttttaaattctccatgattagttacgctctttgaaattatatttgaatttttcagagcttaattgttaattttattaatacaaacgtcatttaacaattatttacttggaaaaagaaagaaaatccttccttttaggtttgcttcgaaataaacacattcaataacttataattgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccaggccacaacctgggcttgggccagaaaagtggcctcactctcgatccctcttgggctgatttcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacggcgcctctcttcccgcgagcggcggcggcggcgccctcccccacaaccaacggcgcggcgccctctccccgaacaacggcggtgtggaggcggctgcggcccggcgggagtgggaggggcggcaggccggacctcgcctccgccagatctggcggcatggaagcggctgtggtccggcgagggcaggagaggcggcggcgtcgtctctttctctctctctgtgcatggtggggaggtgcggcagtggtggtggtggcggacgtcatggaacgccggtcgggcctcgcctccgccagatccggcggtgtggaggcagctgcagcccggcgggggtgggaggggcggcgggccggacctcgcctccgccagattcggcggcatggaggcggctgcggtccgacgggggcgggagaggtggcggcatcgtctctttctctctctctgtgaatggtgtcggttctcctggtgatgctaaccgaataggacttggtataacagatggaagtttgtttcctatttttatggaatcggacatattctttttttttcccgatttttcttttaccgcgttgatgaatcggattcgttccggttttttttcacccggtttttttgacggacgatggaagcacctcttattttttaagtagtagtagatagatattatttattcctcccatttcatattgattagttttttcacaaaaaaaaacttaagtaagtggtggtgaagaataaggaaacatgcacacttttaactcccccccccccaacaagaaaagagagctttactacctcaaatacctatatgcatgcatgcaaacccaattttcatgcttagatgtagtaactacaccaacattacataataatcaacttgaaatttttgattttagtcaattgatgatcaatatataacggatggaatatttcatattggctggtgcattgtgcggcaaggccgcatctattttctagtaattaattattccaaaattagagatacaataaaacgctttatccaaacggcgtcggtgacgccaacgacactggttggagttggacacgccgaccccacacgcagcgacacacaaacggcggggattacttcgccgttaaggcgtacactaaaccaaaccgcgtggtcgactggtcgtctcctcctcgaatcaaatcaaacggaaccgaatcccatctccccaataataaaaatccccaattcgcgtctcgtctcctcgcaaatacgacgcgttcccaaatcccccaatccgatctgcctttcctcttcctcctcgtcaaaccctagccaaatccacgatcggggctagctcgtcggcggcggcgatggggaacccggagaagctgatgacccagatcttcgacctcaagttcacctccaagtcgctgcagcggcaggcgcgcaagtgcgagaaggaggagaaggagcagaagctcaaggtgaagaaggcgatcgagaaggggaacatggacggcgcgcggatctacgccgagaacgccatccgcaagcgcaccgagcacatgaactacctccgcctcgcctcccgcctcgacgccgtcgtcgcgcgcctcgacacccaggcgaagatgcaggtcatcggcaagtccatggccaacatcgtcaagtcgctcgactccgcgctcgccacggggaacctgcagaagatgtccgagaccatggacaacttcgagcgccagttcgtcaacatggaggtccaggccgagttcatggagggcgccatggccggctccacctcgctctccacgcccgagaccgaggtcaacagcctcatgcagcaagtcgccgacgactacggccttgaggtctccgttgggttgccgcaggccgccgctcacgccataccagctgccaaggagaaggagaaggctgttgatgaagacgacctctcccgccgcctggctgagcttaaggcccgcggctgagggatttcacttcaggtgataaacatagccacccctagcatcatacatgaatacttaccttctgttgcacttgtgaaatattgttttagtttttatcaatttgatggagaatgtgaaggtggttatgtggtgtgtatctagtatctacaagaccacgctgtttccttgagttatactcctactttggcctttctgaatgcagctgcgcaccgaaaaataatggctatgctgctatggtttaagatttgtggaaacataagactaaccatacctcacatcttacctgtcaaatggcgagggttactgaggtgttgcatattcatgtcatgctccctgtgctgaagacatcgtcattgcataacatggatgccaataaaacaatgagtcatgctgttatcactgacctaacaatcaggccattcggctacctgggctgtggctgcggctgctgctgcccgctgtttccttgctgcttgcagcactgttgctgttgtctgtggcgcagatgcagcccaggcagccaaacagccttaatttcaccaatggaaatttctgtgtattccaatatcaaatagcatcatacatgcggcaaatcatctcttctgttggctgattacttgggaggtatgtagtgttgtgaattgtgataggacataaaatgactttcaggatttttaacagctaacatgcggtagtcctatattatgacttactacggaattgatattttgataatgatttactcttcttgtactacctaaaaagtgaggaggatagcaaataacaaggataatattattctgctttaacttaggagcacccttaacagcatgtatgaagtgagaccagtgatcattggtgtgctcagatgatatcatgataacacctattcattttgtgtaaattgtattgttttacctgctgaaacataaaagttgtctttttactcttgaatgttcagcatgttttggatgtaaaattatgtttaaactctctgggctagctattagattaaaaggtttttggtgtttttatgttgccttctcaattgtatatttgacagttaaatcagtacgcaagcagttttctgcaccttacatgccaggaagccactcacagaatattggtagtacaaaatgtttatttaatcctactatcagtttgtttatttaatcctactcacagaatgttcatttgttaatgtaagtagcacaagctcttcaccgaatatataaagtaacatttttcatgatgtattttttatgttgagttcctcagtgatgaaatctcatctccatttatttgtaatttgattactattgttacccttgtttgtgttgaaagggctggctttcataacatcctgctgtggtgccctttgtagttgtgtcgaccttccctttatgtgaaacaccacccccttagtgctacatcttggagtgactgcattttctggtgattttacttccaaacaccatataaggctcaacccaaccacaccaaaatattggtaatggcaaagcttttataggctcatttggtctgttgcaaaaattcacaatgccaatactttgggaaggctagacaaaaggttaaagtatctttgccaaaaaaaatttggcatcaaaccatcttaccaaaattttgacaaggaggttaacaatggctacaagccctaacacttggacgaacgttactaaaactttgttgcatttatcaggacatagtgaactttgttgcatttatcgagacagtgtgtatagagtgacttgcacgcataccttttctctatgcgatgcagtctttcaaggccaatttgtattttcatgcaaaatcatagaagggtatacaaatgtcttcaaactttactgtatcgcattttcacatgcttgctaacttaaagcgtaaatgcacgccacaaatttgagttcactaaatgcattctttaatgcatgcatattacatattcactgcactttccatatatgggaaatggcctatgcctatatgcattgattcattaaacctttttccccgttaactaacttccaccgtatctcattttgcagatatgattctcaagctgctatgagccattgtcacgtcaaaggctactcatatttgttagattcgtaaatactgttatgctaaaatgcgtgtgttgatatcccatatgggatctgtggacttcattaaaaccttgctgtgtgatacaaatccataatatgtgagcttgagaacgtctctgtgtcgctgtatcctaagcctgcccgtttgaacagaaatgttgaagttgtccatcttttcacgggatgttttccttgctttaatgccatgaacaaattcggtagccgccccattatttgtgaggaactttgccttgcctgatggctgctggtatctgctaaccagtgtcctgtgatggcctttgtgctttttctcttcactttaaagactccaagtctccaacgcagttggtgatcacctcgttttaaatctggactgcatggggctttgatgatgcatgctaaccaggcatcaggcatgcatgttggattgttgggacagaaaaaacaagtgcactaaaacatcacaatcacaatccttttagccatgtaacaactgttattaaatcccaaggaacgaggaacataggaaaactacagaggaagctgtttggatggagcacatgacaaacacaggatttggaagaggtggacaaaggaaaaattccaggaggttttggagcccatactataaatcctctaaaattcacatgaaacatgctattccataggatataaatcctctaaaatttacaagcagcaattccatacgaatttcaaagaaattttaaagatctaatcctctattccaaagggtatcataggaaattttttcattgaattcaaattctttgaaattcctctgttttccctttctttcaagggaatagaaaacaacgtaggattagctcctttcaaacacaggatttggaaaaaaaaaactactaacagaatatcttgctctgttgaaacttagaggaatctaagacacaagggaaaacatgaagctatacttcttacaagctttcctccaaatttcccatgaatgaaatgagtcattcaatgggagtttcaaaggattttgcgtatgcttatcctttgttacagaggatcaagtatgattattttccataagattttaacactttagatttcctctattttttttctttgttccaaaggaatccttagaatgtcatatgctaccgaatcccacaagaatatgagaatcatacataggaatttggttgatttccataaaaacatataaattcggaaggatttctgaacattcaacattattttttcactagctggcgtaggatagaatctaaattttgtgttcaggacaaccatgtgttccaaacaacatttcatacaaaattcatttgctttctacttgtaatactattagcatatgtataggaatttggtgagctcaaatccctttttcaaatggcatgtataaaaaaaattccaaggaattgcaatcctctattttcttttttctatgagaatcttgtacttccaagtccaaagagacctcaagtcacgaactggacacttctcctgctatccgcaaaaacagaaagaagtttttcttttttaaccaaaaaaaaaaagattttgtgcacggactagctagctggaaaaacagaacgaagtttttatttttctaagaaaaataaaaaagtggtggtccgttggagtaggatgcgagacccaagcgggccagcagtgcggcggcccgttatccttccaccgttggaagcgggcagtattcgctgctctgtgaaaccagcctcacgccatgcctgccactctaggaaccgtggggccccagagctttcgcacaagccccgccggcccactactcaacttggaacgggcgagccatctgtagcaatgccgacccaggcccgcagccgtaccgcaacgtccacaccaccttaatgcccccgctcgggttacaagctcgcgctgctgagctcggcgacagcaaggggcgcaatccggctatttatgctgcgatgtgtggagctagttttccgaggtgggactaaatgaggtggaacgggagatccccgcgtgcacagtggctttttgtgttttctatttgaaaagtgctctcgggcccaatggctaggtttggtatgaaagatggtgtagcaacattccagcccagtttatatagtgaacagaagtaccctccctagccagataagtcctctacgctgggaaaattcggatgaatcatgcatggtccgcattgataaagaccatatttggcacattttttttcccattctccatcgaagaaaaaaattgttaaacgcaatagtatgtaaactggtttgtaattaaactaacagatactgagaatgaattcagaaatagatcagttgtctcgcgctagctttgtctatacactgtggattctacacaaacagaaattttgttagacattgcgaggattgtgcaacctttactgcttacagtgttgatatcttagtctttacatagagcacatcccctttcagttttcttttaaagaaaagacttgttagctagtattttatcctcaagctttgcagcaaaatcgaccatatatgttaaccaaatcatacgtgcaccatctttgttcccatgtagaattaaagttgtggttgtaattctgctcaatcgttttgacatagtctactctcgggcctctcggctcctgtgtccatatgacttattacactgtaattaatcaaacatgtgttcttgtgcctcaccaaacatagattaattagtgaagacaaaatacgtgtacaaaaacaaacagaatatatatatacacaaagatttgagagcgtatgtcgttggcgagcaagtggcacaaggtgacatgacacgcctgcctatgcaatgaataaagtttgtccttgtcaactagagctatatagcatcgtgtaccgcacaaattactgtgatgggcaaatgccaggcagctgggtcatgacaaaagaacacctcacacctactccatctctgaacgatttctgcggcctagccaagacagaggagagcacatggactgcagcacatgcccaaaatctattatcaggaagagagctgatattttttttttagagcaactcatgcaagcatagacttctaagcaaacatccaaatacattacagctcagtagcaggatatggattaatttagggaccataaatatatacaatatttttttagctagtttaatttctagctactaagacatatcttggatgcttatccaatccctcaattagagatggtaaattaaatgcaagactagcaagctaggagtagctagagtgattcataagattaattcctcgcaaacacaagactaagacaatgaagtcactacctatgctgattgcattgtgtggaagatttggtgtgaaagaaacaaaagtgctttcagaaataaagaaactccaatgcaacagctaatggttaaaatcatagataaaattaatctaggtgtgaggtatatatatatatgtatggcgccaaagatatcgcaagaatattataccttagttcatatctagtgcctatgcaaagatataaatgtatttttgttgtttttattcctttcttctttgcgccgttagtgaatatgtaaatatactcaattcctatttaatataacagcagcaagtctggcttcgtttttatttaaaaaaaatgctcgcaaaaagaataaaaggagtaattaacctcaagaaataaattgggggatgttaaatttcacatgcatgtacacacagcgggcagccagactgtaccacaggtaaataatccacgtgatgaactatgtggtctccaaacaaagtggtgaaatactgtttaaaaaatgttgtaaactgaagttaaaactgaacaagagttccctctaaaaaaaagagttaccttgagagaaccacatgtacccaatcagcgcgagagcacgcccacggcgccttcacggaaaactgcgcccatagattggcgatatgtgcagttagtagagctaagctagcatggggtagcctgaacaaggcgacaataccgcgcggtttgcagagaggctttttttttttttttttggagaagcaaaaattggcaggaggataggccgccgcggcgcggctctgctgccggtagataatgaggtgaagaagagagagaataagccatccctcatagcaggtacaatagtatactattagctagctataaacatattttaataagataaaagatgatagagaagaacaacgggctacagatctgtagccagctgcagcacggactccaagacacaatatgtatatgacatgtgggaccatatattaaaagtataataagcaactattgtatgaattagctattagattggctacggatgaattgaagctagtagtatgctatactattaaacttgctcttatacaaggggcaagctctacacaatctccaagaaaagtgaaaaatgatgtgagagtaaactaatatt

SEQ ID NO: 9427 - DNA, 71375 bp, Oryza sativa
atatctgtcgggtctcaacatcgatcactgatcgatcgacaagggtagcacgttgtttggatatgatggtaagatggtgtcgcgcggtggcgggcgagagactggatggtagacttggacagatctctccacacgcatctcacgttgagaattttgattggtatttctttgaggactgaaagttgattattgaaaaagaatatattgagttgagtgatagtgtatggtgttacatccatataggaaaagaaatgttttgatttcttaagaatatgggcatgttcagattgtagccaataccaaaattttgctaggatttcttccatatttaccaaatttttggcaacaaactaaacgtatattattttggcaactttataaaaaaaatggtatggttgaaaatgacatcaatatgaacaagccctatgtctcctcgtccgttaaatggttatgaaaaattcttaaaatatgacgacattcatatatgaggcgaaggtttatggcggaggtaggcgagctagaggcgaaggatgttcttttttggtggagtgatagacgatgccattatactctacaatgacatttttttaaagaaaattacaaccatttttggtggtcgaacagtacgtatagtacgttgggacttggcagacttgctggctgttgagtacagagacctgtcggtatggtcgaacagtacatctgccacatgcatgcataatgcattgcactccgttgcgatgctcgatcgatcgatcgccggctcgtgactgctagctagtctgtgggcgctgcggcgcacgccgactgacgcagcgggcgacccattgtcgatcggttcttgcgaggtatagtactccatgatagtacacgtactgtactttcgccctgcatcgtcgtgcgccggatgcagtgaagcatgcgcacaagaacggccgaagaaacaacaccgacgatcgatggtgcatgcatcaccatcaccatcgtcagttcatcacgcgatacatgcagatcacctagacgtactagtaatagtatcgtcctatatacgtatttgtcttctggcttccactagtaagaaatgattttttttcagatgacccataaggggttttcgcgtgcgacatggctggctacccgcactgctgcacatactaaagggtctacgaaaatcgcaattttacgtgcatccgcacacgaaaatcgaattttcgagtgcgggcgcttaagtttttctcacgaaaatggaaaatcgaaaaaaaaaattccaaaacacaaaaacctaaccctaaccctagccggtcgctgccaccatcgtcgccggtggatccgcacctcccgtcgtcgctgccagcggatccgcgcatgtggaggccggatcccgcgcctgccgccggatacgggcgggggagagctgccgctggccttccgctcgagcccgtcaccagatgagcgcgtgggatggcaggggagagccgccgctggcctcccactcaagcccgccgccagatccgcgcgggagggccaagggagccgccgccttcgccgttgaccgcgccacctgccgcccgtcgcatggccgccaaaggcggatctgaccgccaccgagccctccgccgccggccgagccctccgcctgccgtcgtccgggcccactgcctaccgcgagaggagagtgagagaggagagcaacgcatagtgagattgtgcgaagaagaggtgagaaagtgacagagaggagatgagaggatatggatgaaaatatttgaagtgttgagaaggaaagataagggaacctaggctttatgcggatccttaagagacccgtatgcgaaaatcacggccccttaagaggtccgcctacaaaaatagacttatttttttagtgcggaccattaagaggtccgcatgcgaaaatcgatttttgtgtgtggtccttttaagggtctgcacgcgaaaataggaggataatttttataaacacgaccagttacggttcgtctgcaatctaaagaggtccttgtacagaaaaatagttttttactagataaataacccgtcgcgttgctgcggaaaattaggttgcataatatgtacaaataagatgtaatttgattatcaaaactaaacaattttatataattttgagcctaaaaataattgagattgcatgtttgtaagagagaagaaaaaagagacaatttggaccatagatctatcatccaaaggctagaaataattgaggtgatatggcttaataagagaagagagaaatagcattaactatacttagtggggataactatataagtatataggattccacccaaaaacccaattagcatgttgatcgagttgctacgtcccaattgagtgtgatcatgatgttctttaggcaaatcatacaaaaccagtaactacgtactcaatctgtttttacaatacaatcatttttaggttgtttactaaaaacattaagattaagagagagattcctttcccgttgtctcaatggtgaaattttgattattagatatcaatccgtaaacaactgaaaaatatatagattttcgtgcattaaaatcaatatttgtataaattttaaattctaaattaaaattcatttactttggaacaaaaggaatggtagtaagggcttttacaatgcatatagatgtcattcaacatcaacttgccacataaaagatttcacgtcattcaacatcaacttgccacataaaagatttcacatcacatctgcttctcccattaccaagtgaagaatggaaatcccaaatgagacacgagttccttattaatattcatgagggatttttcagggagggggagaggaacagcgagcgttgtacgttgggagaagtgttgccccatgcgatgccctcataacccgttggagccagcgacgatgagctgattcgaggtggtggcggtcgtcccgagttgctccactcgtggttgtcactgatcgaggcaagcccaatgcctgatctagcgagctcgacgaggcagcgacgatagcctagtgagagacgtgcgcgggtgaggagaagggaagatggaaatggtggacgaagaggaggcggcggatctagcgtttaggacctcattgttgtccccattccgtactgtcaagctcgttgttgcccctcgaaccaaccgatgttatcgtcgtgatcgacctatgaagaagcagctcgacgacgaccgcctcgacctgtccgtagccgctccgtcggagctgccttgacctcctcgtcgcttcttttcgtcgtcgtgtcaatctcctcgatgttcacccggttcaaggcgatggcactagggagctcgttgttggagatgggggagggacatcaacagcaattttaggaaaggaaaaagcgactatacctcccactctctgccgctgagctcatagtagtccacccttcccacatcaccgagctcgtcgacgcgccgattagagtaggagagccaccgaacagtcgtgggccatgggaggacgagataagagctgagatgcggtcactgccgtgggaggagtcgaggagagaatcgagagagtgacggaagaggggaaagaggggattttattttttttctagattctggtattcattgttaaattgtgtacttccacacaaattgaaataaatatgagagctagaatagatagtagcaaggtctgaaataaaaaaaacaatgccattcctagagccacttacattataaaaagaataattttagacttatgaccctagctagacttcgtggtacagacgtacagtactccaaggctcaaatgaagatcctgcactgtgagtgacggtcactcacgttgccacacacacatgcataatttccgagctactagcactctagcagctgcaaaccctagagttcacgggccacaacggcgagctcgccactctatataaccacaccgccataaaccctagatcgatcgcacaaacacttctagctcctcttcttctcccccccccccccccccccttctcaccacaacctgctagcaagctcagagctagcagcagccatggcgggcagcaccaagctgcggccattcctcctgacgctgctcctcctcctctccaccaccgtggcttccatcctcgcggagtacgacccggaatgcgactgcgacaagcccaagcaccccaagccctcgcacccttctccctctcccggccaccccaagggccccaagaaccctacccctcgcccccccaagggccccacctacccgtctccggtcacccgcccgccgccgctcgtcgcccctcccaaggtccccgtcacccacccgccgaagggccccgtcacccgtccgccgccggtcacctaccccacacctccggtcaccacccccccggtcgtcgtcggcccgccggtcacctaccccacacctccggtcaccacccctccggtcgtcgtcggccctccggtcacctacccgacgccgccggtgacatacccgacgccgccggtgacgtacccgacgccgccgacgacgacgccgtgcccgccgccgccgccggcgacgcagaggtgcccggtggactcgctgaagatcggggcgtgcgtggacctgctgggggggctggtgcacgtggggatcggcgacccggtggtgaacaagtgctgcccgctgctggaggggctcgtggagctggaggccgccgtgtgcctctgcaccaccatcaggctcaagctcctcaacatcaacatctacctgcccctcgcgctccagctcctcctcacctgcggcaagaaccctccccccggctacacctgctccatctagttcagccgccattcccctgcctcgccatggatggcgcccaagctcaagctcttgtttgtaagtgtgttactctcttctcccatcgcaaataagcgtcagaaataattttgctatgtgtatctacttgtggatttagaggcaggatttctatccattatttaataaaaaacgtcagaaataattactctctctcgaaaaaaaacagataacttttatacgtgaatcttgaaatggcaaagggtatgtctagattcgtgtgtaaaagtttttttttttgagagaggaggtatatatgttgtctttgatttgatactgatatagtgtgtttttttgatggaatatgcaggttggctactcgatctcggcttattgatgtgttaatgatgagtacgaggtgtattaatttattgttggttttaatttgttagtgtgtggaaacatgagaggatgtcgtctgctagctagctagaggaacggatcaatctgctaacgatagattgatgttcgtattgctgtgttttttttttaatttgtttcaatgtttcagcttaattgcatgcttcctcttcttgattgtgtggtgtgatcaataagacagcaactgttcagaaattgtttccgtcaagatcgtatcctatcaagaaattaattaataatgcctgcagcctgacttaagcgtgtaatcctacatacttccatgtgcggacagtgcatgcaatctgatgtaataatgtgtcggatctaagcataatatgtctgagattaatttaattaacctgttttcttcagacagatttatttgtggttgattttggcactgatattgggagagaacacacgtactccctccgtcccattttaaacgtaactatagatttccgtatctaactttaatcgtcggtcttatttgagaaaatctaaaatctttaaaaaaattaaaaaaaacataagtcacttatagagtactattcatgttttatcatctaataacaacaaaaaatactaattataaaaaaaattttaaataagatggacgatcaaaattgaactcgaaaacttacggttgtgtttaaaatgaaacggacgagtatcactcatagaatagttgtcggagctactccctccgtaaaaaaaacaatcatgagtttaaacctgaacacaatgagttgggttcaggtttaaactcaagattaggttgtgtccagttttaaatttaaaattggggttttttttttctttggaacggaaggagtagctaggagagctagctagcccttggatcgaaaaaatctcacatgcatgacattgtgagctgtgacatattactagcaaggagatctagtatagtcaagtacggtcggatagcgagagaaaactatactgtagagaatactttgacgactgcataggagccggaatgctcgatcgatattctgcattctctggagggtaaccgagaggcatgattggtgcaaaagtgagggcaaagcatgtgcagactccgttggcagtatgccgcccgtgagcgaatactgagcagtaactgagttgatgtgatggacatgtaaccccgtgtcatttgttgtcttctgtttgtagtagctctgggctgtgcatgaaacacggcaaatgggcaatggccatatgtgatcttaccttggattttatactgaacagactttgaaaaggctgctcgtgagtgtactggccaatatataaagatagccaactgtgtaaatacaagtggcttgaaatattttgcaactaaatttccatataaaatggtacttggttcttctcacatgatcactagtactcactagtgtgctgcttgcagaaaggcaaggatggaactgcacagttatgagtgcagacatgacacaagtgactaattgagttaaatctatggattactctctgtccccaagagactcaaatcttaagaatgatagacaagcatgtgtgtatacattcatccttacttcttccgtcttaaaaaaaaataaaaaaagataacctaggtggtggtttgacacgagcaacatagcctagatatgtcattgttcatgttgcacaggagaagcatatgttttgcccagtatggaacgattacaccttccaatttccaagagggcatctttgaataatctggtacagtagcgcacaagacacagagaaaagaactcactaatcaaggctacaaggatttcaccaatatggccatcggagagcatctaaagctaaagctatacacacaccaaaatgatctttgcgaacatcagcgagtctcttcatctcttgctatctttcttttaatttatttacctggcggggtttcgatgcggtccttgatgatcttctcaccggatctgccttctcgcccttgctactggtgctaactttgtttggttcagcagtctcaccatcatcttcactatagtcactacctggtttctccttgccaccaccatttttccttgtctttctggaaagggcacctatggcatctctcttttgctttcccctggcaaccctagaagttgctcctcgcttctttgtattcaaattatcagcatcttctggatctgtgtctatttccttcgcatcatcgttctctgccacttgttctgggttagcaatgactactttgctagattgcattccagtcagcttctgcagttgtggcacgtatgctgtagtctaaatagtgagagtacaaatcagagggtagatgcatgaatgttcgtagcactagaaagtgtagtagtactgaagcagataagagcttaccctgccaccagctgttatgaactcaattttctgtcctgcaagacatttaaagtagtgggtaataattaacatgttcgattatacaccatcatatatcagcaaaactacaagcgaacgctttgctcaattttattcaagacaataacgagttcatgataaaacttgaggacaatctcaccattgactttaccaggcttcttgccccatcggtgatggaataaccattccacaggaaagcagtcacaatcagcatcaacttcaacagcatatttcacaacctgaaatatgctttatttcaggcataagttctccgtgattgtacatcagtagaatacactaaaattatttaaaataatgtcaaattacacaacctcttggatgctttggtgtagtgcttcacaactctccctggatagacttgaagcaatctgtaatggatgggttctcgactgaaaaaacaacatgaattcataattaaaatttatgcatttcattcaagctctaataatatttgtattaatacctggtaaagcacctcatctgcaatccaattaccaattcctgatatgaagctctgttcaataaaaaaaaaatcaagtcttctgtttgtataggagatacaaggacctaatcccgtatattgtagaaacaattttgtggagctaaaaactcatattggttttatggtaataaaatcacctgatcgagtagaagagcttttattccaatcttctttctgctcagcgagtccgcaaaactgtcagaagacatcggctcaaagagagcatctggtcctaactcagaaatcgggggtacagtttcgggctgcaaatcgttatttgattagggacatcattagaaaataacatgaaaggaagactctgaagatttagattcaactagtcaaagcacatacatcttcaaacaaccgaactcttgcaaaccgcctcttatcagtgaaggaaaactctaagccatcatcaagctggaacaagttaaatgcattagaaacaaccaacattaaaagagccaacctatgatatcataaaaggacataaacaataagaggagatcaaattttgactaaacaacaatgcctaggcatgcattgcgtgttctattactattcaataaaccttatatagcagaagtaatattgacgtgtttatatgatagcatgttaaccctgagacatggcacgtcttcctttctggctttctggagatcacaaaagcactactgtttgtggcgatttgttcttccgcattttggattagctagtccgctagaggctcagccaaaacatgttttctgagctatatagcctaacaaatcgatcttgtgtccaagctaaacgatgacagttactacctatccatctctctctttataagacccaaccaaagtagtacagtacagtactgatgaacaacaattccatatccccttttgcttataaactgttaattttgatctcacatagcagcaatgtactgaaaaaagatgctgtgacagctaggagatcttacttgaacaaaaaatttggagtacttggagggccactcgtctgtagaactgacaactgatctgcaataattttctgaatcagcatgtagtccattactgtataacaaattccccagcatacaaattacacatgcctcttgtacttggtcacaggaactcccttaatgtagatcgcacctgccatccctgcaacacacacagcaatttgtcactccaatttactagtagcaaaaagcaatcgatcgaactgcaggaggaggaggcaggtactgaccgaactggaaggaggggaatggaggggcgtcgaggcggagccagaggttcttgcccctccgccgcgcggcgacgatggtccggccgaccatggcgcgctcgaacgccacgcgccccccggcggcggcgaccaccaccttggggtcatccgccaccgcgcagcgcgcgatcctcctccccacgcagtgcgcctccagcgccctcctcgccgcctccacctccggcagctccggcatcccctccccctccccctcccccaaaccccaaaccaaacctacctcctcccctgccccctcaagttcaccaccactaccattgatttgtgcagtaagtctatttggcctccctcaactcttgctatatattgaatctttgacccttaactataataccaggtataaggcctctccattttcaaaaaccggagtaaataaaagtacctcagctattttgatagcggtttcatcctacggacgctcataggactcacatattagccaggaaaaagataaaaatatcagctcacatgccaatcatcctaatctcatctctttttttctcacctatttctcctctccctctctctcacctgttctctgctattatggttgagggatgcaattcaatcaacagcaagagttaagggaggtcaaaaaacttatcccctttgctgagccgcgtgtactaggctgagccgctcgcgtggcccaacccaagcggcagcagaagcagcgcccgccgcagtgttgtggccttttttttgtttttgcctcgtttcgtttcgtcccgttcgcgtacgtgagcgcacgtaaatttcgcgcggcccaagcggaagaggcgccgcgcgcgcgcacggtgtagttcgcctccgcgtggccgccgctgggattttgcccgcgcgcgggccggtgcgcgcgatggaaatcgcggagattcacgggcctcgtctggttctctcgcgtaccacctggcttcttggctgcactgcacgcacccaccgcgtgtgtcgtcgtcgggtccaacaacggtagcgcgttcggggagagcagtagagagagagagagatggattgggttggcagtggtagggggcgcggcggctgggtcgctgagacggcaatatgatacgggacggagacgtgcagccaagcgaaggctggtcataaatgggcgtcggcgttgcgattagcgcgagacgtcgtcaagtcagtcggctgaggctcgggttgggtggggtgtggggtgtggacgactcacatcacaggtcggccatttatgaacccccacggcccgtaccctattcgattcgactattcaaaaatgatatcctcaaatcagaataatactactaacgctgaacaaacacgtgtggcgacgtgtattaaatacgtgtgtctaattgcattatgttgggttcttatgggcctgtttaattggtgaaataaaaatttttggttgtcatataggacgtttgaccagatgtcggaaggggttttcggacacgaatgaaaaaactaatttcattactcgcctggaaacaacgagacgaatcttttgagcctaatcatgtcgtcattagcacatgtgggttactgtagcacttatggttaatcatggactaattaggctcaaaagatttatctcgcgatttacatgcaaactgtacaattagtttttcttcttatctatatttaatgctccacacatgtgtccaaagattcgatgtgatgtttttgcgacaatttttagaaattaaacagggcctatgttcacaacttctccttccttgtttatccgcacgtatactttccaaacttctatgaacaatttattttttaagaaaattctataaaaaattgtttataaaaaatcatattagtttttttaaaaataactaatatattgaattaataatgcgttaatgtatacttcattttgcgtgtcggagagaacccctccaaaacaccctaaatgtttgatgatgggagtatgacgtacattaaatatgcgtgtctagttgtatacactctttttaaaggcaatataaatacagacgctataacacgtactccttgaacgcacatactcatatcttatgaacaccttcagaagagactgagccggcatatcttaaaattaacgaggtcattatatgtgtctcgctatttacgtatacgtcgtctatcacttaaaaagaataaccgtaaatatatgagtacccatgtaaaatctagaaactaaattcgagtgggctagttccgttataaggaatctaacagttaagggccaacagttaaaccatgtatacactctttaatacgcagaggccgcctgatagcattgattgtcatcacgccatggacgtcttaacgggattagtttttgatggaggaatggcaatcaacacatgtatacttttgttgccttatctctctctctcttcttaatttgttgcatcttacaacgaacgaataagcaacagttgcttcttgtatgtacaagtttcgacatcataacaatcaataaatccttgtcattaaccggacgacacggtaatatctcacacttgatgaccgactcctgcaagctaaacaaacttaaaaattttaaaaaaaaacctcacaaaaacaaaaccactcaaatcaattaattcgatcgtctaccgctgtatatatatgcttcttgtgtactctgctgtatcgaattatcatttggttcatcgatccatggagagaaatgttttcttgtgtgttcgatcgctagcttagctatggcgccgggcagcccatctcgtcgcgtgcctggatgaagacgatggcggcggcgtagtgcgcgagcgcgccggcgatgacgagcgcgtggaagatctggtggctgtggccgcacaggtcgaacatgccggggcgccaccgctccgggacgcgggtgaggtagaacgcggtgccggcgaggtaggacgccgccatggcgccctcgtacgccagcgtcacgttccggcggggctcgtgccagttgacggcgacggcgtgggcggcggggacgacgccggagaggcccatggcgacgaacagcagcgcgcggtgggcgcggtacctcgccgcgctcagcctgggcgacatgagcgcgtacacggtggccaccccggcggcggtgatcgccgacaggtacaccacctgccaccgcggctcgcactggaagatgtagtagatgggcgggaagaaggagacgacgatcatgacggcgatgccggtgtagtcgaggcggatgaggaacaggttgaggcggtgcgagtggcacgacaggaggtggcacgccgcgctgctcagcaggcagaacatggcgcccgcgaggaacacgaagaacggccgccgcgtcgtcgccgccgccgccgccgtcaccggccacgccgccgccatggcgccggcgctcgacgccgggctcgcctgcatgaacgacgccgcgccctggccaatgcatggacacacacgccaaactcgatcaaaccattgacgtgacaggacagctgatcggacaccgatcatcattgtagcatatcacatcgaagtataatatgtcattaaacatctgaaagcaatatactctccaaattaaagcatatgcattagaatttagaagactgggaacaccgaattattgcgacgacattcgtttcaacgcttgaatagaacatctaaccatattggtgtccgaactccgaacaaattcatcttccttatctaagaatttctatttggttaccaaacactgttctttggtcaagaacagttgggaagccatgacaagcaatgaatttagctagcaagtaattaattatgcaaaaaaatgaaggtttactatggttgcccaaaattgtctaccaactagtctcaatcacaaaaagagaggacaactgttaccatgtgaggatggaagaaggtttggtatgaaaacacaaagggaaggatcacacgcgataaactgctaccacgttcatgcaaatatcgccttgtatatgtgtccccaatgtttgccaattttagtgacccctaacctcttaacctcccaaaatcttcccctcaagtctcaaaatcttccctttggtggttgcatgatgtatcttgtcaatctagacatccaaggcacaaggatttcaagaagaaaagataacccgcggcgacactggagtcgtgtcgtagcgggtagacttgatcatcacaatcaccaagtcacaaccaagtcctatgaacacatcaccaaagcttaacatcttgtggtgaagtgaagtggccaacacttaatctaggatttgtcatgaatgggcaccagtaaaaggggacctaattgggcaaggttcatcaggtaaaggtgaaagcaatcagaagccccacccaacactttggcccagctgccatccaaaaagtccaaatcatgcacatctgaacaaacagaaggaaacaggacagtactgaaaagtggagccactcaaagctgcacaatgaatctcctaagcatgtggatctaaccagcccaataatattactgcaatccagtatttttttttcttatcagtaacttctacttctatcacaggaatgaatgatttcaggaaatagaagctttactcacagagaggacatctccaatgttactggagacattttcagcaacctttgagattggcctgcagtcaaatagaagtacaattctcagaaaaaaaaaaagggacagacagtgaacagaatattaagcatgcaaagcacatagacatctgaaataaaaactgcaacttgtcattttccaggttgtatggaattggagtgaatttgttggtgagatttaatttgtcgatacacaagcagctagatttatcgaaactctcatgctatcactcagcataatttgattaacaagaaacaagtaggatgtagaatcctattcagtgccttaaaacgttaaaatattcatctcacagctactgaaaaactaaactatttcgtgctactaattccaggacacattagccaagattttaaccaaacaaattccactgaggctttcacaaactcaccaggagaggtgtccgatgagatcagcaacctgggggaagtactggccaagatgcaggacggtgaggccgaagaacagcacgaacccaagaagatgcctgaacaaacaccaagaacgcccacacgatgagcagcaagaacacagcacacaaagctgaaccagaatcaaattcagaaaaattcaggttgaaatccatacgtccagatgttgatggtctcgttgtgccaggagaagaggctgaggagggcattgaggatgggccactcggagcggtagtagtcgaggatgaactcgttctccttcatgtagtccggcagctcgtggtagctcaccagcctgcactccttcctcttctcctccctcttctgctgcttcctcttcttcttgctccctcctcccttcgccggcgccggcgccgccgccggagcaagctcatcatggtaggcgctctccatggtggccatggctgcctcctctcccataacttcttggcctcttcaggggaaaggtttgtgcagtgcttggctggctagctgtggcacggggttaaaaagggaaagagcctaggacacaggagatggagcagctttcgcaaacaagccaagaaaatggtagctagagtgcagtgctatccaagtcagtttctttaattttcttctcaatgcagcatgcaatatcagcaaataatgccaataaatttgatgctacagcaatgaaatactgaaatggattttttttttgtagaaatggatattgatgagatgatgagatttgtaggtgcaaatggcgtgagattgcgtgtattttgggtgagattatacgctgcgagaacaatggagagggggggttttatttggtatgaggtggaagaggacaaatacaggtagagtaggaggacaaccacatcaatactgttgctaacagggcttggaaaaagatactactactacagtgatgtatttttcttctataaaagtccatgtcaaataccagtgaaatattgattaaatgcctttggacacctaactcaagaatttcgatgtgtctgcattattgctcagcatcaatattgttgaaatcattttttatatagcctgagggtattggtttatagttaacactcttaatagtggtatgtcatcttttacacagtttgacagcagtggtggatgccataatggcgtagccaacaataggttcaatgtaaaatatgtagtatatacgatgataacagagaagaggagaaaagagatggtgcggcagtgcataaaaagggagcataactaggtgtcaaaaaaagtctagcaagttcattatcactttcaccacacaacatatttacgcttacatgcatgtatgactatgtgcatctacgatgtagagagaataaagatataaaaccttttcattacaaaaatatgccccccccctaacattatatttgacgctacacacaaacttatgtcgatattatatgacgtcaaatattaatgataggaggcggtatattttctttcaccaaatagtatagcaagctcattatcactttaaccacaccacgtatttgcacttacatgaatatataattgtgtacattcacggtgtaaagagaccaaggatataacactctcattataaaagtatatttacgctcccttccgttgttatatccttcctccatctcatataaaaccaatggacatactaaaatgtgtcaatattagtactataggttggtttctttgggacggagggagtagtagagggttttttttttcttcaaattgacagcataaagaaagtgctttgaaatagaattaggtagctgttgtttgctccgggtccatttctgaagttttgacccgtctatgttgtaggtgtcagctggccatccatccctccgtcttcccacctgtcacaataaattcttcagcaatgggcactctcgcagtccagcaagaagctgcaggttaattttctctctgtggcgtgcaggcaaccgttgaaaattgaggctctgattgcttcattagagataatgaaagctttctgaattcaacttcagggaggttcagattcagattagttgggaagctcacaaccaacctgagctaacccaatcttgtactgtactcgtactggtatagaatggctgagtttcagactttcagtctgcagtccgagagagatgacttgtctgattggccgattcgtcgtagtacttcaccgttttttgcgccttatgaggaaacgtgcaggtttgcatggaatgattggtgagttagccatgaatgtggcactgaacaggaggggttaccaaagctgacgcaagagaattgctctcgttttattttcttaaatatatttttcagtcggtgtagttcgctggctttggtttgcaagcacatctcttcttcttctagcccatcttgcctagttgcatacttgaatgatttgcgttatagcttcaaaatattccttgaacgcaaattttgctataagacatctaaagtttgtataatttgttgatagatatagtaaaacatgtgccacggctgaagaatattcctaaatttggtagttcgcaacatttttgatccaaatgaagagagattcataaaacagatgagaatgcccccgcagcaacaagcttccatggtgttggaagataatttggaaattatgcaaccataaatcttccatcaaaccgaagtatgttccatcatcactccagcgtcagctgaagtatattccatcattgctccaacgtcaagttagaaacttttggctctaagggctttatcatctttttgaaatttttgtctcttcaattcggttgaaagtatcccctaacaaattaccagcttttcggagtgtcctctaaccttgacatttttttacgatgtccaccaaacaattacacaaattctgagtgtcttgtggcaaaatttgtcttcctaaaaaacaattattctctcttataataaatattttatgtttaggggcaatatttttttatatttctaacaattataatagtctttttcaaggaaaatctaagtataccaattttttttaaaaaagcacaagcatttaaaatttttatggaattttttaactggaaggagtatttcttctaaatgttgtgtaaatgtcagctagttgatatgaaggtgtcagcaaaaacatagcagttattttgaaactataagttctccatgtattaattggacagaaatctgcagtctgaccagaaaagaaaaaggcaattggggcaacccccattttaattttttgaagtctgacctctcgccgaccgaacaggaacctttttcgcagatttaaattaaattagccattacgcaaaaaagatgcgacattacgcaaaaaagatgtgactttgactagatattgttcaagatgagcagacgtatcacaatcccctgagagcaagtataatagtaggctacaagccggctaaatgctgaggtggaggagagaagagaggagagcgggctgtaaacttacagccgacttgacacaagaaccaagaaactctgtgagagagataagtttgccctgtattaactgtaaagagctaactattatatgggtaagctaagagaagactacacagaaccttatagctaacaggtcgactgtattactagcctttctgataagctgatacggatggccaaccataaaccgataaccaatacccaaaaccaatcgccccaactgtcctaaagttttctggcaacaagtataagttagcatcaacaataacaaactcttcttttagcaaaatcaaaacaaaattaagagcattaaaaattggttagttcacataaagatcaaatcttcaattaattggttagttcacataaagatcaaatcttcaatcttcgccttttggcttatcaactgtggctaaaatttaattttatagttgattttaagggtttttattataatttattttagcacaaatataaaagttttactcataaattattctttaattactgataagcattttacggtttatcagttgtatgcgaaacgatcagactttaaactaaagatggaagatagtgtgaaaagaagttgaagaaaacatggcttaattgttgcagctactacaccaaactacagctgcgttgagtacaactcacattgaccaatgatattaatcaggataaatataggcattttatacgaagtcggagttggcatctgcgttatagttgccacaataactacataaccaccagcaacatatggacatggaaatcaatgctataaacacaagacacgctgtttctcagtaaaaaagaagttagaaactgttatggcagataaacatcaactagatggtagtactaatctttgcccatccaaggacaaacaacaaaaatgcattgatctcaacaaaactttggatatatagaatgaaccatcgtgtcaaacaatacttacacgaaagctaggcagccctcctggagtaaacatagtaaagaagggctgccagggccatatggtccacccagcagtaaacacacaacataagcttccacttcaaaaaaagggaaattgcaagcttggccaagaattgtagtgattttggaagcttttcttgctgaattaatgcttccttaacatgtttttcattatcaacattgtaaccaatttcttttgtccgtattcctggatggaatcgatttttactccaaaattgccacataccaaaatctcaatgggatgagatttcggaatgctattcacagctcaaggaccacacacataaactacatgacttacatggcaaaatcggcatctccatcaagtatggaaatgctagtgtttgtttgctgtctttgtatcgtccactggttttcttcatatattaatgataaacagatgggggcttggtgtcactgtgcccgtatatccagttgtttcagagcagacctcatgtcatcagtgccataaccctcaattccaatgatgtttgggctatcaagtgcaacaacatcttgtaaaggataccgcctaacagaatggattctatttgcagatgtgttgaattcacccttaaggatgaccgtcttatgaagacctccaaacaattcttcgtaatctgaatcaccagtttcaccaacaagaaccaccacattttgcaactctatgccccagcgaacagataagtacctagaacagaattttgtcaacatggagagcacacatatatgctgctaggctaggtgcaaatgggaattgaatataaaaaactatttaacaagcccatgagcaaaaagttactactgttgcttgctaatttggtctaacagcatctcatacacattcctttttcctaaaagatactccctccgtcccaaaatataaggtactttgcttagatggaacatatcctagtaatatgaatatagacagactagaatgtgtcccatccagtcaaaataccttatattttgggaaggagggagtaggaagccatggaaacttgaatttcagtggtctgtaaaattggagttctcaaacaaagacttggaatatagtctttcctcacccaagaggccaagaaatatacctaatcttctatggaaaagtattgatcgtaacccacacaaaaaagatcagacaggcaaaactgccccacattttgagccaagttcagaaaaaatgttaaccacaacaatactggtacatcagaacatgttaagaacagaagagataaatgaatgaggaaaataagaaaatcaaacaaaccttagagccttagaccgtgatgcgtggattggaattacagatagtctggtagcaccatggttatacagagcgtgacaacggagtgactgaattctcatcaacttttgcagctcctttaaaggaggtaactacaattcataaacaaacaacaattaagaaaaaccttgcatctaacaagctataaaacaatatacctaaaccctttttagaaaaggatgcacttgagcagttcatagaatatataaagaaatacaattccaaccaaatatcatgaactctggaaggaaaaggcttacatgatttggattgaccactttaaatgcaagacagtatgttgaagagtgctctggatcttcgaagataacttgtttttcaatcctccctcttctttctaccacggaagaagcccacttcactagatatttccttaaaccttctcctccccaatgatactctatatgtgattggtaactacgatctaatgcaaatgtaacacgggagttgcttggtgtatcaccagtacatgaaggataatacaaatcacttccactattgcatatgaaagcatcgaaatcagtaggaagcatgccagcagacattaatagagaatgtatctcccctattgtcagggaagttgacaacacaaaacctgtcgatcctgacaaattttctttacgtgcagcctcgatagaatttctgacaatgcgaatcagatcttccttactgacagaatctacagcaataacagtgacatgcttccttcccttaataggtgccttaatccggtcttcattgcttgcaaaagcaggatgccttgggccaagagttgatatccttgacaagtaattcttgcaatgttcaggccaagaaaactgatgtatatttttcagcccattctctcggcattttgaccaaagttgtttttcagaaaggagtttatagagtgcatctgcaattgcatgctgatcatggggatcaacaaggagaccattgtccagcacctgcatacatccatggaaaagacatggtgatcttcatcccagctagtagttgataatactttcctaggtaaaaaatatctaagtttaacaaaggcacaataaatatgctcagatacctggtgaatttcaacaggagctccattttttgttgcaattacaggcaaaccatgcatggcagcctgctcacgaaaatagcagattggtgttaattagatacaaaattcagtaatggaagcaagctgaatttagatacaatgataatgacctctatcaaggtgacaccgaactgttcaaagtaaggcacatttacaaaagcaccctgcagatgttcaatggatgatcagcgtcaatataaccggtacaggaaattgctaaagaagtactgtaaatcctacaaacattacaaatctttgctataagattttgacttcaaagaaacagatactgaatccttcagccatttgaacaacttaatttattggtcacaagttttctacttcaagtgctagacattcaaagcaaagataagaatgccatcaccaatgaatatcttttgttcagacataacacacctttgttctcactgctaaacggtaaatatcaggaacttccgagtgtttgtgacgctttgggtatgccacttgaccatacaaatcatattcatcaatcaatgtaagtactgatgtcaaaacagctgcactcatattatgcatcttggaaatagcctcacggtttcccattatcaatgtctgcaacgcaacatcataagttagtactaattaaatataaggacgtttcagattaatagcagcaatcaaacttaatgcataataagtatgatattgaaattaagacatcaaaatgcagttttgtcttactagattagcaagctccctcagtggtcggcactcaccaaacgccttcacaagagtagtaatattcttttcaggataagggcgagcaactgccagaatcataggtttcctagggtttgtaaagaaccgcattatctgccacccatacaaattattagtgcataaagttaaaactgcaggataaacatgaataagcaaataaatgttctcaaatattaaatgtgcaaactactaagttttattctaaagaaaatattaggtgaactagtaggtgggatcttgcatgtatgaatctaaaaaagaaaagaaaaaatgacctcggaccaaatagatggatcttcagaggctggggatggaccgtcttcctcaccatccatatcgaagtcatgaatcatatggccaaattcaacacctgggggaatgatctgcagaacaaggaacagggaactaatgcacattaaacctctacagcagattataacagcaaattacccaattatgaaaataattgtgcagtagttaccattgactattttcggagtgaaaaaagaaaagattatgatgcataagtatactcacaaccatacgaggcatatagcgaccatagcagttagcaccacgcttgactcttgcacggagtttccttgcaagtatgacctcaaaaccgtcatacaaattccattgctcttctatctcttgcctagtgcttgctataactatttcagatgcatcaagagccaactcctctgcctcaattctacacattattttgtatgtcatgtttatttgctcccttgtctgtctcccttgcttgagaagctcttccaacttatctttcccaagaaaatgccctgtaaagaccatgggaacattaagtgctcctgacagtagagcagcagcaactcctgcactagcataatgaccatgaatcacagcaggccacgccggatgcccacagctgatttcttcacctatggcccttgacatcttcactatatgactgagggcgccatcaacaaattcttgaatgaaaggccagagatgttccttagctagatatttgtcttttggtccaaatggtattcggatgatatatgcaccactattctctcctctttcctgcttaaaattcttgaagcttgttgatgccaaaggttccactggttcaccatagctacgatcaaaatttggcgctaagatctgtcttgtaaaaagatcaacccggtaaactccaggacatgagctcaatgctttagcaagttccacaacatacttgacctatgcaatgacacaacagatgcataaagaattatttccatacagattcttcgtgttggtggaccttatgtaagacagaataaagataatagctaacaaccacttgactacaggataaagctagattgtatagctgttcaagttggataacggaatgcatatctcatataagcacatgcaacaaacaatacctgtccgccagtatctgaatcacggccaagctccatgttctcaccacggaccaggccatgaaggctgcagtattaatacatcataaaggaattataaggccaatacatgtgaacatacataccaacaaacctgcaaatttcatcatatatcaaagtgcaaaataggagaaagaggtattatcactaattctgagtctaagggattgattatcagttgtacactaaatttgcaatgttgatttcctctaggtcattttttagctatgtcatgtttgcattttatgtaaatagcagctcagtgcatatgaattgattgcaaacagggttttacgtgtaccaagaacctacactgcacattgacttaaaaggatacaatatgatgatattaaagaaactactgtgtacctgatcaacactatgtacagcttgtcaactgaactgatcctaggtgtgttcccagttgtgctgtcaccataggcaacagaaggatcaccagcatcctctcccttctcaccttcaaagagatcttccgacatatctgaagtagtctcaacccgtggcctctctgtctctagacggcgtttcaacaagcgattggcttcctccttctccaactgagcatgaaaataattcagaaataaacaaatgcacaaaaacggaagaggtacaaaacttaggaactgaaattggaaagggaaactttgctttttgaggaccaacatggattacatattagaagtgaaagaaacatcagcgctcagtgcaaatattcctatataaaatgtaatatatctaatgtacctcaaaggtgtcaaaaggtgaaagttttgggaataaatgtaaaaatctgacaacttgagatggcacaattaaaaatggcaattttattttctttaaatgatggaacaattcaaacctcaggacaatgcatcaatcaactgattagtacaagaaataggtggtgtgagagcatgccatgtgcaaacaacatatggactagacaatagcaataagactactgatatatgtcactagttcattatgtacaatggttgatatagaaggctcttctgtaagaaaaatagttccaccgaagttagaagttatccagcatgttagatgaatgaaacaaattgaaaaccaaaagacaagtaaatgatcaacaagtgagcatacgacttttagtgatgtatcacatttttatttttattttttgaaacacatcacattttcctcccgttggtatgacctttgagcatctaaatattgacataagaaacaatctggtattgtttcgatcaactgtactgtacgcaccttattgccgctctagttctaatgtgaatcttacttggctacatattccaatttattcaatcaaagacccacacttgcaagagtcaacagctcacttgattactgtcatggatgaggtggatgagaaatcaacataagttgtaaggtacatgcacactgagtgatcacccatgccccagtgttgccacaaacgcatccaataaagtcatcaacattatcatttgtatgtgttctttctttgccaagcctcagtgcaatcaaaatgcaaattagaggaaaaataagagaagccaaataatgggtttgcaggaggtgtcaatagaactgtgcagttttgcttgcttgaatgtggatagcaatgatgaccagaagcagaggataatgggagggtttctgaatgcagaccgttttgatcaagactggctttgtctatgtcaccttcaacaaaataagacactacctcaagctttctaaagattcaaaggatggaacaaagtggtagaactaaatatggaagtaaaaatgtcatacctgagcaaagaaatcagaatgtgtgtgtttgctgtgcaaaatgaagggaaaaaacaggggacctatggtaaaatcttctcttctgataaaatgcatggttctggatatttttgatgactcacatcgcactcctctcaaaccctgaggttcagtacacgattctctgtgtcattctctgcttggaacaaaggtactttcatgaaagtatcaggaagcatttgtataaaaagttgtattggtgaacaccacgtgatctactctgcagtctgtagtaggtagtaactggcttgagtgcgcattacacaattactacagatttcactaaaaaagcagatagttcccttatcagcgaaacttatacagtctactccaacaatggagaacatatactttggctccattgatccaactagatctatggcactccaacactggtcttcaaccttctctctcactgcattttgtcatctatttcacgcgtagaaagcaaacaaaactaaactgcatttgaaagattgcccagtagaaagcttcagtgcagcctatttgactgtggtgtctatgcaaccaatatgtaatgactatttgtcgcaatccctgctagcttcttctgcagggtaccagcatccaacaaactaagagagtaaccagacagagagagatggaaagagctggagtccatataatggtgaatggtgacagcgaatttagcatattatccaacagcacacgcaattatatatagccgtgccatgttgtcccagcacaattcgaaactgataggggccgagaatctacctagcattgcaggtacgcagtaatgctactacatttatgtcagaactctcatgccatttcctcagcaaattcgtagaggagacgggaaagagatcaataagcattccgttaacgcattccctcgaacagatccatgtgctctctcaaatgcaacgcataccaagatcaatccagcccttagtccttcctacgcggaatatcacactaaatcaaaccacatctccactaaaccagaacaagcccggaacccaaatggaaacggcagacaggattttaccaacgctccccccacccaatcacaaaaccgaagaacttgtgctacggagaagacgcaacgaaccaaaaacaaaaacaaaaaaaaaagaagggcacatacacacacctccttcttcttcctggcgaggttccagatcctccacgtcatgttctccagcctcgtgttcttctcctgcgggctccgcatcgcgttcgcctgcgccgacaccacgcctcccgttcaacacacagatcgggggtaaaaacaaaaaaaacaaaaaaaaaacatccgcaaattcacgcgcggcgagccgggagattcgctcgcggcgcgcgtgagcggagggagaggagaggcaggaccgcggcgcggacgtacgcggagccatgtcttgtagaggtcggtctcgtcgtagccggtgatgacctcctcgacgaagtaccgcgcgggggagaagtggccgcgctcgcggaggaggagcgaggggcggtcccccgctccgcctcccccacccaccgccgaggccgaggccgaggcggcggcgcccttgccggcgtcgaggatggcatccaggtagctgttgatccagttgtcgttgccgtacatcgcgcccgcccgcgcgcgcgggggcccccccgccggcggcgaggcggaggcggttgctgccgctgccgccgccgccggcgaaatcgagaggaggcgaggcgacgaggggtgggcgtgggcgtgtgtgtggggcaaagtggtggcaaataaataaataaaaaaagaaaagggaacaggtggcgatgcgaaataaatagcgaaaaatggaatcgaaaatggaaataataaatcggacgtggttattgccccccaaccgcagttggccacttgggtttttgtccgatgttaaccgttggattttgatctaacggtcaggaacctgtctcgtgtgtctttttctccttgcttacatgtgagggttggatccaaaaccttgagaatgttttgtttaaattcagactaatttaaagtgaatccaaaaaccttaaagaaaactcgtgtaggagttcatggcttttacgatattgtaataaaattagaaaggtttttagtataacttttgtcgtttgtcagagtataatatggtatgttattagccacgatggttacaagcgagtgtttgtccggtttttgactggtttttcaacttttgcattgcatttatttcaaaacaattataatatgccatgcattaattattgaaatcatttctcctaaaaaaatgatgtgttatttggacagcttgtttgattgactaggtgagcattcatttatatgtacagcctcatggtctattgcctgctttataggccatggcatttgctttgataccattaattttgttctagatatgtgtgtgtttaattaacactaaccatgatccaccttctcactcacctgatgctctaaaagttctataaccacatggcactggaatctttctcctagcttatgtggacagatttggaaagtttccagttccagatttccaggtaagacataataatacatttttttcacctgttctataggactgttggagcagcatcttttactttctcacctgttccattttttccttctccatggcaattgaatttgacctttagggcaaccctgccttgaattaagaaaagggaaagagctcaaataagagtctaatttgtagaccagataatattattgttcaagagtcttggtcaactatggattagtactcccatatcatagtatatggaataatgcgaggttgttagcttgatagcgataagtttggtctttcatggcttcaaagaacacaattctattcggtctagatgctaagaatgtcttaaagctacgtctttaagcaaatgttttcggatgttaaagtaacattgcacacatcacccaccatttttgaactaagggcaatgcgttcggcctaatgctgattatgataagtcacacaaaaaaaatattttgaggacgaaactttcatacatattttcttagcccgagtttagatccaaagtttttcttcaaacttccaacttttccatcacatcaaaactttcctacacacataaactttcaaattttccgtcacatcgttccaatttcaaccaaactttcaattttagcgtgaactaaacacacccttagtgatttaaaagccaataacgatgaaaaataaactacgatgaaaaaaatcttaaaattaacttttaatttaaactttagcaacggcttataagctgtgggacatataatggcaaccgtagttcgtcgcgggtttcccgtatgtgtattctcaacggggcttggtgataaaaggggataaccttgtaagctcactggctcgtcacagtggagtgggtatgctatagcgatggtttttaattatgtcagttgtattatttgtttttgttgcacatagtaagatttttgccatgagttaatattatttgaagtgaacaaattttaagaaaaatatagcattttcaacacgaaacaaatattgttacgtgcttcaataaatatttctagcataaaaatagattcaatggaactaaaattggcatattactacatgtttatatgaatttgttaaaatttaaagaaatttgactttaaaaaattatttgaaccggataaagtatgtttccatgtaggctctagaatatggtccaataaaccaacatgtctaaatatggtccagaaccatatatatttccttacaataaagtttatcatcaccatgaaccaaaaaaaaaaggaaaggaaagaaagaaaggcacttcaaatctgcttccataagaccataacaaatatacaattcctagagacccagagaacaaaacttctagagaaagaaacaaaaatttggcgccaaggaagtggcggagagaaacggcaaacccaagagccccacacaccagtggacacaacacacaaagggaaaggcacagccagccgtcgccgtcgccgtcgccgtcgcgtcgccactcctcctcctctttagatattcccccaatttgccattgtttaccagccaacttggagttgcaaaagccagtagcgctatagctcggtctccatccggtgtcacccaccgtctccgacccttcccttctctcctcgccttttcctgtgtgccaagcgacgcgtcattggttggttggttttgctggtttggccagcttgttgattagcgctaatctgctaaccccccacctctaattagtatcatttgccgctgacctagccatgtgcagcagcgacagcatcagcggcagattagtttaattatgggtaatctactgctgatcttatcccctaaaccgaatattacagcagtcgttaggcttaggaagggcttgtagattacttatatagtagattggttggttaatcttgggatggtagatatgttttttttgaacggaagatggtagatatgtgatctagtacgtctcgagcttaatttgttagttaagtgtgtgcgcggcagttggagctttggctagctcttgagtagaactttcttttttttagtagaactttctttaatttttgtttctgccaatgggtgttcgcgatgggattctcctaacgtgtggtacgtactgttcgtggcattgcttgtaaaacacgaagtaggtcaggtgcttttgaattatttttttgaagtgtggggaagattcgatccaacggtttggcataggtctttggattaaaagttgaagctaattttgaatatatttttcctaaaaataattcaaaagagagccaggcaggcaatggaagtggcgaaggaacacccaacattaataatcctcagaccaaagttaaaatttaaaccagcttcggattttaagccaaaaccgtgccaggcatattttgatttgtcctttttaacgcctgatgatttggacaagtcgatggaaatggaagatggtcaacccgtcagatgactaacggagaaatgtttttttgctcagctgcaaatcgcgaattaattagagacgttgaaacttagtaattgaaagctacaggtcgattaggaataggatcatgcaaatattatcgattcctcgtaataaaggcaacggcaacgatgaggttatgccttcgcgggattgggccagctcggcgcctccgaatggttcagttgacctaacgattcttatcgccacaggacacgtccatgtcaggatcaggttcagaggagagaacggaattttctttttttttttttcgtcacccgtccttgtcttaatcacctatacttggaaaatagcatgatgtcacaaattgaaaaaaatgcgccccatttaacttttgagatttgttaacttgtgttcgtttctgggttaagctgccatggtttaacagatagtgtgacgtttagatggaaaattctagctatatgcgcccttcagtccctgtaagaccttatttaatgtcgagatacatagttagaaataagatcttttacgaacagagggcagctaatgctgcaatctcggttcacaaccctttgaaactttattgaagatactgtcacattgcgaaactgtcgctggctgtgaaatgctacatgtgtacagcactaatcatctgctgatcggattgtcttcatcatacaatacagtgctcaataatagtaatcccacaaacctgtgcatggttcctttacatgagagccgagagcctctgcctcactcggtcgaggctcaagaccaaagggcaacagagctattccgccaccgtttcagaaagtctgcgatgcagtgttctgaaagatcaactcctagaacacggatatcaagtcctcaatttgatccaagtgaaaatgcttcttcttcagcctcctgcggcgagtgttgcttgccctgccaaacaatgtcctttttaatcagctatctaggcaacaaaaactagaaataagagtgaaggtctgcatatcactagcttcagtcagactttgtaatgtgatcatttctagtaaaagaaatgggggcctttacaggctctagttcaaaaaaaaaaatcactagcttcagtgagcattacgaacaggggcaaccaatgagcgttgtgaacaattgaagcgttatcgatcactgcactcaccaatactggttgtgaaacaccacattgtccgcaggtacatgcttcccatcatcgtttctattccactggtagatagcatgagtcctgtttttcagttgcaagatcgaatgaccataactagcctccctgaatgcagagtagtctggctgtggatcactgaacctgcaacaccgtgattttgaacaatgagtgaaccgtaggagtgcgtaaacaacaatattacaaatagtatgttttccgctataaattcatttgcctttaccttgaagcaagcccttcctggttgcctccatcaccaactgttatgtacacaggagcagatttgtctggcactggatatcgattacccgatgttatgttgtagttgatgttagagatacgatactgcaaacatagacatatagaaaggtacttacgaggaaacaaaaatcaaagttcagagctcttcgactagaaatgaaataacaggctagcataatttcttctggtcaattctcaaaatataactttacgagattcagaccaaattcagctctttttttttaatatcaaagaagcttgtgccaaagaattaagtaaatatttaccgatctctcataagcatgcacatgccctgcaaataccaagtcaaccttgtacttcacaaaccatttctcaaaagcagccctcatactctcaccctccatgtaatgtgcttcattgctgttgtacatgggagaatgcatgagaacaataagccaaggagtcttctctctatccacatgcttcaattcatacttcaaccaggtccattgaggagtgtattttactggtaaacatcagagataagcttataaggcatacaacaaaatattcaatgaaaagaatcatccaactatcaaatcatacatgcatcacataatcacttctaaatatagtagatgatggtcaggatattacgccaatgaaaaaaagatactagtagatctgcactcattcaagggagcatccatgcctgtccccacacaatgttacaggtttcaaacagctggaacgcggaaccttgcattattagtagtttcaaactttcaatcaaaccagagaagactttatgtttctatccatccgcatcagagataaagaatatcgtcatactcacatttggatcagtaagaagacaagaagacagtaacacgataatttcttttgtctaagaagtgctacttttgcccctccttgacttggaattttgaactacgtgaagcacttggaactcccaagtcactatcaccaccacagccgccaccactaaatctggtggtttgtacagacttaatggcatatacaaaacaaagcaagtcagagaaaggatctttatcttaccgaatggagaatagctagaaagcacaatgatatgagcagatgcacgtctgactgcataccacataggagaactgctctttgatgccaaatatggagtgtgacatctatgcagatatggcttaaatgtagaagtttctccctgaaaacataaatacgaatgcggtcagggttaaagaaagacaactatgtcagctagttaaaatgctcaggtggaactgcagtgttattctgaacaatggataagttattactccctcagtcccattttaagtgcaatcatgagtttcctcgtccaactttgatcgtccgccttatttgaattttttttataattagtatttttgttgttatgagatgataaaacatgaataatattttacttgtgacttatggtttttaattttttcaaaaaattttcaaataagacggacgatcaaagttggcgcggaaaaccatggctgcacttaaaatgagacggacggagtagcttataagcacagatccttgtcagtgtgtaaatccacgtacagccagctataagaaaaaataaactaatacaaagatctatagatcacatatctattttcttcagtattatttgcctgtaattgtcctcttctgaacatgctaaagcaaggaaaaatccaaaaaagttgggagtttacaaaatgtcgagaaatcactacttccaatcagaggaatatgtggtaaaaaaaaacaactggtgtatagatgagaagaatgttaacataccagatcaggcctgtattcaatttcatggttaccagcgctccaaatccatggttgataagcggtactacgttccacaagccgcccccaagaatcccaacgaacaccatcattatgttgatatctatcagcatatgacaaatccccaacaaataaaacagtttgaccttcgcttttctcataatgttgaagggttgagagggaattaaatgtctgccccagatcacctagcaaagcacagccagaagactttagtatcaacaagctcggacactataaccatatcttgacatagtggttctttccatgaagtcattgatccccattttttccgttcatgtattcccttatcctaaagctaggatgtttgacaagaacagaggatgtgtttccagtccttctgatagtataatcttgttgagatctatcttatatgactcatgcaacctaggtaaaatcctagaagagatgttgcagagatccaaagtaattcgatgacacatgctgttaacaaaaaaatacttgagaaaacaaaagacgaaccaattatgccaaatgtgtatgatgcatctggatcaattgctggaggagtttcaaaccaaaattctcgagctgaatctccacttccaatcttataataatatttggtgttatactgcaaaacaatatagtaattttatatatttacaattttaaattggaactaacaacaaaataatgtgcacacagagtattttgttaatgcatcatactagaatagtagaactattccacagaactaagaaagtgtgtgaaaataatttgtgcaggtgagcatcgtgtttcaacatgataaccttactcaattgaaatttgacgaagaaaagttctctgtcaaatcaaatttgtgcataataactctaagtttacagctaaagtagatcattatggaattataagtgagaaggttgtgtgatagttacttagaatatgtctaagctgtttacaaaggaaacatgatgttgtaggttattctattttagtattttgcatgggtaaacataatgttggacaaatatttctacaattgtatgcaagtataaaatgcaaagcctaaacgatatgaagaaaatgaagtctagtacctcaagaccatcaacaaggcaatggtgaatatatccagatttatagtcgtaaaaggtataatttgttactgttccttccactctctgatcatactggtgctcatttttaccatagagcacctcacttgtcccaggttctgctacagtaacccatgatactataacagcttttccattatagtcaccttgagtgatatgaacctggcagcagaccaatcaattaaaacaccgtcgattcattgcaatgaactgatctggcagaagagtttagatacctgctgtggcgcattgtagccgtttggaaccgcaaaccattcgctttctagaggtatatcagtcgatgggtactccgtacgcacgtaagagctcgtgcggccacaggagacgccattgacaaggcacagaagaacatgtaacagtaacaacgcaaatctccagcccatcactgatgcagaacactaccgatccccgttttgaacctgttacatgttcaattgagaccaaaacaaacacctatgagatattgagattcatacgagtatgaccacagaaaatactcgaaatgagggattaaacgtttttttaaaaaaataaaaaaattgtgcacatgaatcagccacatggctatggtgtgtcgtcctggacctccctggtacaaccagcagagattcgtacagaataaacacgaacagctatggcgctgtactaccagagggcacccaatccaagcacaccccaagttcggatggatcttcaatccacgcctcgcgcccgctcaccaagcgaagcgcggaggaggaagaaacgaatacctgattcgaacctcccgagacggacgcgccggtggaatgggggccgcgccgccgcgccgcctcgccggcgaagacgacggagaggatggcgagcgggagagaagcccaccacccaccagcggaggcgaggagtgaaggcggcgtagcaaagctgacacctcacggaagcaaactctgtagtacaagtataccgcacggctcgtctactacggtggtggcgagaaaatggaggagaaagcgtaggatcgcagaggatctactgattcgaagtcgagacgaggaggaggatgattcgaagcgaagctggaaaaagggtgggaggattcgcttaccgtgcaggggaggggatcgtctcgcgctgggttggggacggagacagagagagaggatcatgtttggtgttacgagacggctgttagttgggacctttcctacttagcgcataattaattaaatattagttattttttagaaaaaatagattaatataaattttatgaaacaactttcttatatattttttaaaaaatatatcgcttaacagtttgaaaaacgtgtgcgcagaaagaagagagatgggttggaaaataaataacatagtagtgtgattggtagtatcttcatttttcagttcgagttgctagttttcctcgtttgcgagatgggttggatggatggttttgtttccgtggttgttgatggttttgtaccggacacactgaaatatctaaatatctgttactacttccgtccatggaagtagtagcaattaatgatcgttttaaaatcatttagctcaaaagatgtctaatttataattttagaattaaatttctataatcatattattttatcggttgtgtgtcaatctcttatctttaaagctttgatgtattactaatttctttacgaaatcactcgaatagttttcctatgtaatcaacttgtagcagtgtattaacttaagatttcaatagatatttataaaattatggcaggcattagttactgttgtttggttggtatactgaggttgtcaatatttataataattgtatgccttaacttatctacagttttggccaatgaaataaaaccacaatttggctagcaaaaggcaatcacacacgcgcttgtttgagtcatgatggaattggaatctataggatgaattgtgctaccgctctagttatacttatgatatggcaagatgatggaatttgcttcaacctaacaaaccttaagtcaccgccataccgctcctttcaagtgatggtagggtattgtggagtatttttcctttccttttttcagcctgctcctccagttttcctccgtttgcaatacaggttggatggacggtttgcttttgtggttgttgatggttttttttactgaaataccctctccatccaaaaaaaaaaaaaacttaggtttccgcgtctaatgtttgaccgtccatcttatttgaaaaaaattaaaaacataagtcatgcataaaatattattcatgttttatcatttaacaataataataacaccaatcataaaaaaaaattatataagacggacggttaaacgttggacacggaaacccaagaattgagtctttttgggatggatggagtatttggtagcaattaatgatataattttaaaagtaatcaattcaagaattgcctaacatataattaattacagtttaaaattttctattgtcaaattatttgtcacatatcctattttactataaagttattccccactaactccttaagcttaacatgcaaagatgccacatcatcatccactaacaagatgccacatcatcattcactaattaacaagacgccacatcatcatccactaacaatcatcatgtttaaacatcgtgcaaacatgctatatctttatagtttttataatttaggagcttttcaaatacaaacatgttaaattatcatacaacataattcacataatgtttcaatgtatatctttattatgttttatgatatcctatataagtcctcatttagttagtgcttaaatgattaatctatggtccaaattatctttctcctttttcctctaattaagtcgtatcacattaattgtttttagcctttagatgattaatctacggtccaaactatctccctacttttcttcttccataaagtcataccaccttactttttacgtttgaatcaccattctactatttaagtttaaattatcataaaccacattaatttacttaatctgatgttatctagttatcttgcacgttattttttttatcatactaaattcccgcagcaatgcgcggggtttcacctagtattgtttatatcgatggcatgtgcatcagcctcgatgtgttgttagtatcatgataaaaccacacgaatgctttctcgtgcgaacagctcacaagatgtgtattaactttgaataaacaaggctttcaatatattttaacaaaatttatggttattagttactcctactaagtattggaagtatatggatctcgacacaccacgataccaaatctggaggattgtttgattcattgattggcatattgaggttatgttttggctaccaaaggccaatcacatcgcacttgtttgagccaatcatggaatctagatttaaaaagataaaccaaataggcaaaatctaaaccgagaagcctatcggtttagcgttaaccagcgacaaaccaatttgtgagaagaactgctacatgtgctggcgtgcatgcttgtttttcctcttagacatgcatgtcttttccttccttcttataaagttttctctcaaattacttatccgatctacaatccgattacaccattgtattcgttacaattaaatcttcacaacaagatcttacatgattatattacgatgaaaaaatatttatatttgtaaattacttttgttatatacataagttacttttatcatatatataagttacttttagatttgactaagttacttcttagacatataaaagtaaattcaataaagtctaaaagtaatttacatatattataaaagtatcttaaaacaaaatggaaacatactattgcatttttttcaagttgaaaggaaacactagatggagtacaaaccagctaccactagttgtgtagtcacgtccaatgaaaaaaaaatgaatgcattaaagttactttatttttgttataagttacttttataatatatgtaaattacttaagctttattgaatttacttttatatgtcgaagaagtaatttagtgaaatctaaaagtaatttagatatattataaaagtaatttataatttttcatcaaaatataatcatgtgagctcttgttataaagatttaattgttacgaacataacggtgtaatcggatcgtagattggatgagtagtttaagagaaaattttatttgaagtataggtggaatatgatctctcatagatggagtggtagctgatttaaacaaaccagctaccattagctgtgtagtcacgtccaaccaaatagatttagtatttttatatttgagaaagtagcttatgacatggcaagatgatgcaatatattttgtccgttaaacctaacaaactttgaagtcactgccataccgctcccctaccgtcatcggcatgggtggaaatcaggccagcttcatatgcctccatcaaaatcgatttatttatccttttatcatatggagctgttcttttaacaatctaaggagaaaacggcgtaaaatctaattttcgttcggcaataaacaactttgattttctaaagtcagcgtaacttatctagctagattcttcgtaatgagacttatttacttgaactcaaatcttagactttcatggctaattattttttaagtagtaggactttgctagtattaagatatgctacatatatatcttgacatctcaattattaaaaccgttataatttgactctaaagatagtattcatagtggtattgatgtgaatacgagctgcgttagcaaataccattataaatactatcttgtgagtcaattacattggttttaacagttaaggatcaagatatccgtattacggttgaggggcgtgaattagatttaacctatatatcggggagtctaggtggacttattccaagtaataaaccccacaaaatggaagctcgcgaagcccacaagccgcaggaaagcccgcgacgagaataccaaaccaaatccaccaagtccaaggggatctctctctcgcctcgcctcgcctcgcctcgtctagttgagcagccgcgacgagcacggcggcgacgacgacctccgccgcgacgatggccgcgcgcctcctcctcctcgtacttttcgccgtcgtggcagcgcgcgtaggcgcagcggcggcctatcagcccgggtatgtccccccctcgccgcgccacccccaatctcgttttgctccgtgatccaatccaaatcgaccgcgagttgaccacggctctcgctttggtggttctccagatctgctgaggggcacacgatcgcgggccgcatcaagatcgatggttagtctccggctattctcaccctatggctcgagtgaattccgtggagcttttgtgccagatgcgtgcattgaggttgttgttgtgctcggatcgttggggatcgtactcgtgtagcttaggtgcatcagatatctttgtgtgtcagggttgtttggggataaaagccttttttaacattcgatttcatagttggctatggtcaatttgctggaattattttcgagatctgccgattaaagtgtccctaactttgtacttaaggtagtgactaacgagatttgatacactatttatcgagctcatctagttccgtcttagcgcaagccagcgctagccaactttgttagctatcgactacttagcagctttgagggtttgttaatttagttagtgatttttcaggcactcgtggaattcattgcatttgtgcaagctgtttttcagatcatgcactgatacagttcgatgagcccctggttttggttacttagtctcatggggtttgcttagatgacagttggtattcgtattgactgattttagctgagctttcattggtcagggggtatttgattatgaatatctgatgattttagctatgttttacaagagtttgaaagtgagctttcgtggaattttgaattgcaaaaaccgtgtgttgtactgttgtgattgccatcatagtttatccggcactttttgtttctaggacgagtctctacctgcgttacaacatgttcgatagatatgttggcaacttggcatgagcattgaagcccacgtttcccaaccatgcttattgaaataattcagaccacaataataaatggctgctgtatagtgtttcagaccgcttttaacttttacattttctcttgctgaaaacattgttagcttgtggatagaaccatgggtttttcagtgctggatatttcatgtgaactcagattgtcaaggcaagtcttagttttctttgcactcagggatcttgcatttgctccttatctggaattaagtttccatacccgtgaagccaaattgtactaattattataatgataaccagttgatgtcgttttttttttctgttttatgtgcttatagctgcaagtgcaattgcaaagggctttggtcttccagccaagacatcaaacacaaaagtgatacttaacggtggtcagagggttacatttgccaggccagatggctactttgcattgtatcctgcaaaatctgcaaaaccatatgtttacaacctttcagctccattttgagttcccggattagggaaattagtcatttttcattaaatttaattagcctgctctattgttggatgtctcatatcttacatttcctatctgttatgggtagccttattcctgaaaattagatatagcctctgggttgctaatagaaataaatctagctctgttgttgtagtattcttgtttgttattttttttccaatgtttccttgtgggcagcaatgccacaatgttagaagagcatactatgttgctttttgttcctccttgacatgatatgcttaagccacaatgtgccagctggtactcatttaattgaggtctcctcattgggctacttattttcaccagtaagtgttcattagtcatttttttttctgtaacatgggttaaatgggcatcaagattcattctctattatgctgggtgataggttcgggtagacatcagtgccaggaatcctgggcacattcaagcagcattgactgaaaacagaagagttctaaatgagcttgtgttggaacctctcagagaagagcaatactacgaggtgactaatactaacctcatgtttcttatttcttcagtactttctattgtataatatttaataagcagtcaatttccccccttctttttcctagaaaagggagcctttctccattatgtcacttttgaagagccctatgggtatgatgcttggttttatggtcataatggtcttcgttatgcccaaaatgatggagaacataggtatgctgcacacttttagccttttatgtccaaatttgagttataatgtaatagttattacactatattttgtgcccacaagtagcagctatgcagaacaggattcaagcccaatagacattttgcaccatgtagctcgtatcatacttttgcagaaagatattacatttaattgtgttgttcattccacatctctcattctgttccattggttgtaaatttaggccccgttcttttctgcttactcatcagattattgtcgcatattatttgctccacgcagctgtggagccaaggcccagcgaacctagtctggtgccggggctccaccgcatgcagcatacaagcatgacatattatagttacctaattacgttgcttttctgtatctaatcaagaacaaatcagccatgcaaagacaaagtagcaaggcgatataattaatacccacaccatcactgtagttaggatgcaagataatggtaaaaagcatatatttggtaaaagtgcctttttgtttttaaattagcttgtatttgtgtatatttttagttgccattgtctactcctgttatgtaccttctcagttttttatttacagttcgttgcttcattctatgatatgtttttacagtggttcctttcttgagctccttgagcaaaacatttgtgggttagctgtttgtttctttaatcagcttcgcattttacaaaatatttatgtactgctgacatgaaagggctgaaagagcttatgttatttggtgatatgaatgatgtatatatttttaataaatgttaccttataatacttgttgatattatgtatgtattctacctgactgtctctgttttacacttgaagatcccgaggagataaagcaagctcaagaacaaatgaggaactcccctgttccatccttctctggcctattagcaagagcaaacagctagacatactacacggggatactgcatggtttaagttaagtttatgatgggatgaagagcagtactgaacaccacacttgaatagaatctttccctagcacaaggtggaaactctttctccatttttattgtactttaagatgtaataggtttgtgggggtagaaccttctgaatctaactgaagtagcgatgcattattgaattattatagcccagactgagttaagtgtgttgaattttggatgttcgtatatttcacgccttgttgaatcaactatagctatactcatacttgatgttgacctgctattagtcacatgacgttatgatgtactctcgacttgataaacattaggccatgtccatatgcaggtgactcaaattgcttgcttgctcttcacttgattaacatgtctacgtatctgtctatactacaactcttgccagattttaagccgaaagaaagctggaaaccaattatttgattgaaatcctgcttaatttgacacttgtgtagcatactaggctagtagcatgtggccaccagatgggacatgttccactagagtacaatccatgcatactctcagagtctcactacataccttcacacaactggtcacactcaagtcacaaccatgggaaattttgtgctctccaatggcctgaaaaagataaggcaccaaaagaaccaggagccgcctgaaccagatcacacctaccttgcacctcatgaaaatgatgtgtcccattcacagaatcacacaaccttttgtgctgaagaatcaagaacacaagacaaattctaacaaccagacacaaacccccatcattttgaatttggatttggactaatttgtctcctggcatttgtattttagccaattcgactgattctttcgcaaaaatggcctcgtcatcgtcatcttcgtctgagtttgggggattggaggaggtatgatgcatgggaccctgatcgtttatagtggtccgagcttgccattgcaagcaaagatatcatcttcaacgatggcgtcccatgcaagctacgtgcaaaaaggatcatggcattttttttctgccttttcttcgtcccaattgacctttttcttttgctggaaacctggaatatattccttaagaaagttcacaagaatatataaaaaataggagaccacttgcagcagcagtaatggctgtgacaaggaaatgatcaaatgaagatagtagtggtagaagaaaaaaaaaagatagtatttgagcaattgagctgtaccaattgctccttcagtccacttgctgtactctactcatcagtactgacaatggacggataaaatacctactgggatctcttttcttccatgagaccatgaccatccattatattgactctcaaatcttcagtaaaatggagcataacaggagcaagcaaataggaaaagacaatgggatctgccttattttctaagaaatggaaccattccattcagtggcgtgctgcgtgggctcctaaacggtgcgattttgatataaactttctatgtatatgaatttcttagaaaatattttaaatctattttttaactttataagagttaattcattcatttgtagaaaaacatgtcctgcttgggaagttgggaaagcatcagcataaaatttgattttaggatcaattgtcatgtcctttttgtcaattttttggccagctctctttcataaccgctaaagaagacaaggaaagtactcgtatttaaaattttctcccaagcagcttagtttctgacttgctgatttagtcatactgatacagctctacatgaacccgaattattgcagttaggcttccctccaaatctgaccatctgtatgccgtgctgtatttaccatctgtatctttctttattcttccttgtagagaagaaagtgtcggcaacatcgtgatggaaaatgggttgctcccatgaatctagagagagtatagacagaacatcaccatcaagtgtctcacctaccattgcaaaaagattaaattatgattagtatataaatccaaatccatgcaataaacaaggaaaaaaatatcttagacctgcctaccatccatggatgtgtgctgatgtgtgtgagagattatctctatgcataagtgtgaaccatatgctttactttgtgttaatctatgagatggtacatgttactacttaactagcatctcacaagtcacaaggcatatgctcacatgagaaatgggatcttcttcttgatccaattttccttgcacccaactacatgtgaagtgttccaatatgcatttatggagcaaagcttttgcacagctagctgcactatactacaggaattgttctttgttggctggatctattgtttcaaattcgccaccgagtcgcattcgaattgttgtttgttgtcgaacattacaagttacaactcagtgccaactgtatttctgaattcattggtactgccatctgcatcacaaatttttgtgttatcattttagaaaacgttttttgctcgccagtaggttgtttgaaagcttcattgtactttgttttatctgtagtgtttttgcctgtcattaagtggcggaaaaatcgattcgttgatatcataacgtgcctatcggtgtcatagtatgctaattatattataacatatgaataagcagttttgttatatattttgtcgaaagtcgttgatgtagcctgacatcggtcctagaaccgtagatctgcccctgctgtcattagcaacaaaactatcactgatattaatgaacatgtgccgatcgatttcattgagcagtttgagttaagcgtttctttttcgcaaggttggagatggttaattggcatttattttggtttggatatatgtgggtgtcatattatctttctgtataagagaagtaaaggttgctattttggtgccttattatttgtcatgtataattgcagcatgcctgtattttgtatcttaatgtgtataaagaaattgtcataaatctggtccatctggacctagatctacctaatattaggacgactgcttcaattccagctatgcaagtgatgtttccttcaaaccaaaccaatgacagcctttgtaaaataattactcctcaccagcagcatgcagcatgtgattacatcctttaatttcatctcttctcactacttccccttaacaaccactgatccccctgcttcctagctactaatactcaaataaattgctgtccagtacagtacagtacagtactagtgtgcgtggttacataacaagacacgattaaattaagctaagcacatgctctgttgtataggataccatttgagcttgatcttgcacatctctcacaccttttgggtgtgtttagttcacgctaaattgaaagtttggttgaaattgaaataatgtgacagaaaagttgaaagtttgtgtgtgtagaaaaattttgatgtaatggaaaagttgaaagcttgaagaaaaagtttggaactaaacccggcctttgttaattttgcatacatagcttctttgatttaactattcaactagctaggaatagttaatccaaatccagctataattgatggatccatggttgtgtgaactgcagcaaagctctccaagtggattccaaaatatattcagtgttacacgtctctagcaccgacattgatttgtgagatgcttcaaagagtccaaataattgagtaggagtagtatagtataacaacaaccaaatatgcatgcatgcacattgctccatgaaagcatccatctggtggctgcatgctaatgcaatcatattgtaggtgtgtgcagagttgtaaggcaagctatcaccagggaccatgcatgcatcatcttttgggctccatgtccatacagattaaatcagatattaattacgctctttttactcttgctaaagtctattggtggtggtgacagtaattgttccacttttttttttttgaaaaatgctttttactcgacctactggtggtggtgacagtaatttccactctttataattgaaagatgccttttactcttactaaagctgcaataggaggtggtgaaagctttcagttcttcttctctctctgaaaattgcatcaacttagaggcattgcttatagataatagggatgaatggttaatcactggtgtcaaaagaatataatacttataaccatcatctgcagtacatttactagttacctgtactagattttacaatagcttaatctacttaacaaaggtctggttttgacatttcaatcatctcagataagtgccgctacatcagcgtgcatgccgtgcatcagctaacttttgcaaaagcgatatctactatagtggataatggatggaattactattgaagggtgaagttccacgtggaattaattcgctctgccggctcacctcgtccatcatttatgcttctttttatctgtcgatcccggaactaatttacatttaggtcctctttatttaggcttagacttattggtctagacttttaagttagtttattggcttatatgatttataagccggtggatttaatgtcctaagtttagtggttgagtcatacatctacctcacataagccaaaaaagcttcttcaacctagcttttggcttaatagtgttagagtggcttatggcttcaaaaaagccaaacggaaaagctgcttgtttgtttaggcttagacttttcgacttataagttggcttataagcctaaacaaagagggtcttaatatatcacgacatattagtactatcgttttcttaagactatactcctacactagttctactactgtctagctactccctcatgccaaaatattcaaaatttgttctgaaatataataacttcttcacttaaattctcgtctcaacaaattataatatttcaccatttaaatactcatctactttctcctcttaacaattacattcttctcatatttaattttatttttttaagtatccacgtctaattttagaaacttttatattttaaaacggagatggtgtactgctactactgtaattaacgcgaaatcggcacgaacaatgcgagtcaaaattgtaccgtgccgtgtgtcccgtgtgcggatttaggttgatgagaaaaaataaagatgttcgttattcaaaccagatgtctgtaaccggtcaatttcaccattaaactaactcatgatcgagtcgagtcagtgatgagtcatcaccggccagaagatcacctcgatcaacgatgattatctcccattctttaggctattaggccgaattattcaacgagttggtgtacgagagaaattaaccaagctttctgcacgtactccgatgtcttcgtctcgtaatctctcgtagtaaaatattttcgttaagtgtcattcgagagaaaaaaaatagggagaaatctccgggaaagaaggaagagctttgccggtgtgtttatccattatccacttccttatcctaaaacacggtaaaaaaaaacagtattcctacacgctaatacacgtcagattaggtgagacgtagtacaaggtttgtttgaacggcaggagttcaaaccaaccaactcaattgatattgaaaagttaaagaagttgagaaacaaagtaattctgatgcaatacgattaattaaattatttacgagagaccagtgatcttattacgcgtttatgccaaaataaggtcatacaaatgttcattgctgatacgataaacccacaaacctatcgtacgtgcttcaactcaaaacaacactacgtatcactacgataaaaccatactcacttagtactagtactgtttataaaaagtactactggtactactagggcccctttgaatcacatgaataaaaaaacagagaaataggaaaaacataagattctgatagaatgtaagtggaaaacagaggattgtaaaacacaggaaaaacaggaaaaataccggaatttgagaagagataaagactcaaatgatttttttcatgaggttctacctcttgttaaaattcctccaaaacttatattgaaagagtcatttcatagaaatttcataggattccatagggttcattcctttgattcaaagagttttatagaaaaaattcctatagaaataaaatcgtctaaaatttatatgaatttccgttgaatcaaatagcttaaattataacccccgaattgctccgtttcatccggataaacacgagaaatcacccactaaaaaatacagtcaaattagtcaagaatccgaacgactgaaaaattacgaaaataccctccaccttccccaccgtaggagtagtactactacagtacacttcttctcccccttcctctccttataaaaccccgcctcctcccacctcctctcctctcctctcctcctcctcttcgcgtcgaatcctcctccgagaagaggagagtacatgaatcctagcgcgaggatctcgcaggtagcaatggcggcgatactgccggacctggcgacgcaggtgctggtcccggcggcggccgtggtcggcatcgcgttcgcggtggtgcagtgggtgctggtgtccaaggtgaagatgaccgcggagcggcgcggcggggaggggtcccccggcgcggccgccgggaaggacggcggcgccgccagcgagtacctcatcgaggaggaggaggggctcaacgagcacaacgtcgtcgagaagtgctccgagatccagcacgccatctccgaaggtgagggagggggactgactcacccccgtgtgctgttcgtgtttttttttttggccttttttgggtggatctgagcacgcgcgtagttgtgtagatctcgtgccgtcgcagcggttactggcgctaatttttgctaatttagttgtttttttttggttgcttgtggcgtgaacatgttcaaaagtagcttatccgagcatcaattatggggaatttgcagcacaagattgatataattgtggggaatttgcagcacaggatttatatttttatattgctgtgaagagattataaagctcaggttaagatggcgctgcttttaatcaagcggagttgcgtgtctagcagtagtgcttgtgagcttgtgttactttatttattgtgtgaaatcatgagattcctctgagttctatcgaatttactgtggctaaagtagtattctattgtgtggaatcatgagattcctctctgagtttgattgaatttactgtgtgcctaaactataacgagagctgctacacatacgatttttcacgtacgatacttgtacgactaacgatttccagcgaaagcccgtaacgtttgtctcctgttttctagtgatgcacgcacggcgttcaccatcagttagaaatcatactagaatcgtacgcagaaatcgtatgcatagtattttcgaaactacaactatgctagtatgctagatgtgaactgttacattgttagttggatctacagaaacattaaacaatcatgttcccactttacacagcacatgttataataattcttagtcagtgcgtgctaatcgcgggtcaattaagttcgtttgttgcgtctgctgagatattttattggggagatatttttagtggggtagatcagaacttgaattgctcagttcttagaggccctcacgtaaagccctgcggtggccatgctgtggggataggagaatttactgatggaggaggacaagttattggaccagtggtcctacttattgctcttaggaggataagaagataacgatttttctgcgcacctgcattattgaagcagggagaaaatagtttcattttgactgtatccacctagcttggaaggaatcctagatgcggcgcacatggacgggacgatcttgtggtccattcattaatcataaaccttacatgtaaggttataattcaaggacagttgcaggctgagaggtggtgatttatgtagtttgtcctatgttaggcgcctgctttcttggcaggtttcatctctagcgatgcttgggtgagttttaatattgtgaaagtgttaggttctgtccttttctagtaaagttcaaacgtatttttggaaatatttgtttggtcaacatttctttcttagaagactatagggcttgcagttagtgtgccttacttgtggagtcctgctatgcatatgatctgtttcacaggaaatgctagatatgctaatagtttgcatggtttgtaatttgtgaatctggttttgtggaaactttctaggattggaactttgtttaatcaaatacatttttgttggtttcaattggttggatatttgagatattgggttactgaccagtgaccaaagtcccatctatttcactatttaatttagcctttgttaccatattttggtgctcatgtttatggagtccagtcaaacactacaattagaaaaacaggttcagttctaattataaacatatttatgcgttgctagctttggtgttttatgtttcagctattattattgttatcgctaaccttttcttgtcattgactaattgttgtatatttgtatgcgtctatgatctaaatactgttttttttaaactgtaaacaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtaagaattctttcctgacgctttaaaaacttgtttcttaatattacttgaaataatttgttttgttcttttcataatgatttgtgttattgagcaaagcattaaaacatcgataggaatttatgtgcatgcaagaatgatcatttcttcctccttttgcaggtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggtatgcccatatttaaattggaattccatcttttacttagaacttcattgttaaaatcattgacctcatttccctgattttgataggcaacttttcttgtgtgtggcggttggtctttgggctggactaatcatcggatttgtgacagagtattacacaagcaacgcctacaggtgcttataagtctgatcatattcaatgttgtctgtaatcttatatatttgcttctagtccctcatgtccctcacaccttgaatttcccttgtccagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaaggtaaaactgcttatcttgtcgaaagtgtttttatgttgtttttatgcttcatttccactctgaagtcaattaaaaatttaaaattgtgtttgcacttgtaaatatttttccttttgttacaaatgtcacaattttaaagttaattcccatctccatgattgtacttgtagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcaggttcgcacattctttttcacagccacactctcatcacttactcttgccatattgcattcataaccatgttgcttcctttcagattgccatctctgcatcaaacactggtggtgcctgggacaacgcaaagaagtacattgaggtaagaacttatcagccatcttccatcacagcaacacttgacgtcaagcagtttttttcccctcccatattcgccaaacattataactctcgttctccctggttttaggctggtgcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagctaaaatgacgtagtagtgcgtgtgcttgcttttgttttaagatagagaattatagtattattttgtatactatattttcctcctttcttgcttcgttcgtttcatattataagactttctagcagactcacattcatatatatggtaatgaatctaaatatatatgtgtgcctagatccattaataactatatgaatgtgggcaatgctagaaagttttataatatgaaacggaggtaataatatgaaatggaggcagtatcttatattttctttatcctaaataaataaatctaaatttctggatatgatagatagtgtcacattttttttgataggtttgttagaaatttattttgaaacgaggaattacatctacactctatcattcatattgccaacagggtttacgattccgatagaccctttcgttttggccactggcggaatttgaaatttcgcgaaattcggtgaaaaaccaataaattccgaacaaatttcataaaccaaaatttgaatacaaattctctaaatttgccgacaaattctcaaaaactggtcggttttggcgaaattccgatcgaaatcatcgaaatttcggatggagttcttgtcaaatactgctgcttttcggtttaattttttattcttttcttgcctgatgtaagtttcagtaaatacacataatacattatttttttcgaaaatttatatcccaataggttctatgaatatcataatatttataagattttatttgatttattctttttttatcaattcaaatttgaatttaaatgaaacttctcaaaatctcatacggtttttactttcaagcctcgtcaaaacatcaaaatttcgcgaaatcttaccggatttcgtcggaatcgaagaccctggttgccaatcatcagcactaccatcaataaaaataagaataaatagtagtactccatagtccatactggagtagtgattttctgccggcgactcggatattaatcgcagcaactaatcgactcctcaccattcatctcaaaattcaaacaacttcttcacttgatgaagaagagcttcccatcagaaatcgatccccattcatctcaaaatcaaacaacttcatcgtgcggacggcgtcgccggtgccgggcatcccttcccagccaccattctcccaagcgccgccgcacgcccacaccttccctccggccatcttcgccggtgagcctccgccgtcgtctccccggcagcccacccagccgcggaacaagcctagaggagcggctgctcgaggggcaaggcggagagaggtcagtgactcagtgcgtggtgaatccgagacgctagcttagaagggcttggagcctgagggaagggggggggggggggggggtggggagacttccggtgcgcgttgacttgctttcctcgttcctgttttgccgccatggttgggttcggagagattatcgcctccgcggtgatcaaggaactatcggggaagctgggctctccgatttggaacacgatcatgtctcaggtgaccttcagagatgatctagaagccatcaagagcatgctgagcagcctccaagcgaagctgaacgatgcggagaggaaatcgcagacggatggcagcgttcgcgacttgctgaagaaactcaaggccgtagcctatgacatagaggataggctggccgtttatgaatcgagctccaacgatggccatgatggttctctcagacatgtcagcatccttcctgatcatgatttctcgtttaaatgcgatttttcagtctaactttgtgtttgctaactgacaggaatggtcgagctttcctgaaaaattgaagtcacgatataacttgccaagggagatgaagaagatgaggagaagacttgaaggaataaagaaagaaatggatctcaccagctttaaggtagatggtgccacagaggagcaggattcttatatcagtcggcatttagagcctagaagatacagcagtgaggatactgtcggaaggatcgcggagaaagggagaataatggatctgctgctatcagatgaagaacactccattattcctatatatggacttggaggattaggtaaaaccactcttgctcaaatggcttttagtgactgcacaacacagatagcttttgagatgctagcatgggtttatgtgtctgagaaatttgatcttaatgcaatcagtttatctatcaaacagcaatgtaatagccatacgctccaatatggtgattctggaattcataatgttgctgtggagtctatcctcacggaaaaacgatgtcttattgttttggatgatctctgggaagaaaataattttaagctggatgagttagaggcaatgcttagactctgcaagaaaggtagcaaggttattgtgactacacgtagcaagaaggttgctgaccgaatgaacaaagatttgcaaattgaattgggtcttctaccaaacgaagactgctggaccttgttcaggaaaaaagcacgagtaccgacaccagtgcctccctacgtggaagcgatgcgggagacaatagtggagaaatgccaaggtttgccattagctgtaaaatcccttggttactttctaggaagaatgcgtccgactgagtgggaacaaaacctacatagtaatatatgggccgaaaaagatgatcgttttccagataacggagttatagccaacttgaagcttagttattacagcatgccttgttctctgaggttgtgctttgcatatttgtcagtcttccccaagggctcccacatacagaagagcagtttgattcagcaatggattgctcttggattcattcagcccccagaatccatcccgacagaacaatacgcagagtactgcttgcaagaactcattgaaatgtcctttttgcagaatgtgaacgcggcaactgcggtatgcttcctcagccgcaactctttttctctcttttttcccattcgattgatttccaaatagtattattatacaatattttatcaaaatttcacatgatattatatgtaaaaatggtggtaatcggaacaaatatgatagagaaaaatgagtttatagataaatgtaatttgaaggaatcgagtaagcggaattcaatggaaggatcacttttgctcggaatggtaccgaaactagtggtatgtcaatggtcaatacccaattgaaatttgaccaatatttagaatggaaagacgcatcacttgttgcatactatttttgttagtggaatgataaataccaactactctggctaatattgaaatggaattgataagcttgacgctccctcctttcactttggttgctgtggaggtgtccacaacatggtggtggatgcacacaggacacaaaaaatgcttagctttggcagtctacttctgttgaatagacttattcatgggcagcctagccagatcttccaccattgggctaaaattttgggcccaaagtcatgaaaaaagcctaaagcttgaaatcagaataaaacatatgcatgcaccaacaagttcaatccaaatttaatcctgaaactaattggataattggaatattgtctttttgttgacatgctatgatatttggatttaaaaatcttgcgaaatgttagatgaatattgtaccaatgttactattttttttttcagttttttcatagctatttgtactgagattaaatgagtagcacataaatttgatgcatcaaatgcaagcagcagtggtttggtgatggagtcatgagtaacaccacccatcaggttaagtattatgtacatgtgggcgcacattcaataggattttattgaggctagggagttgacgctagtctttgtctctttgagtatgtgttaaggggtgtattcatggaggtgtcagatgtggtttgtgtccgtgagtgtggtgtgctggtggagtggtgtgtgcccgtgtaatgaaaaagaagaagaagaaatgcctgttgtagacggctgcaccttggtcgtacgcatctagtattaagaaacgacggccaaattgaatttgaactccggataagcttctaaccattttatgtgctgagtttggttagtttcacaccatataaaatgcattcgttatcatgcatagaaagaatgtgtctgtcttgctgttttatttatcctactctgtcaagtgactaaacttaatttttcagatgtctgcacgatatactgagcctcaaaatgtactcaagatgcatgatatagttcacgatcttgcaagtgtaattgcagctgatgaagtatgtatctttcatgccagtgactgcagtagctccaacactaaaaattgctgccgctacatgtacctcttgaatttgagtgaattttcccgagatcccatattgcccaatacagcaagagcgcttcatttcaaggattgcaggaaatctcccaagaattattcagaaactaaattcttgcgcatcttagatttcagtgcatgcaccatcaatgaactaccagactcgatcagtcatttgagtctattgaagtacttgaatgtttcaggcctaagtggcacattacctaaatcgttgagtaaactacatcacctgcaagcattgaccctgtcaacaaacattgaccttgttgagctcccttcctacatttgtgagtttctcaagctacagtatttggatctacatggctgctcaaaactgaaaaaactaccagatggcattcacaaacataaagagctccaacacctgaacctatcagactgtacaagtctagaatcacttcctttattcagttcacagtctggtgggcttcaaaaactttcattccttaatgtatcacattgttctcaacttgtaaagctgtcgttcctcgaagaaaaacttgagaagcagcctgatcattatctgccaaacatggtacatctaaatatgtcattttgccccaagctgcaagaactgcctactggattatttaagcacatgaggaagcttctttttttgaatttctctggttgtacctctcttgaggatcttcctgaatttgtagagcacgacgctggctgctcgatgttggaggttttggatttatcgggttgtgctaaactgcctgccctccctgagtcttcaactgaactccgtgaactccggtgtttgaatctttcaggctgttctaaacttcaaaactttttgaagttgattccacgatggaagtttggtacattagagtacctcaacatctcgggggttggcgcaaaaagtgattctgaggcaccaggtacctctgcagaagaccaaagttcacaagatcccattaaagagttagagttgggtatgctgcaggaagatatcatcacccaaggcttgtttcgtctgaagtacctgtccattggaggattcactctctactcggagcaaggtattgcaagaatggtggaccttctgacactgcccaattttaatgtacgcctgcaagatgatgggaggtgcagcaatattttgatcctccagcaaatccttgatgttacacatcgtcaactcaatatcaagtgcctagagaatgtggtgttttcagaggaagcgaagcagcttgaactggacaggatgcgacagtttcattcgttgggtttcgaatggtctttatctggtatggtatcttctgttaaacaacgagcagtgctgggtaatttgaggcctcataggaatttacagtccctctctataaaaggttacatttgcaccgaatttcctgattggattaacaagataaatgatacactcccagacttggtgaaacttgtattctctgatatcaatggttgtaactatatcccaattagtcaattaccaaatttaaaagagctagaaattaataatatgccccggcttaacaagatatatggtacgctcccaaacctggtgaaacttatattgtctcatatcgagagatgcgaccatatccctgtacttggtaatttaccaaatctacaagagctagaaatctataatatgccccagcttcatgatgcacgaattgggccatgcaataagctaagaagactgacactggtaggactaccaaatgaggccacggtacatttattttatgatatctgtacacacacagaagtacagatggtggaatcaagtcatggctgcgatgaagagatgacagaaacaggacaagagttcaacacattacctggctgttcttttcgtaaaaacgaagtgagaagaagtgaggaactttctagaggcccatccactgaaaagggcaaggtaaagaattggtttgacgctctattattatctattggaggagcaagggcaaagaaaacattggcctcagcattgtcccacatttcactagtgccagaagagtcccagttgtcaccaaaactgtctcatggttgtttggaggtcacaagtgcagcgctccccgaacttgattacctacaaattggaagttgccatgacctgaaactgcatcccactcccccaaagagcaaagagtacttcgtcaaagatagcagtctcagtctgcctgtagacaaggaagatacttcaagttttccatcacgtccatatgatcagtatactgaaggatgctcacattcaggacaaggtactgcgatccctccacacgaacatgctatgcagaagtcgatccctagattgaaatcaaaactgcatatcgaaggctcacgagatcaacttcgccaatggacagaacttctaagcacccacttggacgagttgactatcactgacccattgttttacaattcgaagtatttagaggaagagagcacagttagtgaacatgattccctggagagcatctatggtctgccacagtcatgcattgccaacttggagaaaataaatttaccgccatctcatcaatatggactagaagaatgttctaactatgataatattgtggactttgtaggtagaattgattctcaggttccgtatatcaatattggaaaggtatgtagtttctttgtttctagcagtaccaagcaaatttactgttaagtctagtagatgtcaagggtattagaatactttcccttctcttgtgtacataatatatatgctatttagggctaaatcaatgcactgttgaaaatccccaattcactaaaattaacatgatatgagagcaccggatttctttattccggctagatatggcaaataggaattccccgtcgaggaatgcatccccatccctgctcccgcgaaatacaatggggaaaacttgttcctatctccgcgggaattaatccccgtagggtctacatccctgcttaaaacaatatatagatgtgaaattctatatgcaatgcaacacatatattcacactttatattaatatagcaacttatacccactaatacatatgataaaaacacaagattaatcacataagataagtaaacaaattaaacttggaccgaaaattaaacttgaaccctatgcgggtctctgtaggggacggggacggggacggggaatggaggatcaccccatcccacgaaacctaacaggacatgattcctaccatttaattcccatgaactaattctaaccttccccctaatagagggatatatttggttgcaagggtgggatggatcaggataggttggaccttttttaggtttggttttgggatgggtgggataggatggttctcttaggtagtgtttggttggagggatatcccgggatgggatgggatgatccccaaaaccaagtgtttggttgagagattaagagggataggatggttccaaaaagagaatattcctccaatattcgggacgatctcatccgcgaaaatctggcggacggcgccatcccacttcgcacgcgcgcggtaaccctctggcctaccttttttttcaccgcacccctttcctttctccttctctcaccggcggcgggagcatgtgtttggtttcatgactaagtgggatgggatgaagccatccctggttttggggttggaatcatccactcatctgtttagttcacgggatgggcttatcctagttttttgtttggttgaacggatgagagagggatgggatggacaccgtttgcagccaccgtcaacaattgccaagtgggcgtaggagtggcgaccaggcagaggagcgtgtgcggcgtgggctcgcgacagcgggtgggcacggctcgcgagcaagcctgcgacgagaaggcggaggagtggctgacgctggctcacgagcaagcaggcagaggtgcagcgcgggctcctagcaggcgggcggcgagcgcggccgaggagcgcaagcatgcgggcgataagcaagcggaggagtgctcgcgggttggcggcgagcaggcgaaggagcggcagccggcggctgggtacgcgagccacggaggagctcggtgatggtcggagaagtgggcgagcaggcggacgactagcgacgaccgacggtcaagagaagctgcagcggtgactgacaagcaggcgacgatgattggcgtgcgggtaggcagacgtcgggcgggcgagtgaagtagcggcgcacggttcacaccgtgcgcccgtcgaagtgggtcgagatgatcagctcgattttgccgggcgctttggacctggatctaacaggaatattcctcgagaactccccgcgagacaggggcggacctaggccttgggccacctggaccgtgacccgaggcctaggtgtgaaggcccattaggatggtattttttccaccatgtaaacagaacacaaggcctaagtccatcatcttcattcttgtttactcgctgcactgcttgctgctgctgctctccagcacacagcttattgttcatcatgtcactacttctagactagtggagttgatatgccactgctatttgggccagcttggctattattctagctggtagcttctttggacatcctatcatgcatatctagtgcttcaaggctgatgcaatctgctggctgttacatcccactaagtatggcattctgctacaaacatatctactagtattccttctttgctaatacgttagtgtaattgagcatgctgctagtgttattcgctatttcaagtcaattacaatctactgaatccatccaagtgcactgcatctctactagtttacttgtgtcttttgctagtatgttgcaatgtccaatagtttccatcctgtctaccaagtccattgcatcatggtatttttgatggcatattattatttcaatatgaattatccctacaatcttcagctatgataataggatttaaaaagtaattagtgctccgtctttctacttgacaggggagccttctcagagtgtataattagtataggtattaaaaagaatggatttaaattacccaataacaaacacaaagatggctctgccatcactgctccggagatttgcggatagttgaagcgttgatactggtctcatgcataatcgatctatataacctggctaaagctcaagcgtgctgctttgaggatgcacacgtattacaaatacatgcaagcttccagccttccatgcgggtggtcacataaaaagaaacatataatgtaatgcctgcgcaggtgcataagctatcaaattgatgtgctttttacagcagatagctgtggctgctattatacttactagcaatgttcgtttgggatttaaaaaaatggtagttgtgtttacagattatgcctatgtctaaaaatgcaggtgggcactttttccgtaaaaccaattgaggaaggaggaatattctgctcaagtaacattccattactgtataaacactatgacggacaaagtagcagcctggtcattaaaaatcttgagaatttgaagggatcactgggtgaagtccaagagttggcgaagtatcagcaagttcgtttggtgtggtccagaagcaatttcattgaggattcaagcatggctgaggacaaggcagttctccaaaaactccgaccccaccacgacctggaaacaattgaaatagaaggctatcggggtgatgaattttgctattggatgatgaatataaattcttcccttccaaatcttgtgactgttaaactgtctaacatcgcaaactgtcaatgtcttcctccacttggccaattagcaaatctggaagtattgcacatctcagatatgcctagcgtcagaaaagtggacggtcatgtttacggcactgagaaaccattcaggaaattgagagaacttgaacttagtactatgaagaacctagaggaatggttaaccactacactactactaacaggtcacaatgaccatcagctttcacgaagcgaagaagttttccctaatctccaggttcttctcattgcaaattgtcccaggatgagatttgttccaggtttccctagaagtcgggagtgtaccctcgagaaaagctacagcatactattatcatttgaacagttcatcggaagctcaaacttggccttgatcgcactgaaaataaatgactctggctcatcatctgatatcgtgaaatttcttcaaggctgtgtaaatctgttgtatttgactattgattcctgcatcgatctaatcaccttgccagaacctatcaaaaactgccactgcctcaggaaacttgagataacgaactgctggaacttttctgtattaccggagtggttgggagaactaactttcctgcagaagctagatattcaagcaagcaaactggaatatttgccacaatccatccaacgcctgactgccttggaacggttggtgctcaacaagtgcaactacaaactgcgtgaacggtgcacatctagagaggataaagaaaagattaaacatatcaaaacaattgatatgaatgaggtaactccgactctggatcggtaaattattttgtagaggtgcaattccatcggtggagcagtgtggaactgtggatggaggggatagagagaagagatatgggagagttgacatgtgggaccaagggtatttctaacaattcacatgatttttttcctatccaaccagaaatgattattttaataggggcagtgtccaccatcaaatatccaacttgagagcgtcttcccccaaaacttcacttacagtgtccttcagctaaaactacgaagttacaacgccttgtatcaaaatttgccttataaaaaaatagtaatgcaaaaattttaaaacgtgtgcacaaacttctattatgtgctagtaggctagataaaaaaaattcacagctttttgaatcttccagtggtcaaccaattgtcaactcttacacgtatattagggcattttaggctttcttttagaaggtatttggtatatggcatattaaagaaactatggataaacttggtagtatattatagaagggacaaagttgatgacaaaccatgaatcagtgcaaactcaatggcatagtaaaaacatcattacatgaccggttgcaccggcctaagccaacctcaagctacctccagtctaactacgcctccttggtgttagatcgtggttgctctgcactacgcccactcaaacacttgttcacaaccattgttcttatttacaccttaggactttatttcatcacaactatgattaactatgtatataatcatggtgtcaaccccaacgtgtggtccagttcccgatggcacacatctgctttagttttttggtttagatacttggagtcttataagatttgaccaatcatataaccaaaatggtaaagtatttaatttgtgattggagtgactagcatacattgggtatcctatgctagatgtacaaactatttatatgcaaactaccatgatatatctctatggtgattcaacttcaactcatttattgattaataatgtttccaaccattctgtgtgtatgttaacattaaccattggaggtcatttacacctactcccttcattttaaattacttttcgttttagttctatccatagtcaaaacattcttaatgttaaccatcaagttctagaaagatatatagtttaagattcactatgagaaactctcatatgagtaatgcatatttcgcatgttgttaattaaactatgtaaatttctagaaattgatggctaaagttaggaatatttgactttaagacaaagaaaaacgacatgtaatttgaaatggagagagtatgtataaactaacttagatgcaggtcaagcttacatcattacggcaagttcaccatcatttatatcttctttttttcctaattgtaggtccctttgatgtacttgactccaagctatataatgcttcttcagcaagttactagttctcaatttatcgatctgcatattggtggtctggaatgtatgattggcttgagggagatggagaacttagaattacagacaaaaaaggagttatcctcgttgagtttggagtggtcatatgcctatgctgattccagcgataaatacgcctcttctgagagagggatgcagaatagggctgtttttgaaaagctccagcctcatgatagccttgaaatactttgcataaagaactatgctggtgttgatttccctcgttggatgtctttactcccaaatcttgtgcaattgaagatagttggcatgcaatttgaatatctacaccttgatcagtttcagaacctcaaagagctgtttctctccagagtgcaatttgcgcatctccacctgaatggtctgcagaacctcatagaattgtctctctctggcctaaaatttggacatctccacatcgatcagttacagaacctcagagagctgaaagtctccggtgtggaatttcaacatctccaccttgaacggttacagaacattacagagttgaaactctctgaagagcgatttgaacggctccatattgatcagttacagaacctcaaagagctgaaattctccagtgtggaatttggacatctccatcttgagcggttacagagcatcacaaagctggaactctgtaaaaaacaatttgaacatctccaccttgttcagttagagaacctccgacagttgtatctcttcaccgtgaaatttgagtgtgtcgttttgcatcagttacagaaccttgaggagctgcatctttcacagatagaaagccaaaagtctaacaaaccggtttgcatcgagtgtagccaaccacttaggaagctccaaaagattgtcatgaccaaaataataaacaaagggttacaaatatccgtgcaaggaggagagggtgacaaaaatttattcccgggtcttcagcatttggaaatggaattatgtgagaatttaagattccaaccatccatcccgaggagcacccattacatcatatcaggggaaatatatttcgataaatttaattaccgtagaatattgggttcgttcctgttcccatcgttcaagcaagtcatggggacatcaatccctggatcaacatccaggatggaaatcaagaacaccagtggtctatcttccgaaagatggaagagcattccgcacctcgagcttctaaacatcacagaactaacaatagacaaatgtgttgatagttgtccagtgccaaagtgcatcctgggctggaagtccctccagaagcttgagatacggagatgcgaggatattgaattgcttccagaatggttgggagagatgtcctgtctcactgagctcatagtggagacctactggatggaagctttgcatccatgcatccggcggctcacaaatttgcagagcctgacacttataacatgcttgaataggtttaaagaaagatgcaagtcaggagatgactggatcaatatcaagcacattccgcatatacaaattacagatagaaatgggcgtacggagatcatttcaccaagttgtacctaacttctaacatccgctgaaaacaaaggtacaccggatactctgctgtttttatacctcatgcttccactgtaggccatgcaatagctcaagctaagaattttgtataagaaaacaacagcagcaggaagttttttttttttttgtgtataagacaatgcgaaacatctacgtaccattgtttatttcttatgacggccttacgaggcagcaacatctcttttggactaggacattatttgtacccaatttaatacttgatactatatgccttgtgttttctttgtgcaatcatagatgaattttgttagaataaaaaaatagatgaactttgatctcttgtattaacatccatcatattgaattattgagtttgtaagcttttactgagattagctgtgttattttccattgacaatgtgacaacctgcagttcttgtgcgtgtttggaacgaagtaactaattgctatactacgttgcagttattcattaccaatagccactcaccaattgtttgataatctcatgcagcattagtttcgacagagagagaaaagaaaattgaggagctagctgatcagttgctgggacagtatatagcaggaagatattaaccggacagcccatcagcccagagtgtaagttaatggaataatcttttgccattaatatcatgtacacatgtaaattagtgatcatgcgtgacaatggtgctctgttttcttcagttgccgatcaaggatcttaactacatgtctacatggtactgtcaaggctctatgatgaatagattgtttatctctgtgcgtgcaagcctttctgctgcatattgtacaaacgaagcctcgctgttccatagtatgctgaggacttgtgttaggttgtatgctgaatagtgaatacatatactccgtaccaaatgttaaccagctggttttcccgtacaattacacgaaccatttgaaagtaattgtagctgctgtggaattatttctgatggacaacgtactcgtacattttcatctatcagcatacatggttgtaatctggtcatcatgctttgttctagattaatgccttactctgattagcgtggtgatttcgaggccttaataatgaacatggaggctccacagcattatttcctttttgtggccaagcatgatttaacctgaggacaaaatgtcaaaggcctaacgtacgtatggcaacagaggatgagatgaaggccttgtttagttcccaaatttttttcttaaaaacgtcacatcgaatctttggacacatgcatggaacattaaatatagattaaaaaagctaattgcacaatttgcatagaaatcgcgagacgaatctttttaagcctaattattccatgattagccataaatattagagtaacccacgtatactaatgacggattaattaagcttaataaattcgtctcatggtttccaggcaagttatgaaattagttttttcattcgtatcaaaaaactccttccggcatccggtcaaatgtctgatgtgacaccaaaaaatttctttttcgcaaactaaacaaggccgaagagcaagatacgaagcccatattccatgccttgaccgagaccatcaagctactccaccgtgctaaaatataaaagatattggatgatgtgacacattctaatattatgaatctgaacagtttttatgtccagatttatagtactagaatatgtcacattcacccaaaatattcttacattttgggacggagggagtaaaagagaatccacaaaacaacatcatcggtgcgaatcgctgtaatggctaatgatccatacatactcctttcgttccagaaaaaacgaatctatgactggatgtgacacattctattgctacgaatctggacatacatttatccagaatcagattcgtagcactaaaatatgtcatatccagtactagaatggttttttatgagacggagggagtacatgtctgtcgatactacaacaagttttctctcggagcagcttttaattggttcgtgtaatttcttgtcaattactcctttcctttcaggctgtcaattactccctccgttttaggttataagacgttttgactttggtcaaagtcaaactgtttcaagtttgactaa

SEQ ID NO: 9428 - DNA, 5066 bp, Oryza sativa
  unsure (1)..(5066): unsure at all n locations
agtttgactttaaccaaagtaaaaacatctaataacctaaaatggagggagtaacttttgtcccaaagaaccgaactgccaatggaatggcagaaaggaaaacagggggcgaaaaatgtactatgtgattagggcgttcacggtggacttacgtgacgttcagcctcgccctccctagtctgcaaaggaaaaagcacacgccacgtttgcttctgggcccaaaaaaaagtttttgtgtccaaagtttgccaccgggttcttggaagaagctactcatttgtgtggagagaagctaatagtactagtactcatttgggtgagaagaaaaaggagagagataaaaagtaaaaagtttgtcaccggtgagacccactactagtatttgcactgtgaagtatgaagcttacgaggttctttatctacgtggcatacgagcaatggcaaaaatcggtgacacactgtgattgcccttagataggaaactgggtgtggaatcggcagcgtactgactgccaagtccacgacgtcggtcgtactggtttgattccacgaggcggccgactgggtcagtccacaataatcgtgtataatactatcgtgtaccgctaaagagacgcgatcacgcgaacgaagaatgacttgtcccgattccaggtgcgaaatcgatttcctgatatattttttttctctcgctggttgtcgttcatggtttcatcggagctgttgaacgcgtaatcgatggaacggaatgccatccgatccatccaagccagcctgctgcggacttgccgtgttttgtcaccgtggaatggtggactccaaggcgatggatccatcgtgcagccgtgcatgaggtgatcactgcatcttttggcttatgcctatactcgccagccaaatttaaaatttttaatcttaaatttaaagttgattttaagagtttttttattaaagtttatttttcagtctttacttatagattgataagaacacatatatagaagttttgataagaacacatatatagaagtttcatttcaggtctccaagtcgacaacggttagatgtgttattccaaatattgtactagtgtgattatgatgaataagagcaacaccggcttcagccaacagaagtaacgctattacctatcagataagaggcctgaatctgtataaaaatcattgtctccgtctcttttacttcaatctcgtatataccctggtaacaacgatccctacagtatgcaaaatatcgtagttacgatctcaaacatcggcaataattattaatgttttagacaaagatatagttttcaaaatatgtctttcactatacctaaatgtgtgtttatttttattataatactgtatttgtctttaaactgaatatttttaagttataaaaatttaaattaaaccttatctaaatcattaaaaattatgaaaccagaggagggagtagctcgttaactcctagccaagtaagacttttactgctgttaaggttaggacaaggagagtcgctcattatccactctagagttgtgcagaaaaagaccgaactgaaaagactgagattgagaccgagaaattgggtgaaataccaaattttgttcggtcaatttggttagtctccttaagtgaatagacgaaaaaaccgaattaacaaaatatgtctaaatgcaacctacaatccactaagttcaataggattaaactctaattttcatatccatacttcttctaggcatgcaacataataaaagtctttactcatacgtgcttacggtttttttatttttatttttgtgttgaaaatttccattatttctttgcatatataaaaacgttgttaaatttcggtcagaaccgagaccgagattgaatttatcggtcctgatatttttacattgaatcaaaatgaccgaaaaaccgacaccgaatacccaccctgttccaccctttccattatgcatccaacggtgatgtgctaaacttgcagtcactgtggggattttccttctttttttcagccaatcacagtggagtttcccgtttcaccaccaaccttcgtctccgccgcctccgcctctctccttccccctcgttctccgcttccacccaaaccaaacccaaacccaacttgcgaaaccccaacgaatcccccccaaaacacccacccagtcaaacactccccaactccgatccccacccccatggcgtcggagatcgaggtgctcgaggacaccaccaccacgatggccgcctccgccgcccccgtggcgcccgcgtccccatccccatcccccgccgccgctgccgacggcgaggagggggaggggccggcccctgcggcggaggacgactcgctgaagaacgacgtgtacacggcggcggcgtacggcgatctggagaagctgcagcggctagtggagggggagggccacccggtcacggagcccgacggcctcggctaccacgcgctccagtgggccgccctcaacaaccgcgtcgccgccgcgcagtacatcctcgaggttttcccccctcctgcttcccgcccgagcgtctcgcgatttggctggccttcgtgtagtcgttgtttgctagctagcgagggatttgggtgggggtttggtaggatgcgtcatcaaccaatgcactttatgagccgcaattttatatgtttttgaaccgtggactgtttgttgttatactgtgttggctaggtgtattcacttttagctcattggctggtgttttggataccaaattaccagtgcctgtggttgaattactccaggtttgtgaacaattttgttggtggccaactgcattaggtgaatatggagggtttgggactgctgcaagctgttatagctggaaattgatgtgcttttagtaggtttcggatgtttatatgacctggagatgatgccagtttttcagtatctcattttgtatgttgtaggcttgaatagaaatggaactagtgagactgtgctttggtttatccctgaattttcatatggatgtatgtttattttttccattggatcattgagaatgtggacatgcttactgctggataaagcagatgagaattcagctggcctgtgcagcgcccttgaggtgtttccgtttaagtcttcttttccttttaatcttaagatcatgagtgtatggtaggctcagtatagtctgaataagaaaggttactaattgtgtgcctactaagtgcatgaataaactcgcacataacatgcatactttgatggtaccaggaatttatcttgattgtggtatgtagtcagagtatgttattctctgcatgtagacgaagtatcactatgctattcagtgagcgcattctgcacatataattttgtttgaccggactatgattttgtgcttggtctttgaacagcatggagcagatgtaaatgctgtggaccacactgggcaaacagcacttcactggagtgctgtacgtggacacatccaagttgctgagcttcttctgaaagaaggagctaaggtggatgttgctgatttatacggttatcaggtctgaatttgacttcccttctgtattttggtccctgttttcctggtttgttgctttggttgtccaatgttggttcatgattctgaaagacaactaagtattgttggatatttgtttgccaagttaactgttgtatccacactaggggatcagggatttccagtatataaataaataaataaataaataaataaatttaacctatgaattctctaggtaaaatgaaaagcaagaatcaacaacttttgtctatggcagtgaatttgttaaaaactctatactgctgtttgcaggcaacacatgttgcagcgcagtatggccagacagcatttatttatcatattgttgcgaagtggaatgctgatccagatgtccctgataatgatggaagaagcccactgcactggtttgtaccttgttctctacatttatcattatcttatgttgcactggagtagtagtttctaccagtgcacttagtaatgcatgtccccataaaccttcagtgccccttatatttctttctctctctctctgtttttttttggcatattaccttgtagggctgcttacaagggatttgcggattctatacgtctccttttgtatttggatgcttatagggggcggcaggataaagaaggcatgtgctaaatttatctatttccattattacctgtactgctgtgcacataacagtgtaaaccaatggcttagccatatctccaattatatcagtacacttcagagcatgagatttacttctttactacaatgctgcccctaggttgtacccctttacattgggctgctattagggggaacctggaggcatgcactgtgctagttcaggctggcaaaaaggatgacttgatggtgaaggataagactggtctaactccagcacagcttgctgctgataagagtcatcggcaagttgcattttttcttgtaagtaacatgaaccatggcatttctgtttttgtattatagccattcttttgtagagcccaatgcattaagccattaacagttcatctactagagattctgccaagttacttaatatgatttgcgtaatgatgtttactaataggaaacatttttcttcatcattttaggttttatattccttctgacttataaattctttagagctgagtttcatgtctccatgatgaggtgttattggtgtaattcactgattatgcataattgcatacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9429 - DNA, 869 bp, Oryza sativa
cataaatccaagtagtttccctaatggtactccgaagatgcacttttcagggtttaatttcatcctgaaagcgcggatgcttgcaaaggtttcttctaggtccgtgatcaaatcatctttctgcttggtcttgacgactacatcatccaaataagcttcaacgttgcgaccaatctgagttgaaaaacatctctggatcatgcgttgataagttgctcctgcattctttaatccgaaaggcatggtgatgtagcagtatgccccgaagggcgtgatgaataaagtctttaagcagtcggattcctttagtcggatctgatggtaacctgagtagcaatccaaaaagctgagaagctcgcagccggctattgagtcaactacctggtcaatgcgaggcaacccaaaaggatctttgggacaggacttgctgaagttagtgtagtcaacacacatgcgccattgtcccgttttcttctgaaccaggattgagttggccagccagtcgggatgaaggacttccttgatgaagcctgctgctaacagcttagggagttcttccttgatcgtatccttcctatcctgtgcaaagcggcggagtcattgcttgattggcttagcgtcttccttaacatgtaaagagtgctcaatcacctctctaggaataccaggcatatcggatggtttccacgcaaagatatctttattattttgaagaaaggtgatgagcgcgctttcctatttacaatctaactcaacgcctattacagcagtcttagtaggattagagggatctagaggaattttcttggtcttggcttcgctttctccactctttgggatcttggttgcaggcacttctccttcacttg

SEQ ID NO: 9430 - DNA, 673 bp, Oryza sativa
ttgaatccaactcgtaatatggaacaatgttagattaagagatcctatggataggaaacatctgtgtacatttttctacgagatgaaactggtatattttatattagtgtagatatagaaataagagaatagatgtatggggagtgagttcagtcaatgacaagtgggttgagatgagaccttgttaatcttaccattttgcagctagctcacattgtccaatagaaaacatacagtaactatatacgtctggttcagcactgaacccaacgaaccactgaccaacttggtgatgggtcgaccaccggtccagtttttttcactatggtgtccacgaaacactcgtccgcgtcaacaaaggtgggtgcatgtataaatagtcaaatgggccaccagacacgtcctggcccgagcatgactcgaggaccgaccaacttgtcatgacgtgccgtgcccgcccaccgactacacctacggcccaggcgcggcccaataaagcacaggttgtgccatgccagcacaaaggcacgatcagcccactgtgctcgtccttcaataaagtctattgtacctcactcatttctttggtccatgcctcatatggctggaataagtttattttacctccctcatctctttggacagtaccttatatggctggaataagtatatt

SEQ ID NO: 9431 - DNA, 248 bp, Oryza sativa
ccttaactttcgaggcaccaacgaggagccgaagacgcaacaacatctacttggcattcgccaaaggcagggggagtcgataagggagtacatgcgtcgcttcttgcaagcccggtgccaagttcaagacataaccgaggcgtcggttataaatgccacttcggccggtctgctcgaggacgaactcacaagaaaaatcaccaacaaggagcctcagacgctcgagcacctacttcgcatcattgacg

SEQ ID NO: 9432 - DNA, 675 bp, Oryza sativa
cacacgaacggacggccgagatcgaaccaatccaaaacggacggccgagatcgattgggtccacggcggctcacggcggacgaccccgataacgtcagcggtgacgtcaccgacagcggcggcggctcggcggaggagacggctcgaacggcgcacgctcgccggcgaacggcggcgcgaggacgcaaacggagggcaccaagacgaagcgggcggcacggcgaactgaccggcgaccaaaacgacggcggaaggtcaacggacggcgacggcgacgaggaggaagcggcgaagctcttcggcttgacgacggcgacgaagctccgacgatctccggcgacggcgaaggggcggacgaggacggcgacgacttggcgagcacgacggtggtcttcccgagcgacggcgacggctgaaacgacggcggcgcacggctggagcggcggcggcgacggcaaagctagggcacacggcgctagggcttttccgacgacgagaggcgaaggcgaaggtggcgacgggtagaggagacaccgggggtccttttaaaggggctcagaggcggcggcgaaggcccaaggcggcggcaacggcgaaggaaagctcggcttggagagagggaaaccgatccgtaacgaactcgattccacgaacttccaaaacgatttagccaaa

SEQ ID NO: 9433 - DNA, 365 bp, Oryza sativa
aagaaagatacgccgactacgtgagggagtggaagtaccaatcacaaggaccgtaagcgtaagcccgaggaacttgttgcaactactacacattcctcccgacaacgttcgcgcgtcaatacttttgacaagatcatgaactcccaatgtccgcatcatccaaattccaatcatgcggccaaagattgcttcgtctacaaacagtttgcagaacaaaacaccaagaatgcacgaaaggcctccgacggagatcaaagcatgtcaaaaaagaaggacgatgacgacgatgccccgataggttttcgagaccgtcgtaaggagctcaaccacatctttggcggacctctggcttatgaatctaaaag

SEQ ID NO: 9434 - DNA, 669 bp, Oryza sativa
cgggcgtccctcacccagcattactatctcacggccggtggcggattctggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttgcggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctg

SEQ ID NO: 9435 - DNA, 681 bp, Oryza sativa
  unsure (1)..(681): unsure at all n locations
attcctgcagcctccttccaagaggagaatctgctggatgtctaaccaaaccatcttgtgtgcgctcttcatcatgccatcttgttagagctgctgttctagagcatgcaaacaacctctgaaaccttctctttattggaaaatagcgaagaactttattaggaaccttgtgtatgcgtttgccatttagactcttgttttctgacttccatcttgaggtttcacattttggacaagagttggcattagcatcatccttccaataaaggatgcaatcatttttacatgcatgaatactaacatatccaagccgtaagcatttcactgttttcttagcttcattgtagttctttggtagtgctgaccctttagggaaagcttcaataagtagatttagtaatagatcaaaactcttatcagaccatcccccaagcaatttgatgtgtagtagtttaactatgaaatgcagctttgagaatttatcacaccctgngtacagttcttgcccataatcatctgacagcattttaagagcattcagatcttcatttgttacatctgaattaccctcatcctcaaattcccccctatcatctaagccacatgccaagtctcgaagcaaatcagagatgtcatcatgttcacttgactccacatccccaacctcatcatactcagcag

SEQ ID NO: 9436 - DNA, 686 bp, Oryza sativa
tcttattggctctttgggtgttgaggagaatgcgagggcaaaggacaacttgggcaaaaaggtcgagagaggttctagtgccaatatggtacaaaagaagaaccctcaagcatcccacaacaacaagaaagttaagcctgatgtcaaacccaaggctacaaccaattttaagaagaaaggcaagggaaaggcaaagggagactgctttgtgtctcgcaagtctgggcattgggccaaggactgtcctgaacgcaaagacaggaagtctgctaacatggtcattagcaagggcggaggaacatcggggtacggtaaaattttacctacagttctctctttttttcattcacctaattggtgggttgatattggtgctaatattcatgtatgtgctgatatttccctgttttcttcttatcaggtcgggagaggtttctccttgttgatgagaaaagggtcacttgcggctgttcatggtgttggtacggtcgatatgaagtttactttgggaaagaccgtgcagctgaagaacgtgcaacatgtcccttcaataaagaagattctagttagcggctctctactgtgtagagaaggttttagacttgtgtttgaatccaataaatgtgtcgtatctaaatatggaacttttattggaaaatgttatgacaacagaggcttgttccgct

SEQ ID NO: 9437 - DNA, 681 bp, Oryza sativa
gggataacttgtgccgatctcgtgtagtttgaatttttctcaataccaggtcgccgactaagaaggctagtgatcgaacgttatgattatgataacggcgcaacccttgcaagtatcgagccgactgaattaaggctgcttcgagggcctcttccagtcagttcaaatcatctactcggtcttctccgtagcgctcctcgttaaagttgcgaaaacgtaaagattcaaattccacctcactgggccacattgcttccgctccataaactaagaaaaacggcgactggcccatggcccgactgggagtggtgcgcaaggaccaaagtacagacggcagctgttctacccacttgctggcatagggattcagtcggtcgaaaactcgtgcctttattccttggagcaccatgccattagcgcgttcgacttgtccattgctcatagggtgcgctacggaggcataacaaattttaatgccgaagtcttcacaaaagtctttaaatactccgccagcgaattgagtgccattatccgtgatgatccgattaggtaccccaaaccggtgcacaatgttgatgaaaaaatctctagccttgtctgtcatgtttgtgatgaccggtttagcttcaatccacttggagaatttgtcaatagccacaaagaggtgagtataaccgccga

SEQ ID NO: 9438 - DNA, 658 bp, Oryza sativa
ccaaacaaatcgagaaacttaaccacatgtgcatgcatctcctgatcaactcatcccccctttacttaatcatctaaaccttctttcagaacttttgccacggtataaagggtatgatattttcatgcccacaaagatgcagcttaatttaacatacactcacctccaccacaggcagcgcatcagtccaactccctgacttaataatctaaccttcttccgctgcctgatgcttgccctcgctgacccagccgccgccatcagctggcgcacgtggccaggagttaggcggagggggacggcgacagcggcgcataagttgatgagacctgaggtagggcaattgtaggtgagcgagccgacggcgtggaggagaggtgattctagtccaatggagacgagatggggagaagggaaatcacggccagagaaaggcgaaccgtcctgctcgatgactccgctcaccctaactgagccttctcacaatgcgcctggagccgagcggcctgaaccggatcccgactccatccacgcgtcgggcatccgactcgggattgcagggattggggtttgcagctggtatccacaacgtgcgcaggcgtgaggagacgtgcggagtggtgggtcccacgcagagtgggagagtgctaattggatg

SEQ ID NO: 9439 - DNA, 673 bp, Oryza sativa
gggccgaaggcggttgtgatggcgcagatgtggaagcgaatggtcctcctccatcttcggccacgggcgccgaaggctctgctccctcctcggcggccatgtccggtccggcgttgctttccttccaccttgcaaccttctccttcacgaccttcttcggtggcattcgctctcagtggtttcgctcggaggtccccacggtcggcgccagctgttgtcgaaatgactaccgcatacgtcgaaagacgtggttactcaacggtggtaggaagaaaacgaagtgtattaaattttgagtttcccttctttcctttttttcccattacatggccctaggggactatttatagccctattacaggttcttactactagggtttaggttatacaagggaatttacatgattacccttatgaaagggacatttacaggggtacataatgatataggggctcatgggcccctgatgggccgtctggcgatcgccggccctattgcccctaggcttgataggccgaaaaggcttcttcggcccttgcgggggtgaacttgccaacgcgaagtcatcttccttcggcagatagtcttcgccttgcacccttcgcctgagacgcctctggcctggcaaggcactcgtacgactcttcgccttccgccgttcttgccccatag

SEQ ID NO: 9440 - DNA, 658 bp, Oryza sativa
acgtcggcgtgagcgccaccgcggtggcgccgcacacgatccacgactgctgcacgtagaggccgagcacgtccagccgcccggcgcccaccgcctgcccgcacagcgtgtccagcgcgcaccccatgccaaactgccatggacgcgcatctcacgtcatcggtaccgtccgcgacggctagcggcggcggccggccggaatgaacaatgccgaaagaaagctcgaggctacgtaccaggacgccgtaggcgaagccctccaggatgctctcgacggcggtgaccgcggcgagctcgaccacgccgaggtggccgacgaagctggccgtgacgaagccgatggagaactggagcaactcgacgagcacggccgggaaggcgacgcgccacagcagcttcgactcctgccagctccggctcacaagaccttgcccctccatgctcaccgtaccacgtataccaccactattatttacagctttaccaccatctgcatcttgcaacaaacaaggagagcatgtgatgagtttgttgggaaatggccgtggtcctagctagcttcctcatcctaattattgtcagataatggatataatatcataggaagattatcataaccagtaagaggtgtgcaggtcatcttccagcagagcatatt

SEQ ID NO: 9441 - DNA, 1187 bp, Oryza sativa
  unsure (1)..(1187): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgtgttcggcagctgcgaggcgggcgactaagtcgctttcgcccgtagccgccccgccgctgcgcttcctcgcatccagctccttttctcgcgtctcgaggttagcagcctgttgctccagcgcggctctctcggcgcggatgcattccagattgcggcgcgcctgctcctcgtgcggtgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgg

SEQ ID NO: 9442 - DNA, 297 bp, Oryza sativa
gcattgttggttgtgtcgaactgcagtcttgctacgtaccgaatcggcacaccattcggcaaaaataggactgccgcaatgcctgctcccctgtgcgaccacgagccgtctgagcacatcacccagaattgttcggcgggctcggggtcgggggcaagtaccggtgtccattcagctacgaagtcggctagcatttaagacttgatagcagagcgtgcaacaaaatttaagtcgaacggggatagctctgtcgcccacttgctgagccggccagtgacttccttgcctcggagtatt

SEQ ID NO: 9443 - DNA, 452 bp, Oryza sativa
cgctttggctcagtgactgcaagccagctgctactccttatgatcctagcgtgctattaaggaaaaaccgaagaatatcaagggattaactgagatactcccaaatcattggttcattgatgtacttggctagtgcaacgaggcctgacatatcatttgctgtaagcaagctgagccggtttgtctcaaatccgggagatgatcattgacaggctctggaaagagtaatgcgctatctaaatgacactataagctatggaattcacactaccgggtacccaaaagtactggaagggtatagtgactcaaactggatatatgatgctgatgagataaaggccacaagtggatatgtgttcacacttggaggtggtgctgtcacttggaagtcttgcaagcagatcattttaacgaggtcaacaatggaagcagaacttacagcactagatact

SEQ ID NO: 9444 - DNA, 5394 bp, Oryza sativa
cagcacgcgagagcgcgcgctccaccgcgtgaatcccgcgctcatctgcacgcatccagtccgaagcctccacgcgtcccaccgagccgctcccacgcgcgctcgctaaatcgcacgtgggtcccacgcgtacggctcctgcctccgagccgtgcaaaacagcgtggaccccgtgcctgcgcgcgccgaattgcttgtcgccgcgtgtccgcgcatggtgccgatgccgtgggccgtcgtcttctcttgggcctgctcggcctggcctccctgccagccaagcactcgggcctagagctagggatgaaaacggagcggatacggatggataatgctcataccatattcgttttcatatttttttaccggatacgaaaacgaatacggatagctcgaatacggaaacaaatacggattatctcgaatacgaataagaatcgaatatgatcggacatgaatacggaaacaattttttctcagaacacgaaaaccaactcaacttctaatagaaacaaatatcaacatatataattagctcattttatataaaatgaggtataatttataaatattttttaaaatttaaataatattaatagtatggactagtgttaagagataaactactattaaaatctataaagatatattgaaggttatagagttagaaagatatggggtatgtctcatgggtcctgcggatatccgaatagcactgttcaccggatatccgaattattatccgtatccgatggaaaccctggtaccatattcgtattcatatccgggagaaaatatccgtattcgtatccatatccgaactatccgagaattatctgatccgaaaggtatccgtatccgtttttgtccagaacggacggaaactatccgcttagttttcatccctacctggagccaatcaggcgttggcttggcttccgtcccaacagagcccatgtgcaagctagctagccaatcagctagctgcacttgccatctcatgcacacgccagcgcatgcctgcatgctacagtacttagtactgtagctcctcttctattctccattttcttcgtgaacccggcacttgcacacttgaccttgtgaagcccgttgtgaagtcttcccgacacggtgttcgtccaccgtgcgtcaccttgatctcaaccttgtcacacggattcgtcgatcgttctggacctcaactccccctgagtctagtcccaatccgccgtctacccaggctgaccatcagggatcatgacgtcagtcccaccttgtcacatggcctcttgaccgtgctagacctctgctcctccctgagtatagtcccggtcctcgccattgaccgcggttgacttcgatcacctgcacacacgtaaatcaaatatccgattctgggcacagatatcgtaacctgacctacgttagtcataagcattgtcgcctaaaatcgccaacaatccaaaccaaatttcttactcaaaccaactcatggttaaatatttcgttgccaattttccatcacgaataaaccaaaatcacacttggttttacatagatcatgcatacgtcattagtccatgatacgtggttttgtcaggcttaaacgggcattatcaggttcgtgcgaacagaactaattccatcatgtaccataatccatttcgttatcttctgatggtaggtgattgctactagtagtactattttctagtactcctgctcgagatatcaatcaatagaaattaggtgcaagcctttagtgcaagactagtacatctctgaattctaatgcaccgataatagccatgcataggtgcagaccataccgtcctcttctcccaacccaaccgattgatctgacagtgctcttgcaacaaactcaaaatgttcagggtagttaacaacatgatctcctggctgtcagtatgcaggggatggtcctttttgctgacatgctctccatatgaccaaatcaacaagtataattcaagtctgcatattactagccagtaacttttgctgatggagtagtttatatgtagttatgtatagtactgatcagtattcagtactagtacagtagtaaagtttctatgatccgcctgtaagacacatcaaagagatcagaaaagagtacagattgaacaacctgctactctgctagtagtgctgcactctgctctgcaccgtcgccgacgtcgttctccagtccgctgttcactggatccaaaatgacgagtttcgctattgcattggtgcgagctgcgaactgcaacaccagacttatataaatggaaggccaacggcaaaatcactcgtgctgcgtgtaactgtgccgcctccaactgatcgtctggtagctgcccgtgggccgtggccaagtcgtgggaggccgtcgcgacgtcgccgtggggcattttcaaggtgagccgctacgcgttgaattatctagatcgatcggcacgacgcccgtacgggccaccgacggataatcggataggcaacggaagcaggatgatataatatggtatcttgaggtcagaaatatgattcctggtcagattaagttctccaagtaaggaattgaatatgtttgctcatgtatcgcaaatcagctagctggaatattatactggcatttgcttctcaactaaaggtttcaatattgaactaaatctctagattccacattttgtaaagctgtatcgatcaagaaccagatcaggtgctgatcacactagtttggtttatgggctgatcaggtgctgagttgccatcctgaaactagcctaacagtgaagtatagcatagggttataagtgtggccgcctctgtttcggcatttggttgttgagcttaattcgtgtaggtaccttgagactgtgtagaagttcaggcgaacagtacagggagggggccgtttggactgagtagggagttgcaagtctgcatgagcaatggcagcatggacacatgcatcgtccatgcgtggcggcgccgacgcccacgtacattttgtttggtggattggaacagcgacagcttcagaattacgtttcgctcaattgtacacagttcgtttcgatatatcttacactgtcaattagccggcttaaatacataattaaggaacgtgtccttcgcgtcaatgtactgagcagtgagcacgtacgcatcttgcaccttaaagtagaaccactagttagcaccttgcaccttacccccagtaaagaattacattttaatcacataaaagaaaaacaatgcttcctccgtttcacaatgtaaatcattctagcatttcccacatacatatctatctatattcattaacatcaatatatatatgggaaatattaaaatgacttacattgtgaaacggaggaagtacctactttgagaataatgtgggagaattactcggactcgaacaagactcaaccaaagactgttaagaacagaatacaggagaacctagggtataaaggcctagcaccagaaggaagatggaggaggaactgaacagaacaacaatctactcaaaccttgatgctcacaaatcccaccgcgatatccagccttcgatccatcaagagccaccggagccgagttttcatatgtccgaccaacatctcgttaaaattcctagcaagactagcacataggcttaggataggcacatatatcaataaaagtaataggcctacccaaaccaataggacgtagggttattatttcgagtaggccctaaacttgtataaaaatgccacgcgtcggactaccatacctcacacaagaaataagacacacaaacaagattcaggtcttataagtttctattgtcaggatttttatcaacaacagcttgagccacggtcaagctaggtttgcacaacataatctagcttagttagcatttgtttctccaaccaagcctagcaacttagtttgcaaaagtttaactaggtgtgctttttaaccatcgattcatctgttggcctacatcatgatgctatagctagtcataaaaaaatgtataaatcatctcctctttcctcctcatcgctccctcccgagctcagctgatgtggcagcgacggcagagttggcgctagagaagagaggagaggaggcagcggcaccaaatctagtgcagtgttggcgctcatgacttggcaggagacaagggctaccaggtgcagcctttggggaggaaatgagagacgacggagttgcattggggttcaagttcgacatggggagacccaacaagaagttggcaacccatggtgctcttcttctagaggatgaatacgtgattgtatggtggcttcttccgaaccgcgttggttggcaagaaggatgaagtagcaagcgacttttggcccgatacctatatatggccagcgtggttgggcgagacacaagtgctacaatgacgaggagctggataccagttgcattagagatagttatgtggctttgcctcttcaaattttacattttggagtgagatgcaagtccattgaagattgcctatgaatgcaattgacataatcaacctactgcagtaaaaagacactgctctattaatttgagaggcaaaataagcatcaacctatcgtcgtcctggctactatctagatctatatataaattgcacagtgaaagtttgttcgaagtataaaggtctacgaagctacttcctccatccaaaataaaaacatttctgaagttagacataggcatgaagaaagtatgtgtaaatgattaaaataaggttataattagttgagaaataaaaataagtgaggaaaataaatggagaatagttatggttggttgagatgaggggtgtagatggagaaatagttttattttgaaacaaattaaacttgagtggtagaaatatgttcattttgagactttgggcacctttgtatacatttatacgcctcaccataaaccattcatggctgggaatggtttatgaaccgatctcctgtagacgctaatgttatcagatctccgcatggatcatgaactactcgcacttataattaattttttttgcggggaattaattaattcgttcttgcccccgtcttctgtgtcaagaaatcaagatggtgaccatgacgggccctttaatttgccatgtgagcccgcgactgtgaccatctgattctgaatcaatttttgttggtctaatgccagtcgtatcccgtatccgtttgtaaatcactttcgacggaaatacaaatactactcaaaattcttcgacatttatattgcatttctagctggtatctaataggaaattagagaaaaaatcttacaaattttgaaccatcgatttaacttatgattcatacactaggccggctc

SEQ ID NO: 9445 - DNA, 2610 bp, Oryza sativa
agagtggtgacatgttgatggcaccaccaaagccataaaatgaaagagggtggtggatagtaaaggtagtggggtagtcaagaaggcaatagtaggccacgagtacaaacggtacagccagtgacatccttgaggtcacatgctcgtgtgctgctagccgctactgcaagcaccaccacgacgtccctccagcatcgagctcaccagatccaggatgagcaacgatagagctaaggaggtggctacgagctcaaggaaggaggagcagtgagtgtcgccgatagtgtgggctctgaagaggacgacagtctcctcggtgaagaagccattggcgacgaagtggcggagcatgtcatcgagggaggagaagcgtgcgaaaaggtcaacctcccatgcgttggactagagtcgcggcagccaagcacaacatcataagcggcgcaacaagggacaacaacagagtcctacaccatgagcgacagcatgtcggtgcaggagatgacggcggggtaggcagtcttgacggcaccatgaatccctaataggcgccagggccaggatgaatcgactcggcatgagggccgtgacatcaccatcaaccccggccaccaaaactatggacacacctctacctccccaacctcgacagctgcggctgcaagaggaagttgatccccatcatcctgtacctccataacggtaggctcgtcattggctcggttgaggatgcgctcgagcacgagctcgccaaccgcctctacaccctggcacgcgtcctcgtgttgtccttcaattactgcctcgcgctagagcaccccatccctgcctgctacgatgacgcgtggtctacaccgcagtcgccgtttgccatcagagccacgagcgccgacccgaggtggtgggccttcgtcctcggtacaatgctgttgagaaagatggaaaagaggagtgaggagggggaagagaaagagtctctgattatgtgggtcccaccagtcatgtcagcaaataatgcttcccacaccatcaaaaaagttgattttttgcacccattttcgaagatgggagagacattatacccggttttgcggttgagggatgcgattcaatcaggaggaagaacgagggaggtaaatagacttattccttcaacccccagctcaaaattaagcggcctagcattggcacgacccagaaggccttcaacctgcactgagaaacaaaagagaagtactcatatagacaaaattaggcccagttcctatcgcaagaaacataccgaaaacatagcccaatacacatatcaagtctcaatgtgtactacctccatcccataataaattcatttttagtccctctaagttctcgcaaataagtttatttttaaataattattgtatcggagtttgtaaaagtatgaaataattacatcagaaatagataaagttgtattagaaataaataaagtgtagaataattacattgtgatttgataaggtagggtattttagtttttaaacttattttgggacagatggagtaaatgaatttgtatatatggttttgaaaacctctagaaataagaacgtgcatgtacgctcacctgaaaattttgtgcgctcacaccatgtgctacatttgtcttttctttcaagttatttattccacccatatatactggcaatactctctccgtacaaaaatataaacttattattaaataagatattttctagtacagtaaatctgaatagatactgggaaatattccatttaatattatgttgggttatttcggaagggagggagtacttgtcatcccgaaattggcagccaaactggtgagaaaatagcctggaattggacaaacattgctgtatgtctttcatccatccaaaaattacgtacgtgtgtaaagaaccattaagcactagctggcatcctgggtggcactgaaaaccgaagacgctagctgtaattttgtactccaggttgcgtagcagtaaggtagtcacacacaagagttaaaaatgcattggtccagtggttgcggcaggcttcgttttcaacagcatttcattcccttgacatgagcagaaacacccgcaggaacacgaggggagggctacagggcgccgagggccaggccaaccgatcgagtcaacctttcaacactcgccaacatttcttcccctcctgcccatttactcgctaccaattgtacaagctgcccatccccctcattactcccttgccttttaagcactctttccttccttacaattccaaactttacacttctataccctcttctctcctccggccctatctacaactctacatctcctcctcctttctttttgttcttgttgtccatctccatctcgtcatacacctcccaagcacgggagtatgcctcaatgtccacagagaggtaagtggccacctagaaatgatttcagttgaattctttaccttttgtcccctttttgtctcttggttctttttgaaattatgcttctctctttctgtttcttgatttttttctctaaagaatcggagaggttttctgttccttttgcttggaaggatagcatgtaccttttgtag

SEQ ID NO: 9446 - DNA, 4710 bp, Oryza sativa
cagcagcaggtgaacgcgctggaggccgagctggaagcggtcagggccgagatcttcaagcgcaggtaccggcaggccggcgccgccaccggcctcatggacgacgtccaagtccatatcaccgccggcttcgccgctcctcctcctcctccatcgatgcacgcgagggacgtggtgtcagtggcggacgccggcgggcaagggcaagagttggccggagcgccggtgatctcgtcggcgtctccgccggtgtatcctgccgggcagccatcaacaagtactactgactacagctccctcaacacaagtgagcatgctgcatactttggttgacttgcatggatttatctaacattttggtgtgatcacaattaagccggggaaaataagatctgtgtgcgagattagttatatatatgtttctctagaaatagatatagttgtggataccttgggtgaagaaaagaatttgtccaatggatgtatcaatccttaattttattgtattgtccattgtgattgggcggttgatttaattaattgagtgcgtgctaaatgatcgaattagctcaaggaagttttcttcggttccggaatgaagtagtggttgtagtaagtgaaattgaactaaaaaacacatctgcgtgtatatatgtacatatatagtccaagtgcaggttaatttcagagttagttatgcgtgtactgaataagatagatcgttttcgtcctacgtattttttcacgaattttacaatgattgatatgaatttgcgtgcaggctagaatgatctggtaccagagtacctgcagagcatgcgtgatccttgaactgattattactactagattggtgacgagacctaaaagaataggtcattcgctgatgtacacgtatatatagtgacatctccttggatattatttgcttgaatgcatcaactaattgattggttcttactattcgaaaaataagtcagcttgatacttacatagtcacgtcattgtcatttctcaacgttctagccttgttcacataatttggcaattgatcattgttctgaaataggttacactgtacaaatacatgcacagaacttatatgaaggaaacaggacaatgaaactactgtaggtcgatcatatatgcatgtccacattatataactgttactctcgcttgtgcaatgtagtatatcattcgatgtgctctgcacaatatccttttgtgtaagttcgtgtattttttttaaccagcagatcgtcgaaagatttctttttacatatccgtctcgtttaaacgaagcatttctttggtgcaaaccccctctctctctctctctctctctctctctctctctctctaagatgatgttgattggtgcattttttttaaatctggaaaagtgttttttgtcctcggatgccatctcatttctttcatgtcatctaaataattacaaaaagttttgaattttgttacaacatatattaaaacctactagatcggtccacaaatatacaagtttaaatcaacttttacaagttattaacaataataacatatataactacgaatatgtgtatatatactagttagagtttataattttgttgtttttttaacttgttgaaattgaatttgacattgcatgtttatggaatgatatatatcgtattaatatttcttgtcaatttgttttaaaacaatttgatagttatttatgtgacatgcaagggtattctcccgagggataaaaatccatctccttttagtagttttagtagttgtacgtgccatgttacactaccttttaactatttcatctaaaatttatcatttgcatataggacgcatgaatcatttgaagaaatctagtgggcgtgttttaaaatcttatgcacagtacaaagtgatagtacaaaacaaggctctgtatgggccgacatatcatttcttcacgtgctcttattttagtatttccctcaataatactatgaccctgttccgaagtctgaataccagggtattggtcatgtagaaatgataggacatttcctatgtaggccagattacttgttcttaatttgtagctcaatacttcttcagatgcatatgagttattctagttttgtattaaattaaactcatccaactcggcagagtttataaaaaaaataaaccaacatcaaatcagttttattaaatatactattaaagatatcttgatagtgcatttttttaagatattagcagaattttttactacataaactcggttaaagttaaaagaaagtttgtatagtacgtacaaaactaaaacaaacaaaaatgaggaatgcaaccttgttgcatgaaaattagtgattctttagtttttctgccctttaattgtatgccagaaagttgttgttgttttcatattttcttttgttattcctgcatatattagttgtgggttgatcggtagtctggtataacatggttcagacttccgatggacgaggaagctaccagtccatacacattacttcatgcacatactttcgagaccatttaatatcgttaatttgcctacatatattgtcctggtacgtagaaagcaatgtgggtgtgtgcaggcatatgctgaagtgatgtgagtcggctgttctatgcatagctatgccagcttctactagctaattgcattatattactaaaacccctgtaggactaggggcctttccttgacgtgcagtgtttgcagctagctcagctcgatcgtacttggttgagttccaagcaggcaaagtagacacacacccggcctcgtattaaaaactggagcaaccagcacggcctctccttccagcgtccatgtgtgcgagcgagagagagagagagacagagagagagagtcgttaatttgtttatttccaagctaaaatgggttgggttgggggagcttggcgtgtgggatgtgattgtgatggggatttggtccagcgtcgtgcttgcttgaggtggcgggcatccttgcttgcttgcttgtccgcactcaacaccaacgccgatgcttaaaagtcttcgctaacctcgaaaacccagcacgggatgcctactactcatgcatctccactgttcctgctcgtactactaccacatttgttgcactacatgttttttcatgtatacagtagagtatatggcctgttgcaacccaacacagtagttaggttgatcagtgttcaggctttcagattctggacctggaatttcagctgtgagctgaaaccggacagattacgcactgcgtgttaggtttaggtgtatgttcgcggctcactgcacatgcttcgacgactggcggtcggtcggcgccgcgacggtgcgtacaccgcaccgtttttttgtttgtataagagtgacgacggaataatgtaggagtactagcatagccgctccattgactagaggagttttgcatgccgactgcacaaatcttgaggtttagcacgtggtggtggcagcaatacgcgaccttgtcgatcgtaccactgtctggtgactgtgccggtgggagaaaaatgaccgagattgaaaaaccggactgctttttccagaccgatacataagtgatggagaccgattttttaaactaattcggtcaagcttttcgtgctacctgagttcaggtggtgtttggatcagggatttaactttagtctctgtatttagacattaatttagagtattaaatatagactacttacaaaactaattacataaataaaagctaatttgcgagacaaattttttaagcctaattaatcaataattagagaatatttattgtagcatcgcatatgctaattatggattaattaggctcaatagattcgtctcgtaaattagtccaaaattatagatgagttttattaatagtttacgtttaatattaataattagtgtctaaatattcgatgtgataaagacttaaaagttttagtcccatctaaacagggtcttattcggccataccttggttaaccaagatgactgaattgctattttatttgtcctaatatataacaacttagtattaaagtattaagtattagataacctagcattacttcattcatagtgctagatggtgtacaatctagtgtagctggttgcttctcccctgtcacaaaatataagaatttaggaccaaatgacgtattcttagtgctacaaatctagataaatacaagagtctagaataggatgatgcattcttaatactatgaatctggatgaaataagttcttgtattttgagacggagggaattctgaataagattcgtagtattaggttgtgactaatttagtatatatgttgccatattttatgatggatgaagtatattaatattggttactattatcttgtgctatttaatgggtggctaatgggcgggtgatcgctgtgggcgatcacccgcccattagccacccattaaatagcacaagataatagtaaccaatattaatatacttcatccatcataaaatatggcaacatatatactaaattagtcacaacctaatactacgaatcttattcagaattccctccgtctcaaaatacaagaacttatttcatccagattcatagtattaagaatgcatcatcctattctagactcttgtatttatctagatttgtagcactaagaata

SEQ ID NO: 9447 - DNA, 11268 bp, Oryza sativa
ctatatatatatatatataatttgaatttaaatttaaaattgaatcggttatataaactttgggtctataaactttaaatatatagaaataccatgtattaaaaaaatatttgaattcaaattcaaaattgaatcggttatataaactttgggtctctaaactttaggtgtataaactttagatgtgtaaatttggggtgtacaaactttaggtgcatgaatttactaaaacaggaaagtaatgcggtaaaaaaaaagaaaccacgtggagaaggggtgattgcttggagcgatcgatcgtccattaggcttttcgctatttaattgctaaaacatgtatcatattattgggttgccaaaattttattgtaatttcttttattttgtgatctcctaacttcggtcatgatcagagaccaaaccatactaacgctctatttgttttcgcttaggattattataatctagattattagtaataataaaaaataaataggtaaattattatgatagattattgtaatctgtaagccagattagtataattggtaatctgttctaaacatatatttttcatattattgggtggctaaagagtcactgcctctattctactataatccattgaaacaaactcatagcttattataattcagtttataaatctggctaaataatctgtattataataatcttatacgatgagaaacaaacaggcccctaagccaaacccgaaaacgtcagatcgatccgcgcggtcagttaacagttaacccattcctttatcgggccacacggttttggccttctttttcattttaacaaaatttttttcatgggccagccccgggaggtacgaaggacatgatcacatgaggtccccgaaggggcatcagtgctactgctcggttagcctcgtcagttctggcagaatggtacgcgcgaattgaactggggctgaagctgggagcctgggacgacaggaattacgcgaatgaagagaaaaaaaaaacaggggaaacatcgtggcgttgctgccgctgcattgcatcagctcggccttccgaatatttttaaaaaatatatgttgagagtgggatttgaacccacgccctttcggaccagaaccttaatctggcgccttagaccaactcggccatctcaacaagtgaccacaggagagttgtcaaactttataatagtcgcatagcgagatgttagtgatattcggcccacacatcgccgtgggcctgtaaggccgcgtgtggggacaagtgggctaaagtgcaaggtgggccaagcgtggtaaggcatgtcgagggaaatctttatatactctccattatacaagaaaagaaaaaagagaagtgcacgttcactgaattgtcaagcaggataacacaggacagcatgtaagtatttagggtatgtaagtaatttagtacttaagttttatatttaagttatttgacttttttctaattaaactttaagtttgactaaatttatagaaaatgtagtaacgtttttaacccaaaacaaacatactatcaaaactatattcaatgttatatttaatgaaactaatttagtcttattgatgtttttaaattttttaaacttgatctacaggaaaaaaaagtcaaagtggcttataatatgaaatgggtaactacttcatttagtaataaggaagatacaaccatcatcagtctttgcatgattttctgaaaatggtttgataagaaaaaataaaaatgaaaaatcttggaccgctacaaaattacctatatcatgagtctatagcctcctctccaccctagtattgtctccagtctcaaactgtgtcattgccgacaagtataatttttgttttaaccatcaataaattttaaattgatctatttaaatgattagatcggtgatatacgaaagtttcattactatatttagcttacaacacacttcattaatatgaaatactttaaatatttatatattttctgtaaaaaagatgagtaataaaaaaataaagataaataatatccagtgataagcatttgaaggcagagcatatgttgcacacttgcacacattgaggtacagacgttcgtgcccctaatttggcacttcaacaaaggattcagtatttcctctccatactggggccttctaaccaatcggctacactggaccatggcttagcttaattagctgtctgttggacccaaaaaaaacagcccaaatagtaacggggcaagatttttgtctccagcgacaggtgtctacttcgcattagcaaattaatggtccgaggcgacctacaaatccacgttcattaaagaaagaaaactctctcgtgtcaaaaagaaacaaattaatataagagagcaaaaaatctcctgtcacctcacccggagatcctaagcacatcaagccatgatcaaaagatagcatgcaactaaacgcttcagaaagtatgagacctgttttctctgaccagaagcagctagcctgctggctgctgcgctgtatcctgtctagctagcactgtgtttcattcttgaatcgagatcgccagttttggagatatactggaacggataaggtttgcttagtgcattctcttttctttccacaagtgtatcagctctcactaatcccttttctcaaatatctggacaatctcatcactatctgtatgatcagcacattgccctctgtgctccaatctctttcagaaaaaaacaacctttattttttcagaaatctgttatacgtaaatacgcatatagcggctaggatatactccgtacttgccactacactgccaacagctttgagatatactccacaatgtctcgcgtacaaaattcgcatcgtctcggtgaagtcatgtgcattggccgagaggtcttggcgctctgcatgctctacaagtggtgtcgtcgctagctcgacggataatgtgaacgaatggatgacgtagactgtctatgtacggtcgtagtattatactactgctgagaatgaaaaagaaaatagtatatgcctttttggtcttctagaagagtactctatatcttatcattagcactatgtctcttccacttaaggtttcatggtggagccaagtaggcttattactagtactctcacagaggtgcagcagaggagtttagccagttacagtctatgactgggaaaggagagtcaaatgcaaccctgccgataattttgtggagacagcacttggatcttaaaaaatgaccaccaccatcaatttttatttcgttaaagtaaaaacactgatatatcagcacactgcatcacacaagcatcagcgtgatgcatacataagtaacataatcatgacctcttccagctggatcagtcacctagctaacttatttagcaaagattaagacccaaaagggaatatccaagaatggttgggatgagatggtgtttgatgtaaaatggaaataaatttaaatagggtaattaaatggataagtagtaatatgaatagtgctaaaattgtttatatttagatacaaattttaaatgttagtagtgatcatattttgaaaaagagggatttctttttagataatgggactaaagccggcttttgctacaacgaagctataaccaattattataatattctctcaaaaaggcaaacacttaattaagcaaaaaaataacttaaataataaagccaacacataagaagtaaactattattgaagtatatttgtgaatctccatctatagttgttgaaaatctgtatgattttaacttctaagtttcgacacgtagaatatatgagcttcttgttctctttacacttttgtgagaaggagggataaggtactgtatacatgtatgacctctgtccattgatacccaagcaaagctggttcacggttgcaggaagcaacatgagtacacggctgcatatatggcatccaggatggctgcaatcaaggccttgtttaggaacgtctgcttcgactgctcagctcgttgatgtgctctcaactgggccaacgcgcgctccggcacgctagctagctgccagatcagttaagatcgaagtgagtgaagacgcgcacacgtgaacactccattagctagtacgcccgccactgtgcgagccctgttctcttgtgacttgtcagtatggctagcagcttgtgatagatctctcgatcgctttctccccgttttattttgcttgtttttttttcttcccaaatgatttactagcaatgcatgacgtaacgatgacgtgagagtagcgtcagcctgcacgaccactgtcggagcacgtccgcatccgatttattcggcattcagtgtttcgcctaaatgcttgacccggtgacagccaaggagccagcggcacacgtaccagcagattgcactgtgcgatggccttgattgcccatcgccgtcacgaaactccgtcgcctttgcgaactaattattctctcctcctagctgtgcctttgctgctgcggttcgtaccggagtcggacgacggggaagatcgcagtttgctcatttgttggtaagctttcccgtgccttccgctacagatcaatagaacgtatatgtgatgaccaccagccaaaaattagcttttcttcatgccttccactgcagatcgaacgtatatgtggtaaccaccaaccaaaaattccttgtacgttcggcctccccgaactccaccgaggcaccaaccaaggatactgtacgtactaccagcctactagcagggtaccgatgctttgccaccaacggcacggctaggtcgcacggctaatctacttatctacgcactaatatgacgaccccccggcccgcgcggccgtccaagaggacggccagagccgcgcgaccgcgtgccctccccagcgtgcagcgccggccgggcggcgcatggggtggctgggtgacggcagaaacacaataattgcggcgcgttttgccgttttgctcctgtcgcgcggatatatatcggatgggccggttaaagtggtctttcgcgtcgcgggcgttgctttcgtccgcccccgcgcgtcgtcccgatcgatcggccccgcactgtatcgcgcattatcacggccggggcgggctcgctcgctcgcgtacggtcggtgttgcacttcttgcaggtagtgcctcgcgagatcggagatggtgagtgctcgcgagcgatcgagctccatgtatctgcccgtgtcgcttcgtttcctcttcgttggtcgttgctttcgctttccctttttgtcccgtaggtgatcggagttcataccagctttccttggcatgtactcatgcacgtctctttcccctcttcacgcgcacatgcggttagcgaaaggggcatagcatttccattgatgtatccagccactacgctatgtcttccgttgcatatgcagttgtagtactctcaagctctcctgatcgactccttttcatataggattctttaccggccggtaaacataaagcgcgagcgcgcatgcaccgccacagccaggccgtttcatccatacaatctcgcatgaaaagccagtcgtcgtcgatcacttcagaattcagattagtgaattattctacgtgcgtgctggataaagagagaaacgggagaagatcgatcaacgaccgatccacgatcacaattcgcaaaccttaggtacgtagctaggcggcctatcctacactgtaaatggttgaagcgttcactcaatcgctcatcatccgctaacacaaacaacattaactaactggctaaggctaataaagcgaagcgtgtgtggtcaggtactaacttaggcgccacccgtgccgtgccgtccctttccccctcgtaccaccgacggatgccaggctcccctcctcggcgtgccgtgcctttggcttttcttctctgatgtactttggatcgatcagggagagagccggtggaccacctcggccgacctctgtgatcgagccgttgtgagagaaaagattgaagggctatgccacacgacggcagaggatggatggatgaatcgaacatgcgcgagatcgaggtgagatcatcaacgagactgcatgcgccgtgcatgtcgtacacgccgagggtccctgccgtatacatccaggtgtaccgattccgttggatcccatcgttttagtacgtgcgatgcaggccggcaccacagtcgacaagacgcggccagtgtcgtgcccatgacaccggcctgcaatcctgcgctcggcagagctgttgctacagctagctcagagtgattaggacagtaaacgcagctaacgctgcccatgcgaagattttctagccccatgctgctctgctccacacgtactcctacaatgcagacacgcagttgccaggccggcatcgtccaagcaccggtgatgcaactaccactattactactacggcagtttggatctaaactttagtcctttttcatcacatcaacctgtcatacacacataacttttcagtcacatcatctttaatttcaatcaaaatctaaactttgcacgaaactaaacacagcctacttctatctctcggttcaaggacatgcaagtcttgccttcatgagtacctggctgaacgttactcctgctcccttgtctcacatataaaagccaatcctaacattctaagataaaaatagtagaaaaaaaataaccaaaatacctctattattgagtaatggtgatagatagataaatagtattgaaggaataaaacttatcattttatgtgttgatagtagatacgatggtagaagttgatcttttgtgggacaaaattcaaattttagaagttgagttttttttagacggagggaatagaacagtgagtttagtcgccaaagcatctacgactacgtaaaactatccgtactctctgtgccttcggtctcgatgctgtaattgtagagggccgtgatcttgattttcgttatatttcgggaccctgttaaataatttcctgtcacgacaaattcaacccgagaaggaagaaatagcctagctatctcaccacgccgagagatccggacgtcgctggtagcaaaacctgattcaaatttcttctccaaagtgacgtctcggattcatccagccgcaaaattttgcatcagctgatggggcccgaaagggatcgattgatcgatggggctcgagtgaaaacgagcggacgattattttgcatcagctgatgtgatcgtgtgaggcttcggccgtggccaacacgagcatgctgtctggtacatgggaaagttgtgatacattgttcattcttgagatattgaatgtagtaatagtacatggctagctttgggaatgctgaggtcagattagtccatccatcgccaattgtctttttcatgtccagagaaataattcacacaagatgatttcgtcacgaatcagaaatccgtttacatgtcccattgtcatgtgatggccagtgtgtacacatttcaaaatcactattaactttttgaattatttatttatttgaaatggaccgaaggttaaattcattataactgttcggtcattttaagctaagttcaacaaaacatttgctttttagtagttctttatctatctgtgaagcctctttatgacgcattggataacaattaatataactgaattagtatagaaaatactccctcattttaaaaacataagaatttctaggttatattgaaaatactaaggttagaacaaaagatttatttttagtcacttcaattatcaatttctaaaattttgaattgcttaaattccctttccaagcatttaatcagcactggaatcatctacctattatattattaagatagctcgaaaaaagagccaccatgctcgctctataggttagaagttccaaattaattagagaaaaagaaaaaataaccgttagactatggtgggtccggattataatggtatagatttattgatatagttgtatgaaaatataattatatatataaatataaatagaagttaagagttgtatatgaaatataagtctatatgaataaagtctaagagttatatatgaaatttatgttatagaaatagaacctaagaattgtatataaaattcaaatatacttctacatataataatacttatgtataaataaaatgtaagagttgtctatgaaatttagaccttataaaaacaaaagttaagagtcgtatataaaatccaaatatacttctacatttctatggtacctatagaaataaaatatcagcattgtatattaaatctaactccacgttaattacctagtgtcggtgatatgggaccgggagtatcatgaccagaggcttgaggcagacgcaatcgcccacgtggcctggcaccttcggggacgtcgggcccgagggtgaggtgtccgccctcctcctgatttcccccgagggggggtcgggttgcgcttgccccggccccgagggccgaggcaccccgaccccctttaggaagtctgcgccacgtatatgggataagtgagcacagctgtgctcacctaacagcatttattgcagtctggtcaagcgtgtcgcgctgcatgcagtgcagcacggcgcgtccctttatccggtctgtgaccagtcacagaccggtcagatcacgggttaggtggcgactggcggtctgacgcacgccatgccccatcccgtcaagacgaaagcctctaggcactcgtctcaagccggcgttaagcgtgttatctcttagagatgacacgttagacccggtcgatatatgccaggcttcatcctaaccattacaggcaagatgttgtgtgaagaagggcaaacatgcacgttgccaagattacacgcggtggacaagaatgaccgatttgtgatcggtctgacactgatcatatcgtcagcgcacagccatgttcccacgacgcgctcacccccggcggaagtggaggtaggtgtgggctgtcccatcggagcgtcattcggacagcaaccgtgctgatctccgcccgttcaagagaaaaagaacagtccagtttggaaagagaagggtgcatgtggtatccccttgaagtataaaaggaggaccttgcccatagaggtggggggatttttttggttctttcccagattaggagcttagaacgggggagaagacagctcacacttgtagctcattcatacacagatccaccaaaacacaggagtagggtattacgcttctgagcggcccgaacctgtatagatcgccggtgtctcgtgttttctggctggcagacgatatttccacatacagagagagcgagagcttgagatttcaccctaagcccccggccgaactggcaaaggggggcctgcgcggtctcccggtgaggagccacgagctccgtcatctggcgcgccaggtagggggctcagcgtgtgctttctgagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcggcgtcaccggccgcaggtgatgcaggagaacggcgagacggggagcatcgcctcctcgtctacggcgacggcagtacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtccgccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggcgtaatagccggcgtactccccgtgcaacggagggagcctcctcgtccagagtgtcacctcgacatggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggattgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaacactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgctccgccggcaggtggtgctccgtccacaacacctccctccacgatctcgcggactgtcgtgcagtcaaaaacctggctgagcgaacgaggaagtgggaggaggacaagaggcaggaacgccgtgagggcaagtccccggtggttccatccggcaaacggcgaggtgaggccaagcagaaggcccccgctgttgacatcaatgatggtgatgatgacctaggtttccaagaacctggggccaccattgccaccgtcgatggaggagcgtgtgctcacgtctctcgccggagcttcaaggctatgaaacgagagct

SEQ ID NO: 9448 - DNA, 7224 bp, Oryza sativa
ggcccctacccatggagggcgatgcgtcgggcgcggtggtcggaggtcgctctcactttcgaccagactgaccacccaccgtgcattgcccggggagggcaggttgcgatggtggtttcccccaccatctgcaacatgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctagggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccctctgcccccaccgccccgaggcagcggatggccacttgcgacgaggccccggtcaaggaggttgccttgggcgacggcccatccaggaccacacggatcggtggtcttctggatggcaaataggaagacgcgctcgtctccttcctgcgggcaaacgctgacgtcttcgcatggagaccagctgacatgcccggggtccccagggaggtgattgagcaccgtctcgccgtgcggccgggcgcaaggccggtccggcagaaagtgcggcggcaagccccggaacgtcaagccttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcctttcgggttaaaaaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggcaagcttctcgggttcttggtctctgcccgaggcattgaggccaaccccgagaaaattcaagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatctcagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaagaggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcggaagacgagtgtgccccgaggggccacttggacgaagaacgccccgggggtacggcccctagcgaggaggatcggccccgccgaaaggtgcaacggcctgtctactttgttagtgaggccctccgggacgccaagacccgatacccacaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatacccgaggccagcacggacccctcacagctgcctcaaaccgcccactgggtgatgcagttcgacggttctctgtctcttcagggcgccggtgcaggggtcacgttgatctctccgaacggagacgtcctcagatatttggtccgtctcgacttccgagcgactaacaatatggcagagtacgagggactccttgccggactcagagtggcggctggactggggatccgccgcctcttggtattaggcgactcccagctagtcgttaaccaggtctgcaaggagtaccggtgctctgacccacagatggacgcctacgtacgccaagtgcggcgtatggagcgccatttcgacgggatagagcttcggcatgtacccagaagggacaacatgatagccgacgaactctcaaggctcgcgtcctcgcgagcccagaccccaccgggcgcctttgaagaaaggcttacccagccgtcggcgcgacccgacccctcaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgcatatttcctaaaagcctaaaatgcttaaataaattttagtggaatttcagagcacaaataataattgaaaagaaataaacaaagttaaaaaggtttataaaaagaaaaaccctaaaaagaagtctgttccccccccttttccctcttgggccggctcggcccattccctccctctctctctctctctccccccggcccatcggctccccgcgcgcgcgcgcgccgctgacaggcgggcccgcccgccactctcgctgacgggtgggtcccacctgtcatccccaaccccgcgccgcgcccgccgccgcgtccgtgccctagcgccgccgccgccgcgaatcccgccgctcccgtccactccgcgtgcaatcaagaggggggatttactccccgcgatctcctcccccgtttccccctctttcccctctctctctccctcggattcgttcgaatcaatcccgcgaagttcgccggcgcatctatggcggccgagatttccgcgcgccgttgcctctctccccggccgcgctctccccctctcgtcgctataaaaacgttgcccgtgctctccttctccgtttccgccgttcgccgctcgctctcgccgtcggaatcgtgctagcgccgtgctcctctctctccgccgtcgccgtcgaccgtcggttcgccgccgccgtcgctccgctcttcctcccggctcggcgacccctccttcggcatcgccgcatcgccgccgaccccgtccgccgctccgcttcgtccgccgaccgccggagcaccgtcgtcgtcgtcatcccgagccgcgccgccaccttcttcctctccgtccgccgttctcgtcgtcgccgttgtctcggggtgagccgaagaccgccgttcgccttcccccttccctcctctctctcgggtgccactccgccgcgccgttggtcgccggcggcgaccatcggggcgctggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgagcggctgacgcgtgggccccacttcccgtggacccggtccgcgcgcccgccctcggctgacgcaataaacatgatttttaattgaaaattaaatgaagaaattcgcaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgtcggtcgtgtagacgctgcagcttcggaagatccgctcttcgttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagacaaacaaaaccccaactagtggacactctctactcatagtaccactagtataattctaggtagatgcttcgcaagttaattaggcaacattaggtggttttacaactctagacttgggaaattctcatatcatttggacaccatggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcatacggcggagggttggtgcccaatgccaggggctcagttccgtctgcctgtcccgggggtcccggccgtaggcggaattgggtcggtactcttgtctaaggctaggatgggttggaaactatgtcacgtctttcgtctgtataccgtggtggtatgtggcacgtggttacacgtgaggaagatgtgtcttgtgggtaaagatgtacacctctgatcagagtaaatctattcgaatagccgagccctcggatatgggcaagcctagcaatgtacccaagtcagtgttataattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataacattgtttagttctaggatcgtgtttacaactagctttgagcaactaaattcctttaaatgctgtttactgcaactctaaccccttatgttataattcccttgtactcccttgcatttattttgcatttgtgggtgtgtcttgttgagtacggtggttgtactcagtcttgcttaattttcccaagcccagatgaggagttccctgaagatgaaggcttcggtgtctagctcgtgcctgccgtcaagtgcctgtggtcgtcgccctagtcttccgctgtttttcgttgtctttgagtgtgctgggccttcgttgcccatgtaataattatatttacgcttccgcttgttaaactctgaattgtatcaacttttggtgtaccttgcctcctgggacaaggaataatacacgcacgtcaggaacgcctgttgggtgatttccggtcgtgacaccctctatcggcgcgcggctaatggaatcctcctgaagtgcattccacaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcctaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctg

SEQ ID NO: 9449 - DNA, 3159 bp, Oryza sativa
cacccccccctcgggtgtgcagggttagccgggggctaccacacatgcacatatattcctttcagcatttcaatagaagcagtttcaatttcctaaaggttgtgtctgtgccgttttttccttttgaagaatcttgacttgaaataatgtcactcgtgctcaaccttgtcctcgggggctcggttcggtcagctaaaatcgccaaacggggcccagaaccgagccgtgccccggggcgtggtgaactccggggggggatcggcaaaaacccacaatcgggtcacccatacccctcggtcaccacgttcccggcctggccagtctcgacatgcggatctccccaggcactagccccgacccgagccattcgaggaccgggacttgggcgtgagcccttatttcaagctaaggcgcaaaaggaccatggcacagatcatcctcaactcatatatatagcaaaataaaattaacacaaaaatttttcatcatttctcattgcagattaagtcagattgtacaaaaaagaggcatgaaggccttagaagaaagaacaagaaaaaaaagttaagagtggcgggggcctgggggctcattcatatgcgcccgggtcgccggcctcgtcgccaccgccgtcctcgctgctggtgtcgccttcctcgtcggagctgggggcgaacgcgagccgaggggctgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggagcgaggccttccagattggtggggggcaccgtcgtctggcctccccagaggcctgcttgccgaccggcgcgcttcatgcgggagaccgcgtcccaaagcatgccgggcccaatctcgcccgccaagcgaagggcctcgacctccccggtggaagagtccagcgcgcgctgcatgtcggcgacggtgtgttcggcagccgcgaggcgagcggctaagtcgctttcgcccgcagccgccccaccgatgcgcgcccccgcggccagctctttctcccgtgcctcgaggttggcagcccgctgctccagcgcggttctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggcggcctcacggtccatcaagcccctctccacggcgccggcatgttcttccagcgccatggcacgggcctcaagggcctcctcgcgccgccgggacgccgcttcggcttccgttgcccgccgctctcgggcggcagcggagtcgagaaccccttgggcggcgtcgagcttgctcttcagctccgcctcccagcttgcgtgctgaagacggagggtgtcttgcgcctcgaccatcgcggtggtggcgacgagggcggcctctcgctcctcctccacctcccgggcgatctccgccagcgccgccttgcgggcttcgagctccgagatgtggcggcggtgagccttacggcccacctccaccatggcgtccaccgagcgccgcccctcctcgacgcgcgcccatgcggcctcgagctccgctcgttccgctcgcaaggcctccacctgggcgctaaatccgtctagtaccgcggtgtttgcggcggccaaggcctgcataatgggctcggcgctcaccggggcgatggaagaggaggagaaaagccgccttggagaaaaagcgacgcggcttggccccccggaggatacgctgagctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcctcagcctggcgagcccgggcggcctcctcctgggcagcttcttcggcttggcgagcccgggcggcctcctcccgagcagcttcctccgcttggcgaacccgggcggcctcccgggcggcctcttcagcttcccgaaggcgggctgcggcttcacgccggtcagactctcgcctccgctcctctgcggccgctggatcttcggcctcgaactggccggacttggggtggcgggaggaatgcgacgggacgtctctgaagcagaagaaaaagccagaagacgaacaaagtgagcaagaaaaaacttctttttggagaaagatggttgcaatgagagtaagacgaacctgcgagggggtcggttgaatgaccaccttgggggggaaattaggtttccccgggctggttccgtctcccccatcttgcggagccgcttcttcttgcgctccccctcgggctgagacgtcggcgcggccccctccgggcgccggccgctggtacgcaccgccccgccccctcgggggggagatgggggaggtgttcctcccagcttcctcttccccggggcgtcggcagggcggctgctccccgagcccccgacgcggggcccagaagcacgaccccctcccggggcagattgtttcccccggcggcgctcgcccgcgccgtcgttgcccttaggggctctctcctctgaggccccgacccccagcataatggatagaatggagacacggtcgggatcgatgcagagggggaggatctcctgaggaaggtgagacgcctccgcggagctaaggttcagcaccctttggaccacgatcttgaagtcctcgggagcccaatcccatctggctccctgatgggtccgcatgtagtcttcaggcccagtgtactcccaggcgctccgggcgcgccgttggagcggcgcaatccggcgacg

SEQ ID NO: 9450 - DNA, 2138 bp, Oryza sativa
  unsure (1)..(2138): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggcatgtcagtgtactcgtgtatacgcgatgccatcaataaatcataaatcaagcggttttccttggtcagatgaaggcggcgagcgttgaattctcaaaccaggtcgtcgtcctcgctgggtctctttgaagcctccgcgagaggcgggcaagcagcagtgcagcacaacgggattgaccacggtggggagagggcagccggcagtgtctctccatgacgataggttccgtggattttttcaacaaaaaaaaaggagaaaaaagaaaccttccgaatacgccggtaggttgacggagatggaagaaacggagaaagactagagagggtttggcctgaaggcacgcgcagccccgcagctctgctctccaacaatatactccgccggccgcggatctcgtcggccgacgaggcgacgtggcgtcggacttgcggcctcgagggtttccccagtggagagccaaaccgcaaaggagaggcgaacgggaggaagacggaaaggttttcactagtagtagtactactttccaggggtagattagtttaccatgggtctagaagtaggcccaactccatgtaaaccactcagcctaaataaaggcccaagcaggcgaactctcaggcttgttctcttgccgaattgtaaagcccaattggtcttaattgacccacttagggcccctttaatcataggattgagaaaacgtaggaataagaaaaacgtatgattttgataggaatgtaagtataaaacagaggattgcaaacacaggaattaccgtttgattgaaccacaggaaaaacacaggaattggatgagagagatagactcaaaggaaagttagcaagaggttaaaactcttgctaaatttcctctaaaatctctataggattatccattccataggaatttcaaaggattggatagaattcaatcatttgtttcaaaggacttcatagaaaatttttctataggattaaaatcctctaaaattgctatatttttttttccaaatcaaaggggccctcagtaggcaaattgttcgtccatgctgtagtttgtggagaaagggggtgcgtagtttgtggagaaagggatgcggtagatttaccaggtttgtcatctcggtgtaaaaaaaataagtttgtcttctcactttggagagtttagaaaggaaaagcaaacatctacgtcgaccccatggatccatggattcaacggcggatattgtgtccggcgcctgtcatgttgctagattccagcaagcaagccagtggtatggatccgttaggctggccgactggccaatcgttgggcatagcaaatcagcacgccgctgctaaaaagggtcccgcttcattgtatcatcgcaaaatcaggaatcggggccgtgttcccgtccaagtacagcacctgaaacactagcttcctctctccgctctgtaatcacatcagtcctttctgtcgcgtagtacgcctcccacgcggaattaccatattaggccccgttaccagctgctgcttctacagcgatcatcattagcgcgtaaggatatgggcgtaattttcaccggattaaggaagcataggttcaagtggtactaatttaggtggtgccaacgagcgccatccacacgcctgaaatccccaccgaaaatgacgccgccggcgagcacgggcaagtgcaccggcgccgccgccggcgaggtggaggagccgctgctgccggagttctctggcggcgggcatggggcgtcggtctccggcgcggtgttcaacgtgtcgacgagcatcatcggcgccggaatcatgtcaatcccggcggcaatgcgggtgctcggc

SEQ ID NO: 9451 - DNA, 7880 bp, Oryza sativa
aggagcaggagacgagcacgccggtgttctgcaggagctgttcggagcgcagtggtggacggcgagggagcctcgtcagactggtcacggccatcgtcgttctgctcccgctcgtgctccgccgccgcgtcggtgagttgctctcgaatacaacctgatgcacttaattagtatttattaattgctactctaaaatagcttgattagtttaattgctactctaaacgtacttcatccgtttcatactaaactaagaatatttttattcaaactttattaagtttaataaaatctatagaacaaatttgacaatatctaaaacatcaaattagtgttattgaatatattttgataatatatttgtttaatgttaaagatgctactatatatttttttataaagccaaaaacttatgacatagaaagtaattaagctagtgctgagttgtaaatttgagttctcgagcggtgttcgacacgagtagttgagccacccgaattatttgggacatggagatggagtggctcattgtggacgtcggattgcgctcgtgcacagggtttatctcagctaccgattgagtcctctaaacgctttaacaaaaatccaatttgtcgaactacggaaacagcacataatggtggtgatttttcctcgatttccattaccatgactaaacggtatattttatttaaaaaaattgaccaaatggtatattttgtgaaaaaaatttatgtagaagttatttaattaaaaaaattaaataaacctatttttaaatttataataattaaaagtcaagtaactatgtgctaatggctctctcattttacatgctctaactttatctttatagtagaaaatatgacacccacgttgacgtgtcaactatttagccagtgtgcgctagttagagttacttttagaatgcatgaaagacataatatattactccctccgtcctacaatagttgtcattctaggttgtttaggatagattaagatttaataaaaaactataataccccttattaaataatgtatggtggtaagtgaaatgattattgagggtaaaaagggaaaacttttgaatagaaagtgattgatgggacaacttagtactccatagtgaccagtattttgggacaaaatttaaatcctaaagagacaagtattctgggacggaggtagtattagccaaaaattgttgacgtgttttttttaacgatcgatttgtcagccatcagattcacgtcacgaatagcaaatgtgagttacatataaataactatattatagatacactacaattatactacaaccgcgtttgaaagtttagccctatatttgaaaggatattcttctatcaacaatcgttgtagcagagtcttgcacttatgaaaatgaaaaacatcatattttccatcaacgtcttttttaaaaaaaattcatagtttttcatcaaattcatgaaattcagaagatatacgtattagttaggtcatgaaggaatatacttatcatcgtactacctccgttttttaatagatgacgccgttgactttttctcacatgtttgaccattcgtcttattcaaaaaattacgtaattaaatcacacttaaaatactatgattgataaaacaactcatgataaaataaattataattatgtaaattttttgaataagacgaatagtcaaacatgtgaaaaaaaaagtcaacggtgtcatctattaaaaaaacggagagagtattagttaggtcatgaaggaatatacttatgatgatgttcttgctggatgaacacaacatccaccaatcgatatcctcttttactatttttctgatggaaagattaattgaaaggaggagaagaatggtttggaaggttctggatttggtctaataggataatctcttttttctagattttttatgaacggatttgctagtttactgtcgacagtaaacgaggggaaaaaatgtcgaatttttgactgtttttgtctgtcggattcgcctcaagattagtgctggcacgttcgtgtaaaaaatccatgcgataactaaatttgtgtgctgcatggggttcgaacctaggacctcaatcccactagctatgcgtggtagccacttcatctcattaaagttttctaaaaagtttgcaagttatagttagttatactccagttacaccctagttacattgtaactatattgttatctctatataaattatatataaagttgcatatattatttgaatacatatatacaagttattattattatatattattttaatacatatatacaagttattattattatagtatatagttctagtgaaattatatactgtagctagatttgaaaattttcccctaaaaaaacactcgacagttttttttagctaatcccttttatgaataacttggagatttatttaaaaaattactatgccacatggttgtggcacgagcgactagcagtaaaaaccatcagctttagtaagatagatagataggataatatatttttctcaaattttttataaataacttggagatttattttaaaagctactgtgccacgtgtggcgcgagcagctagtggtaaaaaccatcagcttggggctgtttggatggagctaaaatatttttagtccctgtcacatacgatgtttagatactaattagaaatattaaacgtagactaatgacaaaatacattccataaccctagattaattagcgagatgaatctattgagcctaattaatccataatgtgctaattatagattaattaggcttaaaaaattatctcgcgaattagcactcatttatgtaattagttttgtaagtagtatatgtttaatagactaaattagtatcaaatatctgatgtgacagagatttttagttcccagatctaaacaccctcttaaagtttagttcgtggatcaaacacctccttaataagatagctagatagtttctatttcatccatctgccgttgagtccggaaggccgaaagagcgttatcttgggcctcgatctcatgtggaccctgagacccatttacacatccctttcaaccatgtgcaccaaatgtgcaatattgccatagtgcccataaacaaggatatcattgcctcgtcggattgttgcacgcggaccacgaggctggcccagttgtcagccactcgcccaccagtccggactaaattaaaaaccctatcgtccttcgaagttcgcagcgccacgccacaataatttggtcgctgagctccgttcacccatctgactaggctcttatcacaagcacactcatcgcccctcctgtcgttttcccgcgccacgtttccacgctctcgagccgccgattccaaagaaacgcgcaccaaactctcgtctagctccccgcttaacgtatcaacaccatggtgtccaagaagacctccatcgccgccgccgccgccgccgccggcgacagcggggcagcagaaacgtccctgctgccagagcgttacgccggagcggggacgccagccgcagccgcgtcggtgctcggcgcggtgttcaacgtgtcgacgagcgtcgtggcgccgggatcatgtcgatcccggcggccatgcgggtgctcggcgtggcgccgacggtggcgctcgtggtcggcgtcgcgctcttggcaacgccgccgtggacttcatgctccggtacacccgcgggccgtcgtcgtacgccgcgctgatgggcgacgcgttcggccgcgccggggccgcgctgctcaacgtcttcgtcgccttcaacgccatcgggaccctcaccgtgtacctcatcatcatcggtaacgcaccacagcatatctccccccgagccgtacacccagcgaacctgcagcgctggtcgccgcgtgcagacgagtgatatttccggggattttggtgtgagtgttcctgcaggcgacgtgatgtccggcacgacgagcgacgggaaggtgcacgacggggtgctgacggagtggttcgggcagcaatggtggacagggcgggaggcggtgctggtggcagccgcggtgctcctcctccctcttgtgctccggaagcgtgtcggtacgtaagggagcccgcgatgattgttgtttctcattaggaccgacgagcagactctagatccagtgccccaaactaaaccgcattttcagtcatttggtcgaattctaaattcccatttccggaccaatttccactacgatttggcaaaactggacggtgtcgtatagtagtatatgaattttgcaaggttagaatgccttatgaatttgggaggagctacgacatttgaaaaatacctgaataccgtagtccctgaagtcataccctttaatttgctgtgacctgtgactaattgcagattcactgaagttcacatcagccgtgtccatcctactggcagtggtgttcatgttcatcagcctgggcatcgcggtgtacgccctcttcaccggcacagcgaagatgccgcggatgctgccggatttctcgcgcctctcctctccgttcgagctcttcaccgccgtccccatagtcgtcgtcgccttcaccttccacttcaacggtatcacatcgatcgcgccattgttaacactacaccatctttttctcgagactgaattatctgccttgcatctggcagtgcacccgatccgaacggagctaagcaagacgtcggacatgaaggcggccgtgcgcatctccctcgtgctctgcgcggccatctacgcggcggtggggttcttcggcttcctcctcttcggcgacgccaccatggcggacgtgctcgccaacttcgaccgcagctccggcgccggggtcccgcaggcgctgaacgacgcggcgcgcctcagctacgcgctgcacctcgtgctcgtcttcccgctgctccacttctcgctccgcgtcaacgtcgacgagctcctgttcccggggcggcggccgctggccacggacacgcgccggttcgtggcgctcacggccgtgctcatggcggtgctctacgcgctcgccatcgccatccccagcatctggacgctcttcgagtactccgggtcaacattcgccgtctgcatctcgttgatcttccccggcgccatcgttctcaggcacgccatcagatcaccaccatggcatcatacaattctcatcgcttaacgcttggttacagttgtcatgtaatgctacaatttttttgcagggatgctcatgggatagcaaagacgaaggacaaggcattggcagcgacgatgatcgctctggccgtgatcacgagcagcatcgccatcgcctccaacgtcatgagctccatcagcggcaaggtggaaggaggccatgccgcaggtaggtagcatgtggtatattggtttgctgtccgacagcatcaagattcaaggctactgcccctgtagcgttcctctgttttacattttttttaaaaaaaaggaaaaaaaacttgcagggattgactcgtaacaatgtatacttgtgtgttgtaaggatttagcggccagtcattgttgtatactttaacaggagatgcattatcgtgtataatgtgatatagaataaggaatagtgccttcagagaaaacggttggccctcatcagttaaaaggtaaacctatatgatccattgaattgagagttggagatcggcaagaagaaagaacatgaataatggatcaaagtagagttgcctgcttgaattatggagtgtgaaatctgcttaatgcaactcattcacgtgtttgaatctcggcagtacgttccacatgctgactgttttttttttttttgagacatgctgacagtattgcattttaggcgaatgcaaggccggacttatgtccatgttctgaggctgaaagtatagaaaggcccatctcaacttttcaagcagtcttggcctgctacggcattacggcccataaggcctaaagctcagccatcagattcagcaagcacttttatagaccgacaaatagctgtcacagctctatcagtgtcctccaaaagcaacaactccgacttgaaaggtcagactccatacatctattccgagtcctgcctcgtaagaactttcgcattgcaattgataatgttgcgttgctaaaattgttcattatcattagcgatcttttgaatctgctgctgtcaacaagtggttggacgcacgcaacatctgtagtttatacgacgcccatgacgagatgtacggtgtaccaaaccccaagcaagtggctccaggtggaaacctcccatccaaccactccaaatatactaacaacttttagtctcacgattttatcctaaaatataacaattttcttaccaacattctcttccatatccaccattcacttttttcacttatcttcacaactcatctaataacaaatctccatcactcacttctacctactttcttaataatcatatccaattctaaaacttcttatattctaggacaaagaagtacttggggacctttgaaattataatgcaaatagtagcattggcctgctcatttgtgctcaacagtatctaatatatttttaaccttattttaaaattaatttagctttatttcacgttctaactttggctttagaagtatataagtttttccttaaaattgttttcgttagatgggatacgtgtctttgcttaaaaaccacagccccaaaataccttccaagcaggcccacagagtaccgagggtaatttgtacttcgcaaagtgcatcatatcggagctaaccactatttatggataaaaatatattatactccagccaaatatacatacttgctcccaaagtatcattggtgagtgattttatagtcggaaggaagattttttttaatatagaatctggtactctctgtagctcacgtatcacgacatatcaaaaattacttaaataaaaatgcggattgtctcacgtaactttacttgggattaggtaaaaatagaattaaatttggtatacaaatttcatacatctctatctctatctcttctctctactattataaaaattatgtttttgccggtattttagtacgtcatccgtatttgagtcggtttttatgtttgttcgcttttagaaatacaaatctgtatttaagtcagattttaaattcgtttgcttgtgaacatataaaagcattttaagttcggattttaatttcataaatattcaacaattaaaactagatttgatatacaactgtttgtttgttccctatatatatgattgtatttcctatacaatagttttgaaaagtatagttggttgtcatgtataactctcaacctctatttcacatacataaaattgtattctttatacaattactcaatcgatcagtgccttttacctttttcgattattaatacgaaaatttgtcagcactgttagttttcttcaggctggagtctgtgaatctgacgaaaaacagagaaaaacaagccaatgaaagaagaaaaactcctggactcgttgaccaaaacctaatacggagtggtactattaatctctctcccaatccttggcccgtgaggtcgtgacacgccacgtcacgcttgggaccacccgtcgtgacggagacaaattgttaatcccgcacgcctgcttccgcggcgctaaacggacagcacggattaacccctacctcccccccccccccccccgcgctaaactcagcggtttacgagtagtagtttattcgctcgtctcctcgggggagtccaaaccctaggctcttcctccccagcgatgcacccggcgggggcggtggtggcgccggcggcgg

SEQ ID NO: 9452 - DNA, 2195 bp, Oryza sativa
tagttgattcattgtttggggcaaattttggtcgactttggtattcgggtaagacggccgtgtacgcatatttgaagtagagtcgagatggtttcaaggccctggtttcgcgattcgatgctttttgtggtgaataggatgccattcaacttagccttcaacgtgtgcgtggattttgccctctcccaactcccaggctacctgagagctcttttgataattacctgcacttgcaaaggggatggctttgactctaatctgaagaaagcaattggagtgagggaactcatatagggccatagataggtcgatagtatgaaataaactagcttatttttctactccaagtaattatctccttaacaagctaatatttgtgaattcttatcaggcaaacaaaggatgtggtaaaggcagtgaagaagcgactacagaacaaagacccaaaagttcagttctatgctttgacggtatgttcttttgttatgtaatgatggatgcagtgttttcttggctacataatttttcatctttgaacagaatacaaattttatttcacaaaaaagtaaaggagaaagttccctgaatactctcttacccaacaatctgaagttgttgtttgtctgatgtatttagtttgaaatttgttgcagctcttggagactatgatgaagaattgtggtgaatatgttcaacttgaagttgctgagcaacatgttctgcaagaaatggtgaaaatcatccagaagaaggtccctttactcccctcctcactactaattacttgctcttctgaattcctaattttgtgcacatggtgattttctcagttgtttttttaatcatatgcattcttaatggcattgcataatttgagatgacactgaatactgctagtgtttttggtataagacatttagagtttcgtgtgttacacgaaacccctgttcttttggctggttttacggtttgtctaattagcaatcaaactaatcttctaatgcgattggatggttattctgtagagagctaatatattaaaacaggataatataaatggttaaacccattttcttcacgggtggaaggatatttttcataataaacgctgattggttgtttgtagtagagtaatagggtaactagcctgcaaaggcacttgatgtcaccagcctatcattaatatcatggttacttgttcaatgccctgcttaaagtttgatattatgtggtagcacttacaataacccatatttacctttactgaatagtttgatattatgtggtaacacttacaataacccatatttacctttactgaattaatctttgcattcgattagtcctgacctgtgcactaagaaaatttgagcttaacaccaatttcttcacctatactaattttgtggttaagttgaatcatcgttgacagtgcaccttatcttcttttttctcagcacctgatgtttacacacatcagatttatttcctggaatatcaattctcattcggtatttgcatgttgttcaattcacatcaatgaggcaattactggacatgcccctactaaaattatgaatgttttctcttttgtaattttctttcagaatgatatgttagtaagggataaatattattacttttggactcctggcagaagcatttggtggacctggaagtaaatacccacaatatcactttgcgtatcttgaagtaaaggtatgtaacaaattccatgattgttccttaagaagtatagaagccttgtttcgtcatggtatgtggaacgatcatgattacaagaggcatgtcatgtactcatgtgttcaacatgcatggctcacgtgtttatgctgaaatattcatttcttttctttgaaaacatccctataatatctaaccatatttgcaacttgtcaattttgaattcagaggataggtgccgtgttcccaaggcgtcctatagatgcaccaccgatatttacacccccggcgacacatacttctcaaagctatggttcacccagatatgaggcaggaagtctgaatgagataatgtcttccgatgttgagacactaaggttgcttcttggcatatcggattcatttggtttggtcagctatcacccaactacttcaatttatgtttgtaacatttttttctctttttctattacagtttgggtgacctgaat

SEQ ID NO: 9453 - DNA, 2333 bp, Oryza sativa
ttgtaatgtagtgatttcagggttctcctttgtttctcttcatagcatttcataggcagagcaaagaagtttgcacaaaatgtgatatgatatctgaattcatttatctgttgtttaggaatgaacagttactgaagcaaggtttggagataaatgatcggctacaaaatattatttcaaaatatgacattatggcctccagtactcatttagcagttgaagcacctccggcagacaatgttgaggctcctaaagaggatccagcagaaaagccatctgcacctcctatcagcactcttgaggaggaggaggaggaggaggatgagttcactcgactagcacaaaggtatttataagtagccttgtaacatgcagcttcattttcatgcacagttaacttatgcttcattgtgcatctgcagaaaaaataagtctgtgatgactagtgatgattcattatctagcactggagaccttgcccttgtacccattgatatggaaagttcagaatcttcatcttctgttgcaagcaatgctttagttcctgttgacccagctcttgtcagtagcagtcctcaaacaaaagagcaggatatgatcgaccttttaagcctcaccttgtgcagtcctacacatgaagcttctacagattcttcaacgcagggtcctaatggacctcagcagcctgcagttactgatgggcagcacaacccatcgggtgtgccacagtatccttcaaaccaccagtcgcatccaataaatcaggaatatattcgacagaacagaaactatgttgcaccttgggcacaaagtggtcaatattatccagcaccaccatgggctgcacctccaagtgtcaattctaatcctttccagtcagctacttaccaagaacaacccccacctgttggttctgtttcctcaacctattcagctccctcagcatcatatacttccccttcaatggcatatgtgccaccttcagcctcattgccgatatggaatggttctactacaagtaatggactaagtgcaacacaagctcaaatgaatgggaatcaacaaccgccaggttcttcagcggcagcaagcaaaccttattacatacctgacaatttattcagtgatttgattgacttgaagggtctcagtggtggaaataagatgggcgtacccactagcatgggtagtgcaaatggtggtcaacctacgattggtggaaagaagtaggtttctctaattggttggtggtgccgtggtgaacgttaggaattctgatcactcagtttggtgtacatttcatgtatatctcccttgccccatttacatgtttggttacattggttcatttcatggctgctgactgttcagtcgagtagagatggtataccattattactgtacataaatgatgagttgcgcattgccttgtttttacttcgcgactcatattttgatatgtttggcttctcattattgagcacacgcatgaaatcgtgttcgtccaggatattaaatcctgttcgtgcgttgttattctccagcatattttatggttctgttgatctcaaggaaagttctcttatatagttattacttcctctagcccataatataagggattttagagcgatgatattttctaggactacgaatttggataggtcgtagtcctagaaagtgtcacatctctccaaaaatcttttatattataggacggagggagtagtaatttcggtgcgttggtaatgcccaggatttggtctcgttttggctttgttgtaattgtgggtttgtacgcctgcctccggtgcgaagggaaggcattccagcggttcatgatgaggcccagcatggggtgtaggctatgatgagcccgtgaactaagggccaggtcgtgacaattgtgcacgtaacaagtatagaactcaaatacactgggtctccgactgatggatcaaacaaaactacttaccattacttcactgtctattcctaaaaaaaattactttactgtcaactacctccattgtcaagtagatgtatagttaaaataagcttaaacttaaactttgcagttgatatgcacaggaacagaaggtatatttgtaccatggaaatgataatcttttagcgccgagttgacacacatttagtagatgtatagttaaaataagcttaaacttaaactttgcagttgatatgcacaggaacagaaggtatatttgtaccatggaaatgataatctcttagcgccgagttgacacacatttagtagatgtatagttaaaataagcttaaacttaaactttgcagttgatatgcacaggaac

SEQ ID NO: 9454 - DNA, 8287 bp, Oryza sativa
ccctcttttttaacataaaccatctgtaaaaattattaaacttccatcaagcttatcaattacagaggaacaggtgtatattactcccacttttatacttgtacaccttctatcccaaaaaggataacttatagatataaatttgaaccaatgcttgtccaagtttatctttagaagttagttttttatcatacggatggctcctttagcaattgcatagtaacactgtttctttggttcatttcaggtagttctatttgactgtttcttgtcagtaataccattaattctcacagcctagtgaccatttataaacgctaatcctgccaaaatgattaatgtcaacagttaaatcatataccattccccaccgtgagtcttcacactctaaatacagagcaaatctgcgagagaaaacaaaccaaattgaacccattttctcttttccttctccaactcaaccccaaaaaagaaaaaacgaatttagaattctccaaccaccgcgacggccatggccatggccccccggtgcaccttgtccgtgctgctcccggttgcgctcctcctctgcgccgccatcgcgtcgccggatttccctctcggcaaaaacttcaccgtgcctttgtactaccagcagccggccgacctcgccgtgacgacgaccacggtgctcaacgcgtcgcacggcgcgccgctgcggcctggcgtcgccgccgccatcagcgtcgtggccggcacgggaggcctggaagggctgtccatgtgctccctcgtcgtcctcctgggcaacgtcacggtctgggcctcggaccacgacggcgggaggttcttggtgcggggcttctgccggctcgagctcacggtggacggcgatctgcggctgacggacgccgccgggaccgtcgggtggtcgtccgccacggcagggcgacgcgcaaaggtgatgcatgcatgactcctcctgtggatctacctagtttgcttttcaccattctgtctgcttgattattgcaatctttaccattgtttctgctcttattacaaactcgataggattgtaagctagatatgcgatgcgaggtacgcccagcgagccaacaatcaaggtatataatcgtacaatgttgttgaagatggaacagtgctagacttagtgcatcagcgttatgccgatatatatatgggtcggttgatatgaattatgatggagttatctgtccgaggatttgatgatttgtcctccctgttcttggataattggatagaggatttggcaaccttatgtctaggactggactagtatacatgccaaatactgacatgcgactgttaagtggacaatcctcgatttttccaagaactacctactagatcttatataccataaaaaatagtctatatataaaggttcatttctatgaggatttggttctgagcatttttttaggaaaaaaagggcttattttaagggctaccttgagtgttttaaaaaagcgcgcgaaaggcatggatcggatatcaacgtcataataacgacttttatcgataacctaattaataacgacacgtaagtcatagagggcaacaaataagtacaaacgacaaaaataaataaagcaacaaagtaaagctaccgttattatagttatcttttatgcaataaagtgtgactccctattgaaagtaaagcgcgtatagatttctggtggttttatgtttttgcactctttgcccaactaattgcctctcaattttgttacttattagtgtcaacctatttcatgggagatcacctttgagttatagcctgctaggaactttctataacgtattgctttttaatgtcgtgtggctgatgtcggttctctaacaagtgagcctatatgtcagccatatacgttagaggacgatacgttaaagaaagatcatctctctttctaggtcctctattcttagcaattcttttcacgtacgctttgttggttcaacctagagtaaccgattttacgttttctatcctctaaagtgattgggtcattttgaaatgaaaccaaaatgtgctatactaagttattgtcactttgaatattagtacttttggcaatgtttggtttgctaccaaaatatgctaaaatgtgacctccaacggttactttgacgtgataaccactgggcccactcaaaagtattgattgttaatagaaccaacgtctatgtccgacaacactcaaatgtgttgattgttattaacaaccagcacctttttcgcattataggtgtcagttcttccaaacaacacatcagatcagggacgtgtgctcgggcaaaaaaaaaaacactatatgttttagttgtatagacttctaataactataatgttatccctattttgcgtttatgtgttagtgataagtcaactagaaatttttaacttactaccaaaattttcctaggttttagcattacccgacattctgataaggtagcaaaacaaacaaacccttttaagtcagagctgagatactcacgttccccttatgtttcggcacaggttctgcgtctgacccggagtggcaacctccgtctcctggacgccaagaaccaatatgtatggcaaagtttcgacaaaccagccgacaaactgctacgcggccagcgcatcggggtgccctcctacctcaccgcgccggtgacaatgatcggctccgcgttcttctccttggagctcaaagagcgctcgatcactgccaacttcaacgttgggattaagaggtacacatactgggagctcactccgcgccataaccggagcgtggcatttgcggagatggacgtgctggggctgaggttgctggaccgtcaacggcgaccggtcgcgcagatctcgccggcgatcgaggcgcaggtcagcttcttggcgctcggagaagacggcaacctgggcatgtacttctacgacagccatgacatgaagttcgggccgtcgtacgaggcgctcgggttctgcgagcttcccctcgcctgcggcctccgcggggtctgctccgccgccggcgaatgcgacgacttctccacctacggtgtccatccggcgccggcggcgcaccgccacagtgcctgcaacgcgaccaccgtcgccgaccggcactacatggcggtgatggaaggcgtcaccacggcgatcaggcccgcctcgccgccgacggccaacgtgacgatgcggcagtgcgcggactcctgcctgcgcgactgctcctgcgccgccgcgctctacgtgctggcggccgtggccgaccacggcggcgcgtgctcgcgctacgagatgacggcgggggcccgggaggtgatcggcgggggccaccggcacaactacctgtacctggtgaaggctccaagaacgagagactctgagcacgagcacggagacgacgacggcgccgtgagccgcgtgctcaccaggatcctgatcggcttcggcacgctcgacgtgattggcctgtgcgcacttacatggctgtgtgcgtactactgcatctatctccgcgacatcccggtcctcgacgacaaggacgacgaggaggctgacgatgaaggaggggaagcagcccggcgaggagacgccgtgtcgcaaagtcctcctaccaacagtgaacctgtaatagaattgaactgataaatgaaaaattaagaaaaaagagaggatatactttttcttgggtgaagtgcaatgaagtacatgccacttggttcactgaagtgagcgagagccgaaccaggaacagagaactaactagcttggcaaaggggaagagacggtttgtctgtcttttaaagacccgcacgttagcccgctccaacacagcaaaacggtccagctcaacacaccaccgtggcaaaaccatcttaggtcttgcacggtttgaaagggattgatggaaaataattttacatcacaatagatgtagaataaatccctccaattcctccctcatagggattacactgtcttaagggttaagtacatggtatagaaaaatttaggagggtagaatacattgtttaaaaagtgaggggattaaatagttgacttgcaatagtttaggggtctgtgtagacttattccttggttgtttagtaccgctagcggttacagtttcacgcgctgcaatgattcttttatttagtttagtaggatgatttgggtctagtgggttgttcattaaatgatttgtttttttgccaaatcaactttttgggtagatggtttttatggaatgaatggtcttttggcctgtttggttgtggacttgtgaggaattgttaggagggaatgagagttcgaaggatggggattatcggaaaggaaaatttaagatcaaactcccacatttttaatatctagataggggcagataattgggatggaattccttttctaagtacacaagataaatgtcgaccatatatcatcacttaaaatttaattccacctgaacttcctatacttttcatcttacttaccaaacaagagacaaggagtaaaattgtaactctcatgaccaatccctcccccaattccctcctctaaactccccatctccattctcttgccaaacagtacgtttataaatagtagagaagagatttgcaattccaacttttttctccaacgagatgaatcagtcgaaacttccaagagcctattcagtttgttgttgctttcaaccttaccatattaaacacacttcaaccattgctaccttaccaaaatttggtatttctagaagcttcctctcttaaacatctaccaaaatttggtaaaggtatcaaaccaaataaagccaacactaataaaatttggtattaccaaaatgtaccaaatttagcattaccaacagttggtattgttgatatgggcaacaaatttaacaagccctagatccagctgttcagatgacaattctatatttctatgggccggcccatgtccacaattaggccgagtggtgaaagaatacgaagcccactaccaagaaacatgtctcatgttttgggccgagcccactcggaaatacagccgtttgcaccccgccggcctgacattaggcccaacgagacgttcacggtgtcttccgtctcactgacaacccggtccctacggcgtgcggcgcgattagcggcgaaagccaaccaaactaccaaccccaactgaacttggccgggcgatgcggacataccacaacaacccactgccgttggccgccggtcgccgggatcgatcgtccatgggcttccaccacttatcctctgcttgccggcagcggcgtttactgctcctcaccttgtccacagaggaggcagagattgccagattatcttggcattgttcaggtacacttgtacaagatctcttcctcctcattttgcgtagtttccagggttagattgggcagagagagttgttaggagttgcacgctctaaactctgaagttggggttactacctacttcggatttgcacatggatcctacctgggggattcaaccaacgtgaccgctgaacagtgcttgtaatgacgccgcaaccgaatatgcagttgcttttcacttggaaaaagaatatgtagccgctttaggagtgccaccatgtggtttgtgctctgatgatgttctccgatcctgttctgactgtgtcgactcaaagtctcgtcgagagcttcctggtgaacttttgacctctccattttctttttatcactataaacgacaaatgaaatattgcatcagatgagatcagcattcggtcagacattttagagatcagtggtttttcctgctaaaaggaaaaaggcgatgttggttaatctgaaacctgaagttcggttgatcgtctgaagctttaggaatccaggaaagcatgttgggcgtcagtatacgtttacatttgcaagtcctggccaccatgatgccaccatttaccgaacgagaatggcgattcaagtttctaacttatggtggtctgaactctgaattcagaagaaattaggtctcaggtatggtcaggcagtcaggctgaactccactccgtacaggagccacagaactcacgctctcctgtgccgtgcgtctgatctcaccatgaccttatgacaacggtaattcaattcagcttcaggctgaaggcggtctatagcatgaatgcgagtgctagattcagatgctgcagacatggctagaaatcattacacgatttcattgcctcggatcgcctctacgcggccgggattatcaccgtttcctttcccgcggggccatgttgatctggtcttcggtttttaatggcgtcgaggtgagctgaaagtaaccgcagcagcgagcgcggccagacacggaggagcagccggcgagggaggagttaactagccgtgacgtcactgctcccggcaaatggcagcggtggcgtggcgacaattcatggcgagagagcggcctgatcgtgaccgccggagggcggagggcggccggtgagtggtggtgaaccgtgcttgtgcagatccagagaacagtgacaccgttggttcaatgtattgaaagacatggcgcggaaattgaaccgaatggcgggaagagcttttagtcgacagctgactagctgagctgatcagatctgaattgtgtatgggaaatggtatctcttgctgcactgtcagaaagtgctgctgcaagctgaacatcagaaattgaatccgattaggattactatttgtaggatctctcttctgaagttaaatccgattaggagtactgctcagttcatgtttaagtgtttcatgcatattcggattaggacaccggaatgatcaggccaagaaaccttggcctatatatgcaaagcattcgaaagcattaccagttggggagctagcttgtaagatttgttgccgaatacttcagaaaacagtagggctagctaatctggccctaattatttgttgccgaataccaagtgtttgatttcgaattagcttgtaatgccgggcaaaatcacagtgacgtctacgagaggggcaggcaagtcagcaacggccagctccggtgagccctgcaattgatccgtcgtggctgcaaggtggccatgacaagctccgataattccggaccaggaattagatacagccattgatgccattcattgctccccggttaatagcaaacaatagcaacagatgtcatgatgtaccagtactgaatatcttgcaagcaacccgcagtctgaaatctcagcctccgtttctgaattctggtcacacctgctgagagttacgtcttgggccatagcacttgtgccctcagttgggctggttgctgtttaggctaaaacttatggcctaattgctgatctactaattagtccatactggctaacaacaaaccacataagctagctttgcagccacagtcatctccatcggacaatttattgccggttaattaaccgccggaattgcataaatacctagcagacagaggccattacagctcaagcaagtgcgcaccaccaccagcaacaatgtcttccccttcctcggcccattggctgagcttggtaggaagtatctggctccagaccatcaacggccccaactccgacttcccggtgtactcgtcgcagctcaaggagctcaagagcatcagccaggtgcagctcaacttcctcgccttcgcgtccgacgcgggcaagctcttcggatggttctccggggtggcggcgctgtacctgccactttgggtcgtcgcgttcgtcggcgccgcgttcgggctcgtcggctatggcatccagtacatgttcttggacagctccggcctccggtactggcatctcttcctgctcaccgcgctggccgggaatggcatctgctggatcaacaccgtctcctacctcctctgcatcaacaacttcgcgtcgaacagccgcgtcgcggtgagcctcgccaccagctacctcggcctcagcgccaaggtgtacaccagcctggccgagacgttcccggggctggccaactccaagacgaagacgtacctcctcctcaatgccgtcgtgccgctgttcgtcaccgtcatggtggcgccgtccctcaggggttcgacctcaagagcgcggcggcgagctcggacgcggcattcctcgtcatgttcgcgatcacgctcgccacgggcgcctgcgcggtggtcggcagcatcggctcgacggcgaacgggctgtcctccaaggagcacatgatcagcc

SEQ ID NO: 9455 - DNA, 2705 bp, Oryza sativa
tgctgaaaagcccggacttctggctctattttgtcagctacatgttcagtggcaccctcggcttggtcttcctcaacaacctcggtcagatcgccgagtcgcgaggaatcgggcagtacttccactctggtctcgctctcgtcttcgtttggattcttcggccgtcttctcccggcgttcatggactactactccgcgaagtaagcgatcattcctttcacacacttccatgattaaaaaaaaactccaagcagagtagcaaaatttgtcaaaacagagtattctttaactactacatgagtcctgagattttggagaccacgtacacttgttgttatcaaagattcatgcagtctttgtttgtttttcttttcaagtttcaaagacgacgtgctaactacttgttgctactgcctactataagtcgtagagttagatcttggctgtttgtgtcagagtgattcagtagctcgctggttttccagttccagaggctgattaattagggtgctaactgaaattttgttggtttgtgcagaagtggctactccatatcgaggacggggtccatggcgtcgctgatggcgcccatggcgggggccttcttcctgctgctcaaccagcgggacttctttctgtacctggccacggcggtgatcgggacgtgcacgggcgccatcacgtcggtggcggtgtcgacgacgcgcgagctgttcggcaccaagaacttcggcgtcaaccacaacgtcgtggtggccaacatccccgtcggctccctgtgcttcggctacttcgccgcgttcctctaccagcgggaggccggcgcccgcggcacgctcacctgctccggcgccggctgctaccgcgagacgttcgccatctggggcacgacgtgcgccgtcgggacgctgctctgcgccgcgctctacgcgcggtcccgcaattttgccgggaggctacctgtaaggataccgtcctgcctcgcccgcttagctaaccttgtgtagggtgctagaactttcttacacctctcagaggaggcctcttcttaatttaacgaccatacacgaaagcatcagccattaggcgatgtaattaattaggttttgtttctttccaccacctttttctttctttctttctttcctttggttttcttgactgattatcccacggggggatacagacaaaaggttggagcctgatcagtagatattgtgcaggctgatcaccttgttttctctgcatatattatatatgcaatcatatacgagtggttaaggggaattcaggtcttgatcatattggctaagttggccatgctactggtactagcatgttcatttttctttttgggtttcgatttattagctagtagtatttgatagcactgtagtgctactatgaggagtactacgtactgacgtacgtggagctggaaattcgcatttatgcgtgtgcaactacgggcaactactgccatttacatgagtggtccactgaagtctgtagcatgtagttccacgttattcaattgaaagccaggtatatgatagtactaacagtttcgaatacttgctgttcattccaccgtagcctgatagttgcagttatatggaacactcgtaggcagatagatttatacgtttacagacgaaattgtcaggtaccaaacctagtgcttgatcattaagtcaaaccagatccacgtcaataactgtccataacaattctgttagtatctcttcgtaccgtatatatagtcaattcgtagccgtaggtctaggacaaggcagggaaagcatgtaggcgttttaaacttttaatcctcttctggtgaaagttggacaaccgtgttaatcctcttctcagcaggcggtatcatcagacgtttaactgaaagttacactatggcccatacatgtgtgaaagatcaaatgaagaaatgttcaacactatcctggccacctttaatttctggatatgttcagatgcatcactgctactccctccgttccacaatgtaaatcattctcacatcgtggaacggaggaagtagtacttatctttcgctcatttgagaaccatccggctatcccgtccgacagtaacagcagtgatgcatccaggtccaatccacacacacaagctgaacagtgttatatagaagaattttaccatggttcatgtaagtactaagtactctgtatatacatatgcattgcatgatcatagatatatactccacgcattgcatgattatatggactcctatctgacaggcatgtgaggaagatgtaaccatttaaggatgggcagagtaggttgatccatggtggccatcggtctctcgtggtccactcacatgttgcatcatggcactgcgatgcaaagttcagttccatcttcccccgtgtacttggatggacaaatgctatttattcgccgaaagcttgcagagccatcaacagatcaactccctctagccccctggccggcaagaggcgtctccgccgtctagctccgtacgtacgtctccgatctttcagccggtgagctactaaaatcatttatgatctgcgtggttggttggcagtattgttgagactgcaacatcgacagagcgatctatcataagctcagcttaggctgtgttcgtttggacgttttcccagcgcgctacagtagcacggaaaacggaacgg

SEQ ID NO: 9456 - DNA, 4115 bp, Oryza sativa
gtggcgcggtggctgccccctaccaagctagagggaggaggccaccctcgcttggggtcgagctgccccgaccccctccacatatcagcccacgtgtacagggttaggtgggcgcgcctaatgcccacctaactgcatttaaagcagtctatgcaaccgcgccaggccgcatttaatgcggcgtgctgcgcatctgaccggttgaatgaccgatgggatggcgactgtgtacccctgccctgtcagtgtgtcaggcggcgagcggcgtgctccatcccgtcccatcataatgatgaggggcttcacagcctcttaccccggtcagagctggtccaaccactctgaactgacccgggttcccgttttctggtgtgaacgagaacccgaaagtcctcatccattaaatggcgaatgacaagggcgctctgcattgatttgatgggccccgcgcagcaaccgcggatagcttctgggctaaggcacaagacatgtaattaatatagagaatattttcccttctccctaggtagcactcgcagcacatgtggtatccccttagagtataaaaggaggaccatgcctagcgaggaagggggatcggactgaggatccctgagccaaagcttgtctaaccctagcttgcataccagggattcagggactttctaagcacagaagaatcatacacacaggagtagggtattacgcttcatagcggcccgaacctatataaacctcttttgtctcatcgtcttggaggggcctccgagatcaagatcacacacagtttcgctcaccaaatcctcgaatctcacccgctgcccctggccgaactctcaaaggagggcctcacagcctcccgctagagagggtcacccctcaacaaagacgagtggtcaaacaatgcaaacaaaaactcaaaatcccttatattataggatggagggagtacgacagaaaggagtgattttgtttagtgccgtagaacaaaaatatttgaaaaaaatacataatcacaaatatcttgaattgcaaaagggcgtagctagaaattgtgatatgaatgatactttttaaaagaacttttcacatttattttatgaaagtttggtttgcgaggatcttatctatttatagctatattaattgagcacttcgagtgagctcttacatgaacttaaaaatatataccatttgataagtgaatatgtaaattacacattcagatttcgtgttaaatgaaacatattccatggattctttatatttagttgatttatctccgatgtttttctttggttcgacgccatttgccaacagtaatgtgagcggaattcgatcgacaaaagatctaccgttgattttagatttttttttctattttgaggaaggcaaggactacgtacaacttaatatcagttgataaaaacaatagttatggacagggcactatgaccaaccctagagggagatttgtcttttaagatggtttttcttattagtttctttgtaagaattggctttaacttctctgaaataaaatccagaatgaattccatcatcttaaaatagaaaaaaaatagttatgggcactatgaccaaccatagagggagatttgtctttaagatggtttttcttattagtttctttgtaagaattggctttaacttctctgaaataaaatccataatgaattccatcgtcttaaataaaaaaataccgtcttaatttgagagataccaagaggtgccaaattttacagtagaaaatgcagtacctccttgtacctccccaaggaccgtaaaatccctctcttaaaaatatctagttgttacaaaaattggaattaatagatatggagttgtttcatcgctttattaatttaatatgaatttgaaattgtcgacgtttgatgtcgcgattccggtatttgcatagtatggggatcgttagtactaggatatatgcgagattgtagtaaaagagatgagggcgaggatttttatacaggttcgggctcctgaattgtcaggtaatagccctacatcctgttggccgaagccggtcgttgctcttattcaccataatcacaccagtacaatatttagggtagcctatctaacggttgtcgacatggcggtctgaaggtctgactcgtagtcgacgacagggtagtcttcctcctcgaatccgtgcccgatgagatcagagacaacgctatgtctctcctgacagtatccggagacaccgtaggggattagccatgcctatctctgaagtcgatatccggcttcttgtcttggcgcatgttggcttgtatgtggatcttgtgtcttgatctattgtttcgtgtcccctctcctcctagggggccttgtatttatacccatatgtccccttgtccaagtaggactagggaaaccaatatggatacaatccgagtagtccttgtcgtttccatgtaaaactctattcatccttccttatgcagaactccttctatatctgaaagttgtttccgtataggacatggtatgtggtgggtcctgccgagatttagtcaactattattaggtatgtggtatccataaccttgacagaaaccaataattatcaagttgtaactgaaacaaactcttctttttaaactaatatgctaaaattaacaaacaaatttagaaataaaatgtagatggactcacaatttagctattttaaatataattataaaattcaaagttaacaattagccagttgtaactgacacggtttcttttaatttaatatgctataattctaaaaacattcaacaacaattttagtgtatgatcaaaatttaaaatatatataaaaaatagcaatagccaatgtaacacatgggtgtgacatcccgacctaggggttaataggattaatagaatactcatatcaacaggttacaacttcttttccggaagccgatctccaaagaacaagttgcaacttcttttccggaagctgatctccaaagaactccagggttaagcatgcttggcctggagcaatttgggatgggtgaccgaccgagaaattcttatcaacaagttgcaacttcttttccggaagccgatctgcaaagaattcttcccgggtacgcacgagttcacagagggacagtctatgacctatgaaaactatcagatgtaagcgggcccggcctgggaagaggcgagacgttacaatgggttaatgactaagtggtatattaattcacgccatgggacagtctatgacctatgaaagctattagatgtaagcgggcccggcctggggagagacgggacgttacaatgggctatcagatgtaagcgggcccggcctggggagagacgggacgttacaatgggttaatgactaagtggtatatcaattcatgccatgttttattagcatggctgtgaacaaatgatattttgctcaagtaaaaaggagtgtgagtagtactaattagttttaagccatgggacaggctatgacctatgaaagctatcaaatgtaagcgggcccggcctggggagaggcgggatgttacaatgggttaatgactaagtggtatattaattcacgccatgttttattagcatggctgtgaacaaatgatattttgctcaagtaaaaaggagtgtgagtagtactaattagttttaaaatttcttgatacagtgttacttcctcatattcataatatagtgatttttaggattcaaattttgtatcacaatataagtattcatataatgattcctatagttcccattattccaactataggggattgcccctattcagttttgcgctgaggtaggtgacggagctcgtggctcctcaccgggagaccgcgcaggcccccctttgccagttcggccgggggcttagggtgaaatctcaagctctcgctctctctgtatgtggaaatatcgtctgccagccagaaaacacgagacaccggcgatctatacaggttcgggccgctcagaagcgtaataccctactcctgtgttttggtggatctgtgtatgaatgagctacaagtgtgagctgtcttctcccccgttctaagctcctaatctgggaa

SEQ ID NO: 9457 - DNA, 1095 bp, Oryza sativa
gccactcctaaagcctggtgacaggtgggaccggtctccgtaattgggcaaaatacccaacggtctcaatccatgcacatcggtattgataactttggttgtccataatgggcggtctattcagactgccacaccacttgagcagcgcgcgaatctgggtgagcagatttgtctcgctcggagatacggtaacgccgcttcggtcggcgagcgtaattaacgcgcgcacgatacaatccgtttcgattgccacaaccgcatatccacttcaagcgccgtaagcgggcgaatgggattagtggaagcgtgggcacgggaaacgggggagcgagatagcgagatacgagggagcgaggtagtgggcacgagaaacgaggagccaggcccagcgatggcaagggtataaaagcatcgagaaaaggatttgctcccttcctttcgccattgttcctcttgccttcgctgcctgagctctaactctttctctgctacgccctactttcgccacacgcgctcgttcccaatcatctcttcctccaccgccatggcacggggctctgctctgctcgacggcagtgtactgccgccttcccgcatcgtgaatgagaggcacgccggactgccgcgccgcttcatgccggagtccgccaccggtcgggagattgtgatgctgggcgaggggcgcccggcaccagactacccggggcggtccatcttcttcctccccttcgcgatggctgggctggccccgccattttctcatttcttcatggacgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggttggcggctgctacttccagccgcgggggccggtgctgaaccgctatatcccctgcgtcctccgcaagaagtgggacgactggaagagcgactggttctacaccccccttgccgacgaagcgcgcctccgacttccgagccagcccccggcgcaggt

SEQ ID NO: 9458 - DNA, 2063 bp, Oryza sativa
tggatccccgtgtttgactctcgacggctatgttgtcctcagccttgcaaactgttgacatcgtgcgggtaaaactggacagtctctgcagaggtgaattaaatcattcgaatgtgccgtactcccggttctggagttgtgccattagggtgattcctactcctgaagtataagtagttttaaaaattaaattgttgaggataaagatgatttatggttttcattactcctttactttattattgtttatttattcatatctattcatctttaattatttataatatgtcttgctgagtacatatgtactcacccttgcataatttgacatatagaggaaacgtgctaataaggagatcagaaggaagcgagatctacgacaagaacgagtttttctaggctagtctacactcgagtttttgcctgtggagttctttgaagttctttggaatttattaattgtagttctagtagttgaagaagtttaggagtttagtactttggattttcttgtatttcaaataaggatattttagtttggatcttttcaccctttaacagttgtataattagcttgtatgaacaaacctgtgtaaataatcgaaagctgttctgtatatcaatctatgcgtgatcgaaatcctgaacgatcacgagtggatttttggggcaccaagcctaaattgggtgttcccacacacggcgaccaaatcaatggtaaaagctgttgtagaggaggatccgtgggagaagatcatcgaagcccctcgttgctgacatcccacattgttgtctcctcctatggacgagtggctccgatgtggccatcggtgtccgtgtcctggtcagggacgttctccatctatggtttcctcctacatgtcgacggggaaccaaggggacagggggcaacaacgagttgagcctcccctctgacaaaggccaagtaagcttaagctcggacgggctcaccggccgcctccccctccctctccttcctaggctcgccgactgcctccctccatcccagactgatcggttgccttcctcacggccaacacccaagcactgtgtgtggttgggaagaaaatagtagaaagaagatggcgctgacacacaggtcccacaatttttctcctcacttatgtgtggttcccacattttttttactttttatttgctgactaggatgccacgtcagtgaaatcagacatttatactactacgagaccctaaattacacgattttatatagtttagaggtgaaaatttttgttattggagacaaagatgtcaaacaaactcaacgcaaagttaagagatggcgagtggacttattccttattggatcagattataccggtgtgtgttttatgccgggccgtttcggccttggtcttttccatctttctctacaggactataggacgggtacgcctaatgggcgggtgatcgctctccgcccctcccctatatcgtcgctccctcctctcccccttcctccttccctttttcttttcctactacatcataaatatttaaatttaaatttagaattgaaacggttatgtaaatttttgacttataaactttgggtctataaactaatatttgaattcaaattcaaatttgaattggatataattcaaattcaaatttgaattgggtatgtaaacttttgacttataaactttgggtgtataaactttagatgtatagaaatactatatataaaaatatttgaattcaaattcaaatttgaattggatataattcaaattcaaatttgaattgggtatgtaaacttttgacttataaactttgggtctataaactttaggtgtataaactttagatgtatctaaatactatatataaaaaatatttgaattcaaattcaaatttgaatcgggtatataaacttttgatttataaactttgggtctataaactttaggtgtataaactttagatgtatagaaatactatatataaaaaatatttgaattcaaatttaaatttgaatcggatatataaacttttaatttataaacttgggtcta

SEQ ID NO: 9459 - DNA, 2601 bp, Oryza sativa
agggtgcctcttggtgcatgctctccaggtgaacggaagagccagctgcgtctgcagctagctggcctccatggctccatccaccgagaacagttcttccagaacgactcgtagcacgggtaacgtccctatttctccaacaaatataggagtagcacggaaaactacatcgaatagcacgccacaaaataatcgcggttgcaacgtgcatgcatgtggcgcacgacctctgcagctgcgcgtccgtctcgtctcgccgtgccgttgcgcatgctcgattaagcgatttattattagcaagttgcacctggcacgtactactagtactgtacattgaatttggtgccagactcatcaggacttgttggcttcctccgccaggccagcgacacagcagcaatggcacgtcgtcttttagggcaatagcaatgcgtcacctaaaatgccggacctgagctgccacatatgctgaggaacactaagaggcacaagcttcacaatgcagtacctcaagtggggttcacaaaaatatagttttcctttttttttctccacctttccgctctctctctctccctttcctcgagcccaacgttgctccttcccctctctcacgctcgagcggagccggcactgaggcgttcgagcggagcggcggcctcgacggcgacggggccgggcggagcagtggcgagcggagacggcgctggggtggccgggcggagcgtcggtggatctggggacgacggcggtggcggcaaggaggagacgacggcggcggtcttggcatggaggccactcactcggcagcaaggaggcgacggcggcggcggtcttggcggggcggcgggcttggcgctcgacggtggcgaacttcttggcctcccctcctctcgcatggcggggacgagtctcgaagacggcgtggcagcgacgagtctcgacgacggcgtggcagctcgccagatccagtggcgacggctcgtccgggcgcggcgcgaggatggctgcggccgtagtttcgtcgccgccaccatggtcgtcgccgcgctgccctcctcctcaggccggcaacgcggatctggcggtacggggcgacctcggagcggccagcgagctccgagcgacgcggaggcgacacgcccttcctgtcccccacgaccgctggcgccgctcactccaatgccactcgcaaccggaggctcgagcgcctcccctcctcctcctcttccggccctgcaagggcggcgcggccggcgacctcggctcccacggcggcgacccctctcctctggctctcctccgaccggcgtgaatcgagcgacggagtggccggcgagcttcgggttgagcggatcgggggtggtgtggccggcgagctccgatggcagggacgagaacgagctcgacggctgcggacagcgacggcgggctaggcggctggctggagggcgacggctggcatgggaaggagggcgatgccactcgctccacgacgcgaaagcagcgtcgtctcccagcttcattcgtcctctttttcgccaagaaccaatggccatctttggacactcgaaccttattctggtgggcctagaagtagacgtggcgtgtgccctcctgctttgccgatgtggaatggcgagggagaatgacacatcagtaaatggccttacggcatcgccgtctccctccggcttcggcacatggccctcgtaggttgcacttactcgatttatgacaaatttgtgcacataggtataaaccaaaaagtgataaaagcaaaagtgttggagtacgtcagtgctagtatctatttccgtccaactttggtggcaacgccgtgacacatgcatgcgtttggtttcagatacggcctccactttcttccgttatagtagtatttaccactactgcctgacaagtgatttactagtattttccttttgaaaaatcaaacaagaagtttcattacacctaatagcaggtacaatagcaggctattagccagctataaacatattttaatgagataaaagatgagagagaagagcagcggactacatatctgtagccagctgcagcacggactccaagacgtaatgtatgtatgataggtgggaccatatattaatagtacagtaagcaactattgtattaattggctataaataaattggagctagtagtgggctattatattaaacttgctctaattaaacgaatctatagtcgatgatagccaatccaatgggacactaattaactgatttacacttatcacctggagtcctggaagtcttagtcggacattaaatgccgcatagcaaaagaacaaatgtcccttccctgtgcggtcgctttagggagagatggacctgcgacgtgcatgcgaggttggttgcacgtcgccgatcgatggaatgatcgaaagtgtttctctaatctggacccaacccaaagttgctccgagcgcgctgcgcaagcaatcgaccggtcgccggttggactgttgatctttcgcaatctcgggcgaaacttagaccgggctggaccgattgccccccaaacccatacgcattcgcgcaccatttataggcctac

SEQ ID NO: 9460 - DNA, 10427 bp, Oryza sativa
tcagttggtttggtccctgctaaacccactcttagtgacgagactattcggatttaggttgagccgttgccctccccctcaaacatggacctgctaatgcatcatctgtgaggcactcagactcaactaatccgaagctgtttctgcagactgtggagggagtacatgaatttggttccgtctcaaaccaaatcctagctagcaacctctccgggtccggggagcccacgtgaaaccaagccgtggagaggcggatgggacgggaccggatcagcacccgcgcgcgtgcgttcgtgcgggtgcggcgctcggtttcgctcgaaacggtgggcgatcgagttcgtccaagtgagcggcacggcggcaggaccgcgcgatgagccgatgagacgagagagagagagagagatgagctcgcgactttgattggtggaatggtggatgccccacgccgacacgcagatgacagaaaaaaaaccgaggggttgatccatcgatcgggttgggtccccccacgccacgctcgatcggcagtctgcttgctagccccagatgcatgtgtcccctccctgtcacggcagcgcagggacgcatttgatactgctaacggctctctctcgctgcctgcttgcccatttactcccggcgcctctcctgtaccgcattgtgccttcgtcgctagcttccgcagagcaaccgccggttccatgcttctagactggagctagtaaactttcgctataaaagaaaagcgttcaggttcttttgtttttctttttttcagtagggtacatgcgtgatctcctcctctaattgctgtacctaacagtattgtcagtgcagcatccagtgacaccctggcgattgatacggggacgactacaaaagcgtcgtgcttttattatcaagaacctgccaccggctttgctacttcacaccgacgccgtgccggtcttatccctttgttaacacagtatcgtcactagtattttagcataaaatggcgattaattaaggagtaataacatattgttttcagccaaagttttgatgcattatgttttatttggatggctactgttgaagatacatgataactagtcgacattttgctggaacttttggtgtcatttggtacgagttctacttatgatatactccctccgtcccaaaaaaaaaaggtaaaccttgggtatgaatctggacatacatcatgtccacattcatatctagggtttgtactgaaagcatattaaaaaaaagaagaaatgcagtgcgcacatttgtcatgattaggtggccagttgatgtgcttaactagtgaatcttaatgatagattaggtgcagcgttgtatgggccctgatttttccgatgtacgtctatctctattcttatactttattcgtcctaataaattttataatggcatctttcagtatatattctacgcaagaacaagttccatcgttcctaataacaaaattctaaatcattgtactatgactaacatattatattttccgctacttgcaagaggaaccatatcaaccttgatattccgttgcatcggcacggctattttcctattgcattctttgtataatataaactttgtataatataatccaggctaaataaataagtagttttttaaagaactttaattttaaagacaaaactatcattttgctgcagcattagagcaagttaaaatatgcccttgtttagttccaaattttttcttcaaactttcaactttttcatcacatcaaaattttcctccacacataaacttccaaactttccgtcacatcgttccaatttcaactaaacttccaattttggcgtgaactaaacacaaaagctaactagaaatttatgtaaaggagagaatttaaaaaatgaagagggttagctttcatataaaagctactccctccgtcacataatataaaggattttggtggaatatgacacatcctagtactatgaatatcacatcccactaaaatctcttatattttgggacggagggagtagtacatagaaaaataaatacattaaatacataggtgagaccgtgagagataaagaaaggagaagaaaaatagagcttttttttattaaaagggtatgacctctccatttctattagaagaaaaatagagataaccttacgatatattaactctaatatgagttatatgttcatagttggctctagctgacacatttccctaagctacatcaataacaaataaaattatcacataactaccccattattagcaccctaaacgtttataactagatacgcccacttctaacagtgagactgtgagagggctcggaggcagccaaatggttggacacgtcaatagtccatgtcaacacaggcaccgtagcggagtccggttacactgctaaggcctggtttagggcatgtttagttaaaaaaagaaaattttagggtgtcgatgtttgaccggatgttgaaaggggtttttctcacgaatgcaaaaactaatttcataactcgtctggaaaccacgagacgaatcttgcctaattaatccgtcattagcacatgtgtgttactatatcacttatggctaatcatggactaattaggctcaaaagattcatctcgcgatttctccctgcaactgtgcaattagttttttaaaaatctatatgtaatatttcatatttgatgtgatgttttgggaaaaaaaaatttggaaactaaaccaggccttagttcccaatttttttcccagaaatgtcacatcgaatctttaaacacatgcatggagcattaaatatagataaaaacaaaaaactaattgcacagtttgcatggaaataacatattattttcagtacatattatttttggctttggctttggccagccgcgccaagcacctaatgatcctaaaatttgcaataaaatgttatatccaatatgtgtcttaattattattttctactgcaacttagtaatctcaaactttaaattaatataaatatcaattttcactctttgaatttcatttttattttagtatttttatcaattaatcacactttaaattcagaattagtatttagcaagtcgtaggtgatgtttaattgatgatttgatgagctcatcttgcactctcaatttagtagtactacctctgtttcatatcatagaagttgttttgattttttttaatcaaaccattaatgtccaaccaaagttataaaacaatatagtaatatattcaacacaaagaaaacaactatcaaaatatatattcaatgttaaattcaatgtaaataattcggtgccacaagtgttactatatttttactataaacttggtcaacttttaagaagtttaactttacaaaaatcaaagtgacttataatattaaatggagggagtacttattaattaatgtaactctaagatttgaaattaatatgaacatgtcataaaatctgtggattctttttcaatccaagctgttataatccaaccccacataggtgaatgcccatataattgtggaaatgctattttttgccgcttccaatttgtgatggtatatatgcatgcattagttagattattaataagacaaatacaattattttttaaataactataggtacactgaatatgtaatgaatagacatgtatcttcataattcaaatttgcatgtggtattcgtgggctattcactactattggtaatatagagaaatcttaacgcaggagagcagaccacctacccactaatctttcaacagcattaatcttttttgaggagaacatcactaatcctaacacctaattaaaagatcaatagttcactgttatgacttatgaattagttatgacctttataacgttgatgaccaaaggcagctatcacttttgtgctggcccctccttaaactcgtacgtgtgctgctggcctgtttaaattgaccaggaatgtcaggtcaaatacaataaaacatggtttaggcgcacgcaaagtgctcgtactaagccgtgcgagctgcagtaactcaagtacccaacacaccccagaccaaacccacccaaaaggtttctgctagtcggctgccaccgggtgatggaaagatgaggcaaaaggtaatcgcggattgatgaaaggaacgcgcacgtgaagcgaattgtatgaattgacccgatctgcatatcgccaccaccttggttctctgaacttgcgcgaaacctttcctgatcagcacgtcgggtcgtcggctacggcatttttttaagtggagtgatcagcatggctgcgtcttcggagcttcgcgcgcaggtagcagcagctagcccccgcccgtgtcgtgttcctcgacgcgtcaccgcgctttcgctagttggaggtagccgaactgccggatcacagagaagggcgtcgtcctccggccggcaaccgcgcagcagggtgttgggcgggattggcatgttccatatggcatcgcgcacctggaatttgatggtgtcaaatcgaatagtataaggaaaaagtacgaattagcctcccgaactatcgtggtcgtccgaattactccctaaactataaaaccggatattcttcatccccaactatgcaaaccggacgaattacccccctcgatccaatccgcggtggttttaaattacgtggcatacacgtggcagtccagtcagcgttctgtttattaaaaaatgtgggaccagatgtcatactctctctctcttctatctcttctatctctcacacacactctctcctcccggcaacggcggaggtagcgagtgcggcggcggaggcagcgagcgcggggaggagagcggaggcggcgaggcaaggcgaggcgacggccgaggcagggaacgcggggaggcaagcggcggggcagggcggcgcaggcgagcggctgcggccacccctcttcctcacttccccagggttgcttaggttgacggcgggcgcggctgggttgcttcggttgacggcgagcggcggcggccaccccccttctggcacaccgtcttccgtgacctgctcggcgacggcatcttcaactccgacggcgagacgtgggtcgcgtagcggaatacggcggcgctcgagttcaccacggcatcgactgcggcggcggctgcgggcgcggaccggacgctgtgctccggctgtgccgtcctctgcttgctgctctgccaggagcggttcagcgggctgcgcgtgccggtgtggctgctgctgccctgctcgactacctcgtcgccgttgttcgtcgagcgtccggtctgtggactccaccaaaactcaaatgatagaagaaaaccatcagatagattaacaggtagaagcacaaaacgacgatgaacgagatgcgacaagccaccgggaaatttacaggggaaaaatcgtgcttcccgtctctccgccaagcccccacctcgacgacgcctccgcccgccagcgcacccccgcgcgccgccgtccaccgtccgtccccatgccgccgtgtgccattgtgcccaagagtcgccgcgacgcctccgctcggccatcgccgcgacgccggtgtccgccgcccgccccgtgcgccgcgcccgcagctgccgccgtagtagcctccgctcagccgtagccgcgacgccgccgtttgccgctcgccctcgtgcacgcctgcagagggcagacagagagagattgagaggaagagggggaagagagagagagattgagagaaaagtggagaagagagaggtgggagagtatgacaagcgggtcccactatttttttttattaaaaaacgctaattgggatgccacgtgtacgtcacgtagaccaaaaccaccgcggattaggtcgaggggggtaattcgtccggtttgcatagttgggggtgaagaatgtccggttttatggttcagggggtaattcggacgactgcgatagttttagagggtaatttgtactttttccaatggtatatggaagttacttcttgcttcttccatatggcatacatcgtcctccgataagccgtagcttggatcgagatattatgggttgttcttggacgtttctttaccctgttgatccgcgcaacctgtagaccacgtctctgaagtgaatgtaaattttcgacggtgtgtccggtagagttttgaccgtgttcatgcctttcacggtggtgtcgtcgtgattggtaacaatgtgcgcataaaacaaaccaatcagtaaagaaattgttaaaggtaagttagacgataggcacgtcaggtatttggaggggttgtatataacatcctgaccaaactatgacttgacctgtgtggtttatgagaattgtgtacgcatgtttagtttaatcttgttagtttactaaggctgtgttcagaatcagccgttccaaacttgcacagtgagcatagaaaacagagcgatccattagcacgtgattaattaagtattagctattttttaaaaaaatagattagtatgattttttaagcaactttcttatagaaactttttttttgtaaaaacacaccgtttagcagtttgaaaaacgtgcacgtggaatacgatggagagaggttgggaaccctaggttccaaacacagcctaagggttggaccaacttataggcctctttcctccaaccgtgccacttttgaattaacccttttacacgatgcgatgacgaaagtgtaagtgggtggtgtgtgtgagtgggcctgcctatcagatgggctgggctacgcggttctggaaggcgggttgttacacacaacccaaggggaggaacatggttcgtgcctcgccgttcgccgttgtcgccaccctagtccactatatctgtcgcctttctagttgttcgccgcagtcaccaccctagtccactgcatccgtcaccgctctcgtcctccatggcagtcgtcaccgtagtcgccaccctagtccactgtatccgtcaccgccctcatcctccatggcagtcatcgcctctcgccgtctgtcgcagtcgccaccctagtccactctaaccgtcaccgtcgtgagcaactgcctcatccgctgtaggatcaaggaggccgactagaggggggtgaatatgcggttttaaaacttaatggcacttcaacaaaactaacctaagttgctaggcaaggtgaggtgcaaggttaactaagcaactaagttaagttttgcaaacctaagtgatatgggctcaaatatgtctctatgaatgtaaattgcacaaatgtaaatgcaacaaataaatgagacaagagacaaggaatttttcaccgaggttcagaaacttgccggtttcctagtccccgttgaggcgagcccaactccaccgctcaaccacgaagccaccgcacgcccccttcatcaaggggtgggcaaggtgggagccggcccacggagaggactacccaagcctcgatcactagggtagttcttccttcacttcgaaggtggtgaactccaaaccactcacaaacggcgccgggcctcctccacaatctcctcagagaggtcaccgggcaacacctccacaagccgtctaggaggtggcaacctccaagagtaacaagtctaggatgcttgccgaggatgatcaagtgccacactagctataacaatgaagcaatgcacttggattggcttaactcactctctaacacctcactagataaactaagtgccaagagtgtgagagctcttgcaagggttcaagataatgcaatggagtgccaaaaccttacccttgttgctggggaaagggtatatatacccccaaccaccaaaaccagccgttggggtcgaaatccccaactctgtgctctgccggtccgaccgccatagagtggccggtcagaccggactactttgtaacggctagttggcagtcattgagcccactcaacctggccggtctgaccgcagtgtagtggccggtcagaccgtccacggctcggtcagacctccttcggctcggtctgaccggttgcggctctggcagctctgtatcaccaccataaaccagaccagtgcaacagaccattgaagccggtcagaccggccttatcacgccggtcagaccggctaacaggcccggtcagaccgtcctaaggcccacggtcagaccgcaggttaattttcagcacaaccaaccgttagtaaaatgcgatatctcttgactcgggtctcggaatttggcgctcttggactctatggaaagcttattcaaagggatatccaatccatgaacaatccatccaagaaacacaacttttctcagggagaaagggctcacactccaaaggatactccaccggacataaccacatgaggctacccaaacctataggatttgcccacatatctctttgtttaggacttgataatactcaccacacttggctagacaagcccaccaaatacacctacatgcatatgaactaatatggcgcaagatcatccacatgctcgcttcatagacccctcttaatagtacgacgtctatctagcaaatccggtctacaccaaacaccaagaccgggaaaagactaagaaaacattcgtagctccattatacctttgccttgcgccatccaacttggggtcaatgcttaagccaaaatcaacacttgtgaccatccggttgaaccatgtttatgccgaggtctttaccatcctttgtcaagactttattcccatcacaagtttgacttcattcttgccaacatgacgatgtccttggcttggtgaccattaacccatggtgtcattcaatagccttatcgtagtgggacctattccttttcacatctcaacaaatcggatgtagtataagatattttagataactgtgtgtccagattcatagcaaaaagttgctatattttgggacggatgtagtataagatattttagacggatgtgatacatcctagtattagtattaggatgtgtcgcatccacataaaattctaggatgagtagaatatttatattatagtaagcataaaatttctatattgtacccctccgtaaaaaaaattcaattctaacaacgaaccgttattttctttttacggaataggacatgttagctactactcactgtagaggacatgcatattagggggtgtttagatggggctaaaactttttagcccatgtcacatcggatgtttggacgctaatttggagtattaaacctagactagtaaaaaaactaatttaataaatgagagctaatccgcgagacgaattttttaagcctaattaatccataattatcaaaagtttactgtagcatcacattgtaaaaatcatggcgtaattagactcaaaagattcgtctcgcgaattagtccaaggttatggaatgggttttgtaattagtatatgtttaatacttaaaaaagtgtccaaacatccgatgtgacagggacttggaataagtctctataaaccaaacaggaccttaatccagcagccggctcttgtatagatctagcagttactccagttcttagtgtgacaggtctcccacttccacgtgaaaattgcctggatttgaacaaagtaatctttacagctatccttaggttctgacgatatctagtcctccacatcttcgcctgtcctctcacaaaagccactctcaccgtacttttaactccactcgggtgcttagctcgtccctcattctgtcccaaagtcttactctcagccgtcgcaacccgagagcgagatgcgatccgatcaaaaacgaaacgggctgactcatcatcactcatccaattcccatcccggccgtccatcgcgccacatccaacggcccaccatgcgacgaccctgcccccctttccagccaatgcatcataatacattaatactatagtatgcatataagataatcctaataccatcacaaataaactaagcacatgatgcataacaatcacaatagaaataaacggaaaaaggcaaaatcagtctaggggattccttccagctctcaaccaactcgtcacgccacgcctaccgcctccgaagtttataaacctctctctcttttcgagctctccgctgcgtgtccaccatttccgtttggttttactccactaataagctaaggattttttcttttggttgtggttactgcgccaatggctggtaatccggcggcggcggcgccgtcgtcgtctggctcttcgtcggtgttcctgccgcccccgtcgccgtccgacggggagctgctccggccgctgcccgcctggcgcgcgacctgtccgccgtcgacacgcccgcgccgttcctgcgcgccgcgttcgcgtccatctcgaggcggtccaagctactggcg

SEQ ID NO: 9461 - DNA, 2221 bp, Oryza sativa
cgtgcctcggagaaatggacggcctccatgatcgctctcgtcggcctcctccggtatgccaagtgcgtcctgttcagcgccacgcctcggccttcagattccaattccaaggctgacgtcgaggctgaagacggcgagcccccggtgccgccgtcggacttccggtgcccaatctctctcgatctaatgcgcgaccccgtcgtcgtcgcgagcggccagacgtacgatcgcgagtcgatcgaccggtggttcagctccggcaagtcaacgtgccccaagacagggcaggtcttggccaatctggagctcgtgtcgaacaaggccctcaagaacctcatctccaagtggtgccgggagaacggcgtcgccatggaagcctgcgaggcgagcaagagcgagcaggcccaggcggtggccgccaacaaggccgcgctcgaggcggcgcgcatgacggcgtcgttccttgtgaagaagctgtccgtctccttctccccagatgccgccaaccgcgtcgtgcacgagatccggctgctatccaagtccggctcggagaaccgagcgttcgtcggagaggccggagccgtgcctctgctcgtgcccctgctctactccgaggatgcagggctccagctcaacgccgtcacggcgctgcttaatctctccatcctcgaggccaacaagaagcgcatcatgcacgccgacggcgccgtcgaggcggtcgcccatatcatgagctccggcgcgacgtggcgcgccaaggagaacgccgccgccgccgtgctcagcttggcgtccgtgcattcctaccgccgcaggctcggcaggaaccaatccgtcgtggagaaattagtgcatctcgtgcgcaccggcccgacgagcacaaagaaggacgcattggccgcgctgctgacgctggccggcgagagggagaacgtcggcaagctcgttgacgcaggcgtcgccgaggtggcgctgtcagcgattagcaaggaggagaccgccgcggcggtgctcgccgcgctggccaagcgcggcggtgcggaggcgatcgtcaacatcgacggcgccgtggcgcgtctcgtggcggaaatgaggcgcggcacggactgggccagggagaacgccacggcggcgctcgtgctgctctgccggcgcctgggcgcgccggcggtgacccaggtcatggccgtgcccggcgtggaatgggcgatctgggagctgatgagcatcggcacggagcgcgcccggcggaaggccgcctcgctcggccggatatgccggcggtgggcagccgcctccgccgccgacggggagcgaggcggcggttgccccgttgccaccgtggtgccccctgccatgatggcttcgtgaaaaccaatcacaacttgcctcgtaggataagttcagaaacataatttttccccccttcttgctgtacagagtcttttttaggctgtcaagattctttgctccgagagataatggtgagtgtttgatcaactgtgcatacgagcttcagtccaatgtaatcccctccaattccaactcaaattgcgccctttcttttctcgaaagataaacgaagatagaaagtatttttcacatgcacatttctgtactgccattcgtaaggatacccggatttttccttcacctttatgacgtctgaaccactactcgtatttggtatgggaaggaaagcaacgcctttgttccgatttaacttaccgaatggacccccgtccatggtcgtctactactccatgatccaatgtaacagaagcaagcaactgggacgcgcagtttggcacttttgctatcatagggggtggttgatgggtcccggggcaggagcagccgccagcactggcccatgggcgccccccggagtgattgcgacgattgggaccagcggccagactcgccccccgctggcgaagcggacatgattcgcgacacggtgggttgcacgcacttgcacggcacgggaaggggacgccgcgagttgcaggccgcttgattggtgcgagaaagaggcgtaggaggagtagtagatgccacggccggttcaacgttctgcccgcgagggcacagacgtgcggcgccgccttttggttgggcggcaggaaggcgtcctcgtgccgccgcgcgcttgccgacgagctcccggttttttggcgtttggctgctcggcgcggcggcttctgggatcacgcgggtg

SEQ ID NO: 9462 - DNA, 12629 bp, Oryza sativa
ctggctccaaatcatctatagctaatctaatagactattcatataatagtttactataaaatgtactacactatttatacccggtcccacctctcatacacacataacgtttcggagtctgtgttgtaactggctataaatatgtagcccgctttattctctctcttcacttttttttctcgatatgtggttatagctggtttatagctgctattgtaactgctctaatatctactgatatctatctatcccgtcgagtcaaacgaagagaagaaagcgggagaaggaattacgtgaaacttgtaagcatttactgggaccatttggccagtatcaccatcaatcgttgtagtgatgacaaccattcgtcgacccgcggttgcgacgactggtctcgaacagtgccgcgctgcggaaatccggtgcagaaacctgtcgatattgcagccgcaaagcgattggcagaatggatgggcgggtacgcctgcctggacggcggacgctttgcggcgtggcagaggccacccaaagctgggtgcgtccacagaaatggcgaagctcgatttaaacgccggttgatagcattccgtgggaaaagtgagaaatttcatccaactagttgtcgccatcgattcaatcactttcatcttcctggatggttatcaacctatcatcagtggtgagattttcacaattttagccattttccgtgagaaattttataaatacacccctagcaagtcatttcataaaaagggaacattccgaacacggatttttgcatgcattattgaaacatattgtttatttgattaacatgatgaattaataaattaagaaataaactttataaatagattagtataaagggtcaatacagtagaatatatattttttagaaattgtattattataagtgtctggcaaatagccagaaaagaactggaaaagagagactgaaaagaacagggactgtatgtatgtttatagcatactgcataccatcacagtatttgactttgtgtatgattgtaacatacaaaggtcaattgagccatcaggagtacaaaatatcatacagtcaacgggttattcatgcgtgtgccatgctatatatgtacatggcgccaaatgctgcaggttcatgcttggatctatcgccaaatgctgcaggttcatgcttggatctatcattttatatataaaaagagtttttatctatttaaacaagatttggaattggagattaaacacgagacattggggttgacaccatatacctcttgccaccgcaacatcaagtgcatctcaaaagcttttatctatggtatgttccttaaaaatgttttaaaaatacagtcaattgcaagatgtagtgatggcttattttgtgatggaggcggagagattacacaccaaagcggcacaaaatattgaaaaaaaggtatatattgaaaaaaatccaaatagtttgagcttggagcctaaaatatgaggttcactgcttcagttttgtttaccacgattttgaataagaaatggatgaaaatgatcaaaaacttcttctataaaaaactgaactctggattatgaattttggtgtagcatcagcctatttgtcgcaaagcacaaacattccaaataagggcctataccacatatgaaaattactacattcataatttaattccgggtgtgtttggcgctacctttcccaacctcaacattaacagcttttcacacgcacgcttaccaaactattaaacggtatatttttataaaaaatatagaaaaaaatactttaaaatcattttaattatttttcaactttttagctaatacttaattaataatacgttaatgagctattttgttttcaatgcggggagaatgagttacaaaactgcactatcgagcatacccttagaaatcccactgctttagtaggaattgttggagaatttttaaagtttattgttacattcgttctcaataaatgatgtcctaaaatatgtgcgatcaaatcttgaaatcttatatcatttataaatagaaaaagcattagaattcaatatgcctagcaatgctaatagctaggggtgggcattcggtccgatagaaaatttcggtttcggttttcagtttttgggtcattggaaagtgtagaccgaatttcaacgcaaaaatttcaggaccaacaaattcggtctcggtcttggtcctgaccgaaatttaacaacattttcatatatgcaaagaaataatcgaaattttcaacacaaaatcaaaaaaaaattataagcacgtatgagtaaagactcttattaggttgcatgcctagaagaagtaggaatgtgaaaattagagtttaatattattgaacttagtggattataggttgcatttaattttttttttattaattcggtttttgcgatctattcgattaaccaaggagactaaccgaattgaccgaaaaaattcggtctttcactgccgaggaccgaatttctcggcctcggtcttttcagttcgattttttttctacccacccctagtaatagctatactcactcatgaaaaaagctttcgcatgattatatgttttaatattttttttataaatatattgtaaaacttaatgatagaatatgtgtatggatgtcaaaaacatcaaactaaaaaaaccaagggagtaataatttaatctggcacttgatcgtgccgagagtacataggggtttatgataagatcgatcaagcgggtccaggcttgaatgcgactttaccgtgacgagctattacgagtttgttttagatgattcttatcgatctattacctggttttgtcattatccgagagaagttatcctcaatccataaattaatcatatggattgttaaccctggataaagccgaatttctcaaatgatgactctttcaatgaaatctgagacacgaatgtcaccatcttatctcgcaagggatcaacactacgagaatatgcgggctagcttatgtttctcagtttctgcacttctgtacagttgcagacgatcgacgggtttgtaatctgaacattgctcctgacttgctactaatgaaataggtttgacttgaaacacatgccagcgtgtttgctcagcttgatgaatcagtgacctcctgtctgacccttctgttttttaggagatctcaggcttccaggttacacatcgcatgaagattttgacctatatatatatgagtgtaagaaatatattgtactatattcatggctgtgtgttgttcaaactagcatgtccgtcattcagacgccgccatccgattgacagcaaatcgaggaaatatgaatacgaaagtaaacagctacggattagtttttcagtgggctgtggggacgatgggttagttaggacttaatgaagtctacatgttgtaatcagccactggattgtgtactaaaaaaacatttatacgaatactagctggtgacaatagtattatgtagtgattgattctctactgttgcaccaatcatgattgcgcatcgctgaccgaatggtttatgtaatggtttcctggagctacagcgtcctgtttgtttgtgttggggcgtggcagtgtcgcgctcgttggtccgcagcgaaggcagcgactgcagaagcgacggatagaggtttgcgtgggcgaggcgaatgtgatgggctaagttttgtcgttggcaagatgggctgagagcgaagctttgtgaagcgataccgtgatgggctactttttgtcgctgactagaaacgtcgtgatctggtgggcttattgtgagcaacacaagatcgcgtcctgtcggcccatggttttactgatttagacatgtattttggtccggatactctaaacgaaaaaaggaccagagcgctaatgttattgtccatcggcctcttgttgcagacgggcttaagaagagtcaaagtaggtaggagtagagcttaatctccgttccaattttgtgcacgtacaaaaaaaagatctccggaagagaaacacaacatggaaacataaattttgatgttaccctgtgcaaccctgcaacgcggcgctcgacccaggccccccggtcgcacgcatccgcgccccgtgcgcgcggctctcacgccatcgcgccgacgatttcgttccgcgaggcaacgacgtcggcgcggcacaccgggcacgtcgtccccctctgcagccacaggccgatgcactccgcgtggtagacgtgcccacacggccgcagccgccggcacggctgtcccccgccgtccgcgaccgcgaccgcgagcctccccttgcagatcgcgcagagcgccacgtcgtcgcccctcgcctccgtggcggcggcgacgtcgatgatgacgacctcctccttgttcagcaacccttggcgctccccgttgggatcgccggtggcgacctcgaaccgccggccgattaagcatcgcacggtccaggagatggcacagatcgcggcgatgagcgcgacgacggcgaggaatatctcgaggcctgacagatcaaccatcggcgagagttcgttttcgtagctaggtacgtgttgctggctcgatcgtcttggcgagtggtggaaccctgcacgcacgcgtacgtattaacgtataccagtacgtgctccggctccaggtacgtttgttactcctacttgtttcctatactgatttgtatttcgaaaaggtttgtttttttcccagatattactgcggagataattaaacagttcgtatcagaggagaaaatcgttgtggctgatctccacgtctttgttactcccacaaaaatatgaacaaattatggctcgcatggatgctagtagtatttctgcttgctttttgctcatggaaattattaaaggactaggcaactgggcatttaaggagtggcaactgacaagtatgggctaactcaaaggcgcagacataatcaattggaagagtgcttaaccacgagcatcagttagttttacactgaggcattggggacatggcattacttatctccaatcgtgtggtgttcatcagaaagaaactttggttaaagctttgctcctagggggttgtttattgtgcaaacacacaagtaggctatttgatggtgcaaaatattgtaagtgtatgtggatgggcagagcaaattattccctccgagaaatctcagttatcattcaagattgaccctgaggaccactagatagcagtagaaacataaaatctgaacaacactgagcgccattcagcactgtactacctctcccaaattcaacttccaccaacccaaaaaattcttctttactgcatcgtgacacggcatgcaacaccgtcagaaaaaacgaaaaacgtggcgataccctctgaatattcccgctttctatccccatggtaaagatctggaatagaaggccagaagtcagatctgcagttacagtctttacagagcctaaaattaactaaaattaaatggcatagccgcatgggcagttacagtctttgcattgagtcagagataaatgagagattagggtttacctagccccgcttcctatggtcggccaagtccttagcatctggggattacaaaagaaaactgccccgagtgagtggctcccactcgccttcctcgatccacccttttttgttgttcgaatccattggagcccacgaggtctttgcctcccattctcccaaaaccacttggattctcgaagattcagagcagggacctcaccttcgctgcagcttttttctttcaggcttttggcttcttggatccgtgcaggcgcgagaattcaatggcggttattggagcttcttggggtggtcactgaaggtacactggttagtgattactgagtactcatgactgtgcgagaatatacggtgaagttgtttgtttgtttgcaatttttgatgtttttcttcttcttggcaatcggctaaaacccaaaccttcagaagaaaggcagagactttatcgtgttcttggctttgatccggttggaatcaatctcttcgaagacccgcaaactctcgccttggaatccgcgcatgttttacttcctgtctcaaccatcttgaatcgttcttggagcctgatgctgctctgcctcgcctttgcagtagaccagtagtacgcagtcttgcgatggagtcggcgacggagaaggtgaggaggacgccctcctcctgcctgctgctgcgcatctccgacatctgcaaggtgcgctccgtcggcgtcgcgccgaccgtccgcgaaaagcccaaggccgacggcagcgccaccggagagagcagcgaagacggcggcgcgcacctgaaagtccacccgcatcatgtgtccgaccatgagagcgtctctgaatgctcctctgctcgctgcgaggaagcgtttgttgagaggcttctcgacgcgatttctggcctcaaattgagttacgtgaaccttcagcaagctcttgtgccatatgatcctgaagagattacgatcgctgatgagcgattcacatcggagcttcaagagactgccgggttgaaggatctgtatgtcaacatgaacaaatggagaaatccaatgtaccagtgctatgtgggctctagaattcaggagcaacaaaagttggccgtggagttgcaagctggcatgtgcaagagagactctgagattgtgtgtttgcgagcggagttggatgaactggaaaggaagaacatggaactggaggagaagatcggtcaaagtgcgttacagaaagaaggaagttttgcaattgggatgggagtatcaacggatatgtttatggaattattcgagctttcgacaaagtctatccatgattttgcaaaactcgtcgtccgttggatgaaactttctcggtggaatcttggcaacttaacatccccaatagacaattctgttgtctatgataaaaggtctcacaagaattacgccgttgaggcctactttgcttgtatgatgttgatggggcacaaagaggagtacctttcgctggatgtcttcgattatgtaatgagtttcagtgatccttttgatgctcttatgaaggccccagactcttgttttgggagattctgtcgagaaaagtatctggccattttgcctcctagtatggaggattcattcttcggaaatttggatcatagatcatttgttgagaatggcggccatccaagaacaccattttatcaggcatttgtgacaatgtcaagatatgtatgggcgtccctaaccgtagcacgttctctgaatccaagagcagagatgttctatgtcaagggtggtactgaatttaggagtaaacacatggaatgtgttccatccaagataaccaaagaaggagacaaggtcagtgttgggtttacagtaatgccggggtttaagattggatgcactgtcatcagatgcagggtgtatctgtccatggtcaacgaaagaaacttctgaacacgtcatatagctacagaattaggtaagcagcatcagataaccagttagctctatatagcatttcttttgacttgagtttctgttgagctcctcttatattagaccaggggcataagctaatagatagattagtgtattaacttgctctgtaatacttgatgtaatatttaacattttcagtcgttcaggtctgttaagtcattgctttgttcgtgagtaaatggatcaattgaagaagaaaaatgtgtgacatgctccctgtataccattttatatggcaaaactgaacacataatattgttcaaattcttggggctacaacaccatctatgtatctaagcatgagtaaaaatatgtctttgattgtacaattgaagttcatctggcgaacaatttggcgaagatgttggtcggttttgggttctccaagcatgcgacatgtgcatatcttcctagcttgtcgacctgcctgggttcccctctagtgtccttcttgcaaactttgcaggtcttatccacccaaccttcctctacgtattccccgtcaactgcaagcagaattcagaaacagttaggactgtgcgatactcctactagtataatctttttggatcagaagtaattttaggattctgcaagtaaagcatatatgaggtagtaccatccacatatgacttgaagaaatccttgtaggtgccaccgatcttcctccgaagtgctccatacttcattgcaaatcaaattaacttgtcagaccatagaaaatccatgccgtgtatagtcagtactaagttactactaaactaaataacaccattgatcgacaattttttgtgcggatcagtagttcaatggatacctgctcctttgtcatccttcctccatcctttgtggcctctctggcttcatacagaagctccgcgtccttctccgaccggacctgcgagaagtccagcgcctcggtgatgctcccgaacaatgactgcttgctgcccttctcctcatcttcctttgcgtagaccttcactgatctggtggaggcagtgcttggcctgaaggaggacggcatggtttggtggtggtggtgcccaaacgaggcgctctgcgagtgggacagcgtgattgccctcatggccatggctgcagtctgcagatcggtgattgattctcctcaggtagaaactgaactggtgactgatcaaaccattattatatatatgtaggaggcgtttggtgtgcgcatgcatgggagtcttgtggcggctgcaaggctacgtggtgcaaggcgagcctgctgaaacgagaggactgcgacgccggggtgtgtttcaggcgcgagaggacggcgttgagcgttgcgtcgcgcgcttgcacgcttgtgtctggtcaggagcgatttgggcaacgtggctggttgcctgctggctggttcagatgatgtgtacaggaggtgatatttgtggatgaatgttctcctcgtgagagttggaaatactagtcagaaatttttggttgggcccagcctctcagatttgcataatcctccgaatttttatagggatttttatatgggctattgggctatctagctgcccaagtactacttgattctgataggaactcaattgtccggtacaagaaactgaattacaggttgagctttgcccacggctcacactcggcccatcgtccaagccgtgtgcaaaatacagtaattagacgtggttctttattactagtactctatcgttcaacaacatgatttccgctaagtacaacacatagagccccgagcagaccaggattttactctgactggagtgaattaagctctagggatcaaagcctatcatcaatagcacaatgcttagaatctgggtgttattagcgaccaagtcggaactaagtaatgatatgctcattaaggtggtctgtttcattagattatgaaaacctactgtgttaggtcgctgacactattccacgttgtagctgaacgtatggcgactatgcaagtagaggtagtagcatgaacaatgctggagtattgtcggttgactttgatgttcagattgagccatcgaagttggagtactccgtattttagaacattgattatttgaagctttggaagtgtggaaataaattgggccgaccgctgaacgtgctctcacattgccattataaatacaaagccttcgaaaaacaaacataaaaaaaaaaagccgagcaaaatggatggatcgatccacaacaatgcaacaaccatgtggacctcaggtgccgcaatctccatgatggcctggtagcaacgttgcctccccatcaccatggatgcagctttatttccccatcagattgcggtatcgacgcggagataatcatcatcatggtgccatgacacgtaccttttgtaggggggactcctgttttttcaaaccaaagtcccaagatgcaacaatgtccaatccttttctatcgtcgtcagggcataggtgcatttgtgcaaaaatggagtacgcaccagtgagagccgagccggccagtaggtcgagattctttccaaggacctcgcttaatgaacctactacggcaactgcaaatcttgttggattaatgcaatggctggcagcctgagaccaaactgatcgaccggttgaagaagaccctagtctatgtacaatgggccagttaggatcatgagctggattccaattaagacgggtataagatgaaaaaaaattaacaggggcttagaggttagagccagaggctttcgctgcggcgtccttgtcattgaatagctagttctacggcctcggcgaggcgagaggcgataccctaccctgcgcttgctttgatgtgcttcacacgtgtgttgtcacgtcaggtcaaactctccaacagttgttatcctcaccctagcgattggcagaaacgagtacttatggttttgtgagaggggttacctctctcccaaacaccctctatagcagcacacttactagctatgtacggagtacatacgtacatcttggatactatacacaggtagcacgtctggttcatcaagtcaagattcagagttgagagcagcataaaaggagccataggttcatatcctgccctattcaagagaggtcgatatggagttacgttgtcggggcgagatatgtgaaagattcggcttaatttgtgcgtgtacgctaccaaccaattaggcaacactgaacatatttattcgtttcttgcatgaccagtgaccatgcagtataggactgtatgaaaaaatcgagttgagctgaattgaagacaccacaccaccagccgtcccccgttccgtcacaccaaaggatacccgtatctttgttgcgtattgatcatcgccatcaggtattcgatcattatcagcagatgggcacgggaccgatcgatttaaggggagacggccgaaatacgctaataatacatgcccccgagtcgtgtacgagtacgacccttcgctaccattgctttgcgtatagcacatgtccatgtgcgtatactcccaacgcaggtactgtgtgtcgccagctgctctcgcagccggcgtatcgtacgtactttgacagggctccctgaggaatttgatgactaggatgctctaatctcgtgacaaaacacaagattagcctcatgatgatccgcgaaaagtaccggtgggaatctgaacccgatcgatggagaacaaacagcgacgaggcaacgacgtagagaacgtacctacgctcgtcgatcgatcggcagcgcatgcaggatgagtaacatccgcgacagggatcaatcggcctggtcacatacacattacatcaattaagattctgttagcacgttttttaaactaataaatgttatgtttcctgtgaaaactttctatatagaaattgttttcactacaaggatttctatttgttgcaatggattataaaattgttgcaatatctaacaccattactacgtgagaaaaatatacatttattaagtttgtaataattaaaaattaattaattctatgctaatagttttctcgttttacgtatatcaacttaatctttatctgcttcgggggaggctttttccagtctagtactgagggatgctctcaattctggagaggtttgcatgaggtaaaacattggttgaaattgggcagctgtatgatttaggggatggcagtggtactagattctgggatgacgtctggctaggagatacacctctgaaaatcaaatttccctacatttacagtatagtggctgatcctgggaaaacagtgagtcaattatggtcctctgatggctggaggattgatcttagaagatcgcttggtgccgaggagctagttgaatgggaacaactacttgcagatcttgcaaatgttcacttatctacggatagggacaggatgagatggaaattaacaaaatcaggacagtttactacgaaatctctctatagagaaatgacctttggggggattagagacataaagatgcaagaactttggaagacacccgtgcctctgaaaattaagatctttgtttggctgatgcttaaggggagaattcaagctgctcatcggcttaaaaagatgaagtggaatggagatcccctctgcaagttctgtggtgctgaagaggatgtggatcacctaatgtttaaatgtgcaccagctaggtttttatggtgttgttttagagatgtgtttcattgggatcacgtcccttcttccaggagggagtttatgaatatcttgatgactatgggggatgatagggcaataatctttttacacgtaatttctgcagggatttgggcgatttggcttgtgagaaatgactgggttttcaataacaagctgctttctaatatatgtcatctccctcacaaagctgtttcgtttttgatccagtggagagggctgctgccggagaagctgaaggtcgaagtggatggtctgaaggactcattgcttgccagtattcgggcgtcaggaccaaactagtgcgttaatctttgctgtgtggttctttgtgagttccttcctggcttgttagcgctgtgccagcagcacctt

SEQ ID NO: 9463 - DNA, 1777 bp, Oryza sativa
cccggcgggcgcaacgcccgacaggccgcgaaaaaattaagcgcgcgcgcggggccacggcgacgacgaaccgtgcggcttaagtacctatattatgcgctccgtgcgcgctaaatgaggcgtcatcgctggtgccctctcgccctccggccgtgcgcgcaagcgcgattccgtgctgggcaaaacgcgggccatcctcatctcatctcatctaccggttgcagtattatattgccggcgctagaatgagttagttcaagtatttatattgcacttgttggctaagactgtcgctgtgtgtcgcactcgcaatgcatatgggttaattaagcaggcgtgtgaaaaactaaaaaaaataataatatggttttgatcaacgtttttgcatccttgtgtttgtctcgtccacggggcagaggggctctgccctctgcagcatgatgcacgcgcgcgcgaagcgagtacccgcctcagggccggagttaggaccacactctagtctacaataacgagcacctttctgagatcgccgagcactaagcacgcagccatcaatcctatcgacaccgtttggtgccggtgctggatccatctcccgtgttaagcatgccgatcgaggactcggtttttacgatcaaaagctccggtaccttcacccacgtccctcttttgggttgccacttgccagttgactctttacaagtgccacacaaccacactaatctaacatgcaagtacaagtttagtactgcgtcatgacaggattacggtttggttttgcgtgtgtgtggctttcgcgataagccgccatgcgtgcggccgatcaggctcgctgcattgcgtttcggtgctttgcattgcagcgcaagatttgaccattggccttggcccgaaaagctgcgcgtggcatcttaaatttagagcctctggcgtggtttaattctcaacttttttttcaaacttttagacttttttatcaaataaaattttttttacacacataaacttttaactttttcatcacatcgttctaatttcaatcaaaattctaattttttgtgtgaactaaacacaccctctcggagtctcggagtttttgttgtgaacgcaagcggcgaaggcaaatctcgcagactgaccgctcaagctccgagccagcgaccaccaccagtagtagtactgttgcttgtctcgcccaggggtgatggaaataaaaggattaaacaagaggtcccggacaaggatgcttttcgacgcgtaattaaaggcctgatgagatgagaaagaaagaaaagaattgaaggcagccaggcaaaggacgtaaccacaatccacaagcgagcgaagcgaaatttcttcagatttcatatcatatcctgtctactgtagtagtatatcctacgtgcagtgcagcgtaggcccattcttctccgaccaacaatacctgcgctttccatcctatcatcctatccccgacctcccttgaaacattttttagcctctcatgtcaaccaaaacttcgagagatttacagggattttcagataaaaatacaggcagcagcagtaagtacagtactgttgaaataatctgtaatggaagaggaggcctcaccgtggcgttgtctcactgatgagagctgagagagtgaagccatgcgaggtgggggcccacgccgcatagagaggagcgaggacaaaaggcgcctcacgtcccctcctctccgcctcgccgatcccccactctattacccgcccttttctgctccgcgccatct

SEQ ID NO: 9464 - DNA, 6567 bp, Oryza sativa
agccgacggtcgccgtcgccgcgtgtgacgagctcgacggcaaggtgatcacctccgccacggacatcatcatcgacctgcggaccgagaagaggcccgacaaggtgctcccgcctatcgtgaccaagccggcgaggagagagctcgacggctgcgatctggaggagaaacacatcgacgtcgtgagacgcgcgtcggctaaaaaacccactaccctcctcgaacagagcaagccgaggcggtcggtgtcatccgcgcgccgcctcaagacgcgcgccaacaccccgcgtatcgtggccaagaagtcaaagccaccaccaccaccaccacccgcggcggcgcgctcgccggcgccgacgacgaagccgcccctggcggagagcttcgcggtggtgaagtcgtcgcgggacccgaggagggacttccgggagtccatggaggagatgatcgccgagaacggcatccgcaccgccgccgacctggaggacctcctggcgtgctacctgtcgctcaacgccgccgagtaccacgacctcatcgtcgacgtgttcgagcatatctgggccaacctcgcggacatcaagatgtagcggaagagctcagtctcaagctcactcgtgctagtgcaatgcaatgcaactcttgtcttgcatggtgaatccaatgagtcccatcgtgccaagagctgtcgtcttgagaatcttggtttgctctagcctgttaatgatcctaaaattgggtatgataaatagtgttatccagacctgggatactatgctgttcttctgtctctttacatttatggtactatactacagtagctagtatgaaatgtgagaggctaatccaggcaaaacagggtactactagtactgtagaaatcaactatggtaaagactaaatagtggtgttgataaatgataatattaatgacaaatctaatggagtcaaacagtagtatttcttcgctattggctctgcctcttatctgtaggatgtagtagtgtccaatggtactacaccactactgttgtacgtgatgtagagttgaagacttcagtacaagtatatgacgacgtgtcaagttagttgagcatccgagacattgtggtgcatggattaatcattaatcaaaccgtaatttgacaagcacctaatttggagtctttgattgatgctttttttttgacagtttgattgatgcttattgaatgcgcgcttagtgtggtaccgatgcaatgtacgtactaccgcattgcatacttaaactatagtcatatttcatcttggcacacagaccaaagtaattctacttatcatccatttaaatatgctaccagttattccttgtaaacaagcgattcattaatatttacatttctcgatgcccatgtagccaatcttgtgtggaagaatgtagagtcacgcattaaatccgagaaagtcattaagaggataggttgttggattgaaatatgcctatcaaaaataatttttttagatttagaaatatgactatcaaaagaagatggagggagtagtattcatcaatccaaaccttgtggacccatcgttttacggcatatttgcatttgaagaataatttatgaataaaaattttatatatgcattcttagcgatctaaaaacaaagtctgaaaaataaactttgatgaaaaacccctaaaatcaactccaaatttaacgtcaaaaattcaaattttggctgataagtataaatataagcgaaaagatgagaccctttctaagttcacgcctatctgtttattaatctcgactattataaaagttgaaaatgtttttgccaatacaaggtacgttatccttgtttgagtcggtttttaatttcgttcatttttagaaatatagattcgtgtttaagttagtttttatgtttgttcgcttttgaaaatacaaaaggagccgtataagaaatatcttttaaaaaaacttgtatgttaacttgagacgaaagtcggactcctaattgtagctcatgattttctaaaaaaaatcgagcggatttccagagtaaatttcaccctaactaaactgtcgacgtttgaggtctcgactacagtatttgcatgaaatagggatagttggtaccagggtatgcgagattgaggtaaaagagatggaaacaaggatttttatacaggttcggaccccttatttgacaggtaatagccctactcctgtcggccgaagccggtgttactctttattcatctggatcacacaagtacaataattgggataacctatcgagctgtcgtcaacttggcggcatggataaccaacacatagttgacgacatggtagtcttcctcctcgagtatgagctcttgagatcagatttgacgctaaatccctcttgttggtctttctaggcttaaccctaatgttgatgtctgacggcatatgttggcttgtatattgtgtgtctatctgtggttgtgtctcccctcctattaaggggtcttgtatttatacccatagatacccctttgtccaagtagaactagggagaccaatatggatacaattcgagtagtccttctcgttttcatatagaactgtattcgtcattccttatccagaactccttctatatacgagatataattccgtataagacttaatatatgatggtcctgccgagcttagtcaactactattaggtactccatccgtaccaaaatataagcatttttagctatgaatctggacaactatgtgtccagattcatagtcaaaagttgttatattttgggacggaggtggtatgtggtttccataaccataacataaactgtataacaataattagattaaaatagcctttaatttcaagttatagttattattgtttgtatttgtctaatgcttagtagtagcaacttttttgaattactttcatcaatctaaaatataacgcgtccttatttttggattcgtattaaaatatttttgtataatgttagttttatttttatggaaaatatgttataaattaaaataaatcattgatcaaactataatgttgaagatcgctaagaagctagtatgtcgtggatggagtattacagtagtatatcgcatttgaatttcttatttaagtttgtttaaagtgcaaattatactattggtattgcaacttgcacggtgagtttcttatttaagttggtcactatttttgtaattgaatagcgaatcactcatcttgtctggtgggtgcatttgagtcacaactcacaagtgctcccacacaagttatttttccttagtagggtgccaagaaaactaagcaaggtgcatgtacatgctacatagacgtgctacttgggttatatttgcaaatttaaccacttctatttttttcacaaaataacctacagagaggaacgcagaaaaaaatggccactccctgattcttctttttttaaaagaaaaaaaaactcagtataggatacatccagttttgcaaacaagcccttttagaatgattaaattacaatttcaatcaacattttgcagaaaataacataatacaatatgaaaaggcaattgggttattctcctttggctgcctacgacgccgatggcataggcttggagctcagctgctacggagcttgaaacaaggcgagttgccaaaagaaaagcatgctcacaaaccctaaaggggcctctcatatgtggaggttcaggtgctaacacacgatgagaagcttcagatacaccaccaaagattttagctagatcttttacacaaattcaacacaacagcaataattacataaacggcgggatccaaaccaccgacaaagaaggcagaagaatcaagttgaactacaaaggaaacatgaggtccatatccgaaagaggcctcctctcataggaggttgaggtcttctctgtcgatgttgataacattagcaacctcttggggaatcctcacactaagacgctcttgagaagcattccaaacggatcctccatcaccctgcgtttgtcaacgatcacatttgatagatcctggcccctagagcgttcacccgccaacgccatctagtggaggcagagaagaagagaccctcccattgctgtctgcctttatcaactggtttagtcatgtagctagtataatgtggatattttcttctttaagttcatttctaaaatagattattaaacaaatttcattctgaaacaaagatcatcaagcacatattttttttagataatgaaagataagcatcatgcataaaggtgaatagagaaaaagaacacaccctatataaatgcgtaaggtctgctgcgtctgcaattgccactgttcactaagaatttaaataacaaacttatcatttcttacaaaactattcaactttcacgaataatttagcatagcaagttgattttgatctagctagaatatttgcgtgatctagaacaaactgctcttgtgtctagtattttttaaaaaaattaccttaaatctaaatattgtgaaaattgtacttgcaacaagtgtgcctttcttatacttcttttactgctaaagaaatacaggtaaaaaatattcctggtattaattgatagtctctgtgtgtgtttacaagaaattgagttactcgcgacaaggttgtcagtattaggatcttagttaatatagttttgctcaaagtagtatcgtatcgtaggatcgggatactaagagattttctttttttaaaagtttaattaatatttatattaattacatatagccattctatataaaaaatatagtaataatatatgtcatgcaaatagagatatttattaagaaaaaccacattagttttgatatatttaattgatttttatatataaacttgagcatatttcattattttcaaactatcatattttaaataatattttgttggattgtagaattaggatactatataagattacgtaggatcgtgtggtaatgaatagtaggatcgagatactatcaaaattaggatatcgcggtatcgtttcggtttgataaaatcgtagtatcgtaatatactaatatacgaatcaggatactaaccttgactcgcgtactaatgttggacaagctttgcttctcaagcacagtacaggtcaacatattagtaccatcaagtaaatgttcacagttgtctctcttcctttattttctgtttcttggagacctggtatcgatcagtattcagtaccgatgcagttgcgagttcctggtcctcatcctctttaagtgatgaacagtccgtccttgtataagagctttttcctcagagcaggttagtactttttagttattctgcttgtgagttgtgaatgctagtagtactagcagcttgttgcaccttgcgaattgcgatcttcttgagctcgcagcttgtgggtagtgcagctagatagagaggacagaagtagcaacagttgcagacaaaaaacctagcaattgaatcactgcaatcctactgctcctattgtttctactcatctcatcatatacaagagtggctgtagtatatacgtagtaggagtagtagtctgtagattccattcctcatcaatgaggagcctgtgtctgcagagcttgaggaaagaattcatccaacttctgtaaagtatcagtgctacatactctgaagtctgaacttgctagtagtatgttctttctccaaaacatgatgctttccacagtaggagtagaaggcaaatgtctttgttgtgttaaaaatagtagtattagcatacgaacaattcgatgaaatcatgacatatggatcgtacctactcgacaataccaaggcaacaatgacagtcttactaaaatgattgctcatcttgagtcttctggtcaagaagtcgcaatagtgggctgcattatatagtggaccacatgaacaaaaccgtcatgcatgaatgcatgatagccatgtctaataaacacaagctccagatatcggcggatcttagataaattggattgagcttggagctcacttggcacgtcatgtggctccccttgatgtcctaaggatcagatcattctgaatttaattccttctgctctcttcattccacaagacacatgggatacccctgaaatggttccaggagctgtagctccgctccgtttgtccccgagcagcatagggttccacagatgacgatgtccccatttgcatggcctctagctaatagctcgtttccttggcaaatgttgcagcatagcacgatacggccatacgggaatgattggaaacaaccaccgtggcgttcacatcttgcaactatgataacagccactgaattcttagcatattggcatctgatgtgagggaaggatgatgattcagctgcatgccactatgccagtgtgtttgccgaatgtctgaaacctaactagtagtggtacatcatcaatttcgacaagaatttgcgtggctgttggggtcaaagataggttgggcgatagaagattgttctgtagaataaaaagggggatccacta

SEQ ID NO: 9465 - DNA, 1263 bp, Oryza sativa
gggggtcattatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcgggccacttagctggaagtcccttctcatcccaaccgttctgcaagtagtcaatagcccgcaacatacccgcatgacgaacatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgaccttggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttattctcgatgtgcctaataattgattttggttcaaagccaatgttaccaacaacactgctgtacatctcacttaccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgttcgcttcctcattatccgaatctt

SEQ ID NO: 9466 - DNA, 4796 bp, Oryza sativa
ggtagtcgtgggtggttagttttaatcgtcagctctccttctctgtttgctggttctgtgtggggttttcagatggtgtcgaccaggagaaatgttaacaccggagaaggcaaccaacccgaaggcagcaaccccaacccccaaggcaacccacctccaccaccaccaccaccagacaccaacgccattctcacccaaatcctcgcccagcaagccaacatgatgaatgctttcctccaccacctccaaaatctgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgattacttgggctcgcttcaccgccgctttccgaagaacccatgtgcccgctggagtcgggctcttaagaaaagggaattccgggagtagaagcaaggcaaccgctccgtgatggagtatttgcatgagttcaacaatctagcccgttatgccccggaggatgtgcgggaagatgaggagaagcaagagaagttcttggcaggaatggaccctgagctgtctgttcgtctagtctctggggactacccggattttcaacggctggtggacaagagcatccgcttggaagccaagcacaaggaactggagtcgcacaagcgccgcttggcgaatttccgcaatcagcagggtgctaaccagagggtccgctacaccaatccctacccagggggatcctcctcgcaacagcagcagcagcagcaacctcgctccgcgccccgacctcaattcgtggtgcgcgtcccacagcagcaacagcagcagaatcagcaagggactcgtgcgccacgtcctcctacgccaactgtgcagcctgttcaaggtcgcagggacgctcaaggtcagcagcgtctgtgcttcaactgtttcgagcctgggcactttgcggataaatgcccaaagccaaggcgtcagcaaggccaagcgcctccccgctccaacaacggtggcaaggacgtcatccgtggtcgcgtgaatcacgtgacggccgaggacgtgctgacaactccagacgtcatcgttggtacgttcctcgttcattccatccctgctacaattttgttcgactctggagcctcccactcgtttatatctgtgccattcgtggggaaaaatcagttgggggtagaaaggcttagaaaccctctgctcatcaccacccctggaggggttatgacagcaaagtattatagccctgccgttcctatagaaattcagggaattccttttccctcggatctgattctgttagacacaaagaacttggatgtgattcttgggatgaattggttggcacaattccaaggagtagtggattgcgcgaggcgcactgtcactctgtaccgaggaccggaacagccggttgttttctttgcacctccaacctctgtcagaagttcagaactgcatcaggtaggtctgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgagctagccgaagttaagaaacagttggaagaattgaaagagaaaggggtatatacgtccgagtacttccccatggggtgctcctgtgatttttgtagagaagaaagacaaaacgaaaaggatgtgcgttgactacagagctctcaatgaagtcaccatcaaaaacaagtaccctcttccccggatcgatgatctgttcgatcagcttaaaggtgccaccgtattctccaagattgatcttcgttccggatatcaccaactacgtattcgtgaagaagatattccgaagaccgcattcactacgcgatatggactgtatgaattcacggtgatgtcgttcggtttgaccaatgctcctgccttcttcatgaacttaatgaataaagtgttcatggaatacttggacaagtttgttgtggtttttatcgatgacattctgatatactcacaatcagaagaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggatcccgaaacagtgaccgccgtcaccgattggaagcaacccaagacagtcactcagattcgcagtttcttgggtttggcaggatactatcggagattcatcgagaacttctccaaaatcgctcgacccatgacacagttgttgaagaaagaagagaagttcgtgtggagcccgcaatgcgagaaggcgttccaaactctcaaagaaaagctggtttcctcgccagtgttaatcttgccggatactcgcaaggatttcatggtgtactgtgatgcttcgcgccaaggattggggtgcgtgctcatgcaggacggtcatgtggtagcctatgcttcacgccagctacgacctcatgaaggcaactaccctacacatgacttggagttagcagcggtggttcatgctctaaaaatctggcggcactatctcattgggaaccgctgtgaaatatatactgatcacaagagcttgaaatacatcttcactcagtcagatctgaaccttcggcaaaggagatggttagaactcatcaaggattatgatgtgggaatacactatcatcctggtaaggccaacgtggttgccgacgctctaagtcgaaagagccattgcaacactctcaacgtccgaggcattccgcccgagcttaatcaacagatggaagccctgaacctaagcatagttggtcgcggattcttggccgcgttagaagcaaagcccaccttgctcgatcaaatccgcgaggctcagaagaatgatccggacatgcatggactcctcaagaatatgaaacaaggtaaagccgctggtttcacagaggatgaacacggaactctatggaacggaaagcgggtatgcgttccagatagcagagaacttaaacagctgatacttcgggaagctcacgaaagtccttattccattcacccgggcagtaccaagatgtacttagacttgaaggagaaatactggtgggtcagcatgaagcgggaaatcgcagagtttgtggctctatgtgatgtgtgccagcgtgtcaaggcagaacaccagcgaccggccggactcctccaacctctccaagtgccagaatggaaatgggatgaaattgggatggatttcatcaccggacttccaaaaacccaaggtggatatgattctatatgggtaatagtggatcgattaaccaaggtggctcgattcattcctgtgaagaccacctatggagggaataaactagcggagctctacttcgctaggatcgtgagtctccacggtgttcccaagaaaatcgtgtctgataggggaagccaattcacctctcacttttggaagaagctccaagaagagctgggtactcgattgaatttcagcaccgcatatcacccgcagacagatggacagaccgagcgtctgaatcagattctagaagatatgctccgcgcatgtgtcctagatttcgggaagacttgggataagagtctcccctatgccgagttctcctacaataacagctatcaagccagcatacaaatggcaccttatgaagcgttgtacgggcgcaaatgccggacaccgctattgtgggaccaagttggagaaagccaagtgttcgggactgacatcctaagagaagccgaagctaaagtcagaatcattcgggaaaatctaaaggtggcacagtcccggcagaaaagttatgcagataaccgtcgccgtgatctggaattcgcagtggatgattttgtgtatcttcgggtcacgccattgcgaggtgtgcacaggtttcagacaaaagggaagctcgcacctcggtatgtgggtcccttccgtatcactgctcgacgcggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacttgacctatgtggagaggccagtgaaaatcctggacaccatggagcgcaggaccaggaaccgggtaatccgtttttgcaaggttcagtggagcaaccacgccgaagaagaagctacttgggagcgcgaagacgagctgaaggcagcccatcccggtctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaat

SEQ ID NO: 9467 - DNA, 361 bp, Oryza sativa
gtttgtttgacattcgttatctctgataccagcaatctttaccctaaactatacaaagccgtgcaatttgaataccatagcaatacgaatatctggtttcgctgatgtttcatcctagtcagcaaaaagaaaaaaaatatagagtccacatgtaaatgagaagaaaaaatgtgggggtttctcacttggcggaagagttggaagataaggagaaggaaggcgacgcgctgccgatgctcctctacgtcggctcatcgtaccaccgccacgccgttgtggtgagacgacgcccacaaagaaaagacccctgcagcggacaaaccaactgagacgggtatgacattgagcagttatcgttgcc

SEQ ID NO: 9468 - DNA, 651 bp, Oryza sativa
ttcatacatggagtgaggagatatatgggttcgggatctcagaatcttacacaacgctgagtgcccaagttttttatattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacatggtgaaggaacaacaagcaggcgcgcaaggccaaggcgtcgtcgcgcagcaggcgattccatggtgtaacaatgctatcgatttaggaaataaaacgctgttgtgatgtgatgtgtgttcggactaaatacttatatcgtgtaatttcaattgaatgttgttgtaatgagtacctccgactattgttgtactagtagtattgcgaactattcggtgttgtatcataatgttatcgtgatgagtgttcggactagtaactgcagctattgttgtaatcagaaatattccgtatggtgacacttttgtttgtttgtactcttgtttaatatgtgttagtaattcgcttatgaacatt

SEQ ID NO: 9469 - DNA, 9910 bp, Oryza sativa
ttgacaggaaccaccgctcgttcctgtcagcagtcgagggtgcacagctcgacaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcaggtagaccgctggagacctgagacgcacacgttccaccttccctgtggggagatggctccgacactgcaggacgtgtcgtacctgctcgggctaccgctggcgggagcaccagttggtcccgtggacggtgttgttgggtggaaggaggatatcactgcgcgcttcgagccacgctgtggacttccggctggtccactacgcacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttcgtgttcgagtttgaccgtctccagccgagcgacgtcatctgggagccgtacacagaagaggccgtcgctacgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcgtgagttcggattgttcatttctaaatttttatgatacttacttcatcgagccatataatttacctcggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcacgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttatgtttttgtacgaaaacatcaccccgtcgtaacttgatgttccatcctcgcaggacctcgtttgccttcgagcgcccctagcttcggagcagtgcgacctacagcaccggtttcgcacggtacagttcagcccagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgtcgatccctcgcccacaaggtactttactttttattaatactattaaatacatgtatgaaactgatggtccttgtccagtaggatttgcagccgggatcttcggtactggggcctcttcgtctcacgccggtaggactggtcctactagccagttctacgacgacgacttgcacggtgcacatcaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcctctacatagttcttttcattcatatggtgctagaacaacttatgctcacgacaacacactttcgtacaatggattgacacagtcagagttacttcaagtggcgggccgataacgcaacctgaaccgaccatacagttcattcatacttggatggagtacgaacgtcgggtggaaattgcaagcttagactggaggaacaatccattagggttacataaatggtccgagcgtccaaagtgtgggtgcagggatcgctggcaggtggctacatcctttgctgaacaaacatttcgaaggagatattttgtctgccccaatgtagacaacgatttcgttgtatgtctaaccatttacaaaatccgctatgatttgcacaaaattactacccaaactgaataacattactatttttacagggcaatccaaggatgggtggatttactcgatggatcgacaatgtcactccatcatatcatggccagaagataacagagtcagaaacacaagtagagtatcaacgattgaaggaccacgagaatgcaatgcattctgaccgacctagaaggggccgataggttaccgcatgcttgattcgtcgggatcgacaaatttgtaccgtgtatcgatggcacttcttatctatcttatcattacaatgtttaattatggtggtgattttttgtatgcgtaagactaagggcctatttggattgctaccaaaaacatgccctaccaatattttggtaatttgaatagtacttgtgtttgatttcgattgaagcctattcattggtaatacgtaatctagatttaagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaatagaccctaaaaaataataaaattgtattttaccagtcttggagattttaatcttgtataattttcaatataaaaaaaattgataactattgatatttataaaaaatataaagcacagtataaaatcgccctcccccagggcggcaagggggccgcctgcaaaattccaggccccccgccgcccatttgcaggcggccccccgcacagtacaaaatcgccctagcggagggcggcaagggggccgcctgcaaatttcgttgacggccgtcgcccgagagcgaacggccgtctgccacgtcactttcgccgccctctgggatggcgatttttaaaaatcgccctcccagagggcggtaggcgaccacttctgtcaattttcaaaatgaaaaattatttttgtaaaacttttaataaaaaaaattaaaaataaaaaaaattcccgcgttgcggcgttggcacgaaagatttgtactccagacctccagttccttcgcaaatgtagcacccgtaacgacagttgatcaaacattccgtcgatcaattttgacgtgtttggagctgaggtatactagctaacccaagctggtgattggtatgtttcgcagcagcagtgaacgcgaccacgtttggcgccctcaattggtagtcccctaaccttttcatttcccggtctttcaagtctctttcgtatggaaaatatgctgctctgaactccaaccatgagttgtaaaaaaaaaaaaaaaagtccaattgagaactacaccggccggctaccagtctccatcctcgcttcgtgacattccacattaacctcagtgcacgtgcaccgtgcccacgactactgtatgcgactgcaacccactgcacaaaattagtacttttagtctggcgatagatctcaacaaatgcatttacgaaagatttactacgaagagatcgattggtcgaaacagcggatattttaatttgcagatgggcagatggtctgttgtattgtcctttttttttttctggagtccgtacatatcgcaacgtgcagccggactcttttccatttcattggattattgcagcggccgattaatggctccgagcttttacggtgtttataaggtacttcgaaatactaagagataggataatgtataccgttgattaagagagatgcaagatataaaataaaattatcgtaaacgatagcagtggggaaataactagtcaaatatggtattttctgtgagtcgagaatagttagctccatgtgattagtatcgttcattaggaagcaaactaaatcttcaaagatttagtggattgtattgtttgatagaaataaagtaaattttccgcaaatttagtggattgaattgatctgcatggggaaaaaaaacaagattgatgtatcatttgttctcctccaccgcttcgttcttgtccatggtcatgcttccatcctgccatcaagctccaatgcttccaaccactcccgcaccactttcgtcaataagttcaggaaaacggaatccctatcagttgggacgcgtggtgatgcgcttaggtgcccgcaaataccaactgaagcttgctacatgccattctttctttccctgactcatgcccttaggttgtcctttgtgcctgccttcacttcccgggggtgcgttgtgccacgggacatgtcttaccgccatcaccatcatcatacaaccaccaccagaacctcaacgcccttagcctcctcctcccatttgcccaagcttggacgagaagaagaagatgaacagtgttagggcactgtttcttctcggttgggtccaaccaactcccaaggactcccatgttattagataccaaatatatatcacaaaaaacacgtaaatgacacaataaaggatcatagaagataaaataccaatgcggtacctatgtaactagagctaatatttagacaattatacccttctccatttcaaaaaaaaaatatttttacccttcctacctaaataactataagttataacaatactcaaatactttttaagtggtatctttcattgtggagcgttggatgtttatcctttttaatacaaacacagtatgttttctcaagattttatttatcgtctattgtactgcttggatcaattggattttatttatcgtctattgtactgtttggatcaattgttctatgtagattatttttaaaaaatatttaatttcccccctacgatgaacaacaaaatctgcccgtcatcgtgtaaataatttaactcaccatgaaatcgtgagactggatcacatgcggcgtactttacttgtgttaaccgatggagaatccttgtttactccgtgttactactactccacccgtccagcgtcgtggacctcgtggtacgtaggagtacacgcagttaccgttcagtacttaaccccgtacgctgatctgcactgctccgcgctgcgctgtgcaactgttgcgacacatggcatggggcagagctactcgaaacgcgacgagtcttcccatttggcgacgggtatagccccgatgtgacgcgaccagaagggctcgatccgtcacttccacgagtagttccattcacggcgaagctgatgttcccgcggtgggttggtcttggccgacgaccggccggtggccagcctcacgtttcgatcacctgggcgcgacagatcggttcttgccgcatgctgatgtaacggtactgggtggtacgcgtacgggcggagtttctgtcaccgtccgtcggtccgtgccagagatctcgcgacgcgcgacgcgcgcgtgcacgggccgaccaggcgtcgccgcgctctgttgcttgacacgatcgggactgcgtccgcatgcgcgccgagcgtgacgccacggcgaccggcacgggacgagtggacgacaggtacgcagcattgcagcgttcgaacgaaacccagccgggataacaaagagatcgcctgacttacctggagagcacgcgctatccgaacgattgagaccaattttaggtagtgtttggttgctgggatgaggtgggatgggttggtccctagagaggaatatttctctcagatccgggaccaactcatgcggccaaaactggcggactgggacgagcgaacggcgtgacgacgctgctcgcgcacttgccctgctcgccctcaggagacggcggcgggctcatcgacggcggcggcaacaggctcggcagcagcggtggcgacaggctcaggtgacagcggcaggctccacggcggcggtaagccacaggctcggcaacaccggatcttgtggtggggaaatcggcggcgctggatctaacgatggggagggctcgggcggcggaagatggctcgggcgacggcggaaggctccacggcggcggatccaacgatggggagggctgcgccgacggaagacggctcgggcgacggcggcaggctcggcggcgacggtggagacaagctcggcagcggcggcgttgaggggctcggcggcaccggatcctgtggtggggaaggcggcggcggcggatccgacgatagggagggctgcgccgacggatccggcggcggcccgaccgtccgtcatcgtccccgaagctcttggcgtcatcgtcccatagcttcacgtcccttcgtcggcccgaaggtcgacgccatcacccgccgcatcgcgtcccttcgcgaccgcagctcggtggcggagatggaggtgagggcagaggcggcggcggccatagttgttgccaacggcgtcttcagtggtggcaaacggcgtccatcaaatccctccctcatcccttcaaccaaataaaaaactgcgatcgtcctattctataaaccaaacacgtaagtagaatcatcccaacctcaaaataatggatggtttcatcccatcctatctagttttagaaccaaacactaccttattttcggaacaactgaatatggatatggaccgtgtacgcgcccgccgcacacttgcactccccgccgttgaacagtcggagtgtaaactttaaagagcgttgagcgagctgtaaaaattagcaagtgacggggaagtaaagtacccacggtacggtagctgaggagacacaaaatgtcttcggatgcctgaaccttacagcagtgcgcagttgtgcttgtgcaccaactcgtgtgagtccttttggtgcctgaccacgagtaaggtgttttagtttttcttaatttaagggagtagctatatttgtgacgtcatatttttcatcaaaaaataattagcatgtatttacattgtaagtccctaaattacatatgtaaatttagtgtatttataatgtaagtttcaaaattacatatgtaagtctaaaaattacacagtaattatatgtgtaagtggtgtgtaagtgggatttaagtggggtgtaaatttgtataaagtatagtatgcatgcgtgtaaaaccttgaactaatgaagacgttaagctttaattaatcaattaatcatgttgacagcctcaacgttagcctgccatagcaatatgcacggacaggatcgcattgacacgggataaaggaaatcggacgcttcaaaacgccgactgtgatggaggagaaaatgtgtcgatacaattctagcaatttcgtaatttaatcagtataagatccggtaccaacaggcattagctgatggcctggtgtcgatatggtgccaacataggatagaaatatgacaccttatagtactatttaacaaatatagtaaggccctgtttatccagggatgaaaagtttcgacgtgtcacataggatatagaccgcctgtattaaacgtagactaataatataacagattaataatatccagggatatacagatacacatttaaagtattaaacgtagactaataatataacaaattacagattccacctgtaaactacgagatgaatttattaagtccaattaatctgtcattaacaattgtttattgtagcaccacattgtcaaatcatgtagcaattaggcttaaatgattcgtctcgtaatttacacgtaatttgtgtaattagttattttttatttatatttaatactccatgcatgtgtctacacattcgatgtggcaggatgaaacttttgccaggagatctaaacaggccctaaatatttctggtttgtatacatgcttttatattgtattaacagtacctaagtagtcgagatactctgtattcctgttgaattgtcttaaaacaatgagaaaatctatcctgtatcactgactttgccctggaaccacaatctgccactgactttgttcagttccatactatgccatcgctttttgtttaacttctataatttaccatcgccgtcaagttagcctccgttagtaccatacaattttgttctaatgacaaaaatacccctaagatgaaaactttcagaatttggttgaaaattcacaaatatcatactgtaacatgttacagaggttgcccggctcattttcttctatgatgatacatgattatctaagcatacatatgattgttttagcaacttgtttgacggaatgttgcacttacaaaaagtatatctctgtgtatgtgtgtaggttcaaagcaggttaattaggtacatgattcccatgcatacatgtacgagtgcgagcacctgccggacttttggtcgtcgcatccctgtgtacacttaattagaattctatcaatacgtacgtatgtatgcggtcgccacgggcttgtgtaccacggacacagcctgcagtgcacgtgtacttctggccgtaattgaggcgggcatgaaaatgaaaatagattgggttaattttaggatttttgttcaggggtattttggtcattagtataaaattgtacagtgctaatggagacttaactaacggcgatggtaaatcatagaagttaaacaaaaagtgatgatatattatggaattaaacaaagtcagtggcagattgttgaactagactaaagtcagtggtgtatagtagattctctctacaatcccgttgaatttctgagaaaaaaaatgtttcgctccaaataaagccgggctccttatggtttgtggagatgatccgctctctgtttaagcatcttcgtacaatgaagagggattagaacccaattgaaaacatgatcaaacatcaattgacgggtgattgatcaattcaattccaagagtccaaacagataattcgagtgctgagctataattgcaaacatactttt

SEQ ID NO: 9470 - DNA, 14148 bp, Oryza sativa
ttgataggtatatttcaattcaagaacttatcatcttaataactttctcggatttaatacgtgactctccattcttccatacaagattagctacatgggcatcgagacatgtaaatattaatgaatcgtttgtttacgaggagtagaattacttatccttcatctgtgtgtcaggataaaatataacaatcaaaaatagatggagggagtagcatcttgcaagaaaacagatcagtgctacctatggacgcattgcagcactcctagacaggctaaacctcccgtacgtcatgcttcacacaaatcttcggtcgaatctactcctatatgactgcacatgtgctcgttagtctcacacttgacccgagaaagaccagctagatacagtactactagtcactgcccaaggcatgtctgcgtctccctcttggaccatgtactagctccccttggttggacccctcggtgctgtgtactcactccgtcaaaaaaaaaaaaaaaaagacaaatcctactttccgtatccaatgtttgaccgtccgtcttatttaaaaaaattatgaaaaaaattaaaaaaataagtcacgcataaagtattaatcatgttttatcatataacaacaataaaaatactaattataaaaaattttcatataagacggacaatcaaacattggcacgaaaacccacggtttgtctttttttaggacggagggagtaacttctggcaagtatcacagccttttcggggttgcacatgcgagcctttacgactatccctacttctccatgggcaggaataactttagggcttattaggatcacggtactgcaaaaacgtaggagtagaaaaatcgtaagaatatgatagaaatatatgtgtaaaacagaggattgaaaaacacaaaaattctgtagataggattggtaaatatgtgttcggataggcagaggaaaaacataggaaatggaaaaaataagatacgagtggatggaaattttcctttgtttctctattgattccacatgaaaggaatttttcctcttattttcctttgggttgattcctatggactgaatgtcaggaaaggaaatatttcctatatatagtattcccttgaaaatccttaaaaaatccttccatccgaagaggccctcaggaggttttggcgctggaccaactgacgtactagtactagtcacgtagtagttccccgcttcccactgagcaatcacaattcacacacgagtgaagtgaagtgacgaagggaggactcaggcgaggatgcaaagatatggtaaatagagggagtacgttgctagtgccactgttctttctcgctgatgtattaaacccgatcgatcgatgcatgcagtggtggcctttgcctggattcggagagagatctgacgccgctacagtggccagtgggagggctacaagacagctgtgaagccgaaccgtcccttcgcgtcgcggcaccggccggcttcgactgaccctgccttccagcttcctaaatctggccggctgatcagcctccgctctacagctgctgccgcggcgtgcggcttgaaaaggagctggtttttgggggaggcgccaatggcgagctcgggggggaggtggaggcggagcggcagttccatgctaaagctggtggtggccttgtgcttcttcgctgtggccatctccctgtgttgcgtctgcctcagctcgggttgcggtggcagtggctgtggtggattcaggcggcgcgctgtgctgctccgtttaggtaatgaaattcagcgagctgcatccttctgcgcacttgtttactccattttggtattctccagttcactggctaattctggccacaacctgcttgttgggtgtttcatttcgtttggttctgtatgtttgtcgtcgtggttcatatgttcactgctcatgctgatgcgagttcttcgtttctgaaattcaatctggataagttcattgcaggctttaagttgaaaatactgctataatgtttttgtttcactgtattactcctatatcggtaccatatagtatatcggttgaaatgttcaaatcactctgtaataatccgtgttatcgtgttttctgcagatttccggacacgagcaacagcatattttggcgctaatcaggtgagttttgcatctcctcccccttgctatccactctacatgcccgctaccataagttcgcatcgatcaatgcagttcaacttcaaactgcaaaatgatgaaacgacgcgatttattgttgtttatctggccctcaatcatctttcatcagttgttgattcgcgatcgatgacaagtcgaaatcaacacagaacactaggcaacctcacagggtccgcaatggcagtccccattagcgcgcacagtcacggccatgaaagctggcgtccttctccgacagccgttcaacgccggcggtcccatcgccttttgaccatacgtctctgccgatcgatgcgtagtagtacatccaaacgtagcacgccggcacgccgcgcgtcacagcgatacgtgaaaacggtgaaaggttgaaggacggtgatacgtaaatccattgtgttttgtgttgtagcaggatcacagctcgagcgggcgtcgatggcggcggctgctggcggagggcccggggtcgtacccgccgcggtgcacggccaagtgcggcgcctgcgtcccgtgctacccggtgcacgtcgccgtgccgcccggcgtcccggtcaccaccgagtactacccggaggcgtggcggtgcaagtgcggcaaccggctctacatgccatgacgggcagagcgtgcacggcggggtgacgctccggtggcgaagcgatttgcgcgagggtggcgcgcggtggccggtgggcgtgccgggccgaggtactagcacagtacagcagtgcactgctgcccgatcgaagcggccgtcgcgcatggggccgtttcattattgcgatgcgggccgggagcacagtggcagtgtggactgttgccgcgcccgcgcgcgaatcgggtggaggcgcgcgtgatgatggcctactgggctgctgggctctggaatttgcgcggccctaccacgaggagcggtggcatggggttgtacggcgcgtgctgcaaagggaagcgagaaggggagcacgaggcagttgctcgctgcacgtgtccaggcaatctgttgatatgttttggttcttcctccttgtccatttggatttggatcttcgaaatcccatttgtatctttgtgagaaatgatagtcgttataggccatttatgttaaatttcagcattattcttaccgggcttcaacagcatacatgagtacatgacatgtgttggtttcttctagcagcatggaacagttggaagtgtttgtttagggtatgattgtgaagtgctcgacgttcaatcatgttagtgttttacgtttggagaacgaagaaatgagtgttgctgtttggtgtgtacttgtacgagaccctcacatttgaaggcccatcaatgttgctggtaccacccagcccaactattgatgataggaataagttcactggaaatcactacatctaaactatcacaaaccgtgccaaaaaaataaaaaaggtcccgagcagtattgacctaatttttctcctgttttgctgacgtggtatacatggaccccacatgtaagtgagaaggaaaaaatatggggtccgcatatccttttttctcttctctttctcttctctttctcagcgagctggaaggctgggaggccgccgctggctgagggcagagcggcggcgggtggcactttgttgcgattcgcatcattccatgcaacggcacggccttagcctccatcatcccaacaccatgcatcagcgtagccttggccttggcggtagcgggagccgcgctggtcatcgtcgttggtggtggttgcggggacgtcagggtgcgcgaagacgctgaggtagacaacggatgcgagttagctcacgacggtggagaactcatggtcgccgaggggccgctccctatcgctgcagaggagcaggccgcaacatcggcacgccctcggcctcggcggcgggttcttcgtcgacctcctccgtcccatcccaacgcaagccgaggcggcgctgctgtggctgcggacgatgtcaacgtagacctcgacatctttgtgagagagctcgcgaaggtcggtagagctgttgtcacagaggatggcggtggcagcgatagctcccccgacgccatcccacggtggcagctcgctcgccgcccctgaccgctatgcaccagtctccagcctcgcccaagaagagaagaaaggagaagaaagaaaaaagaagagaaaagagatgcggaccccacatatttccttctcacttacatatggggcccatatattccacgttagcgaaaccgaagaagaattggatcgatactgctcgggacttttttttttttgcacggtttgtgatagttgagggctatagataacccgacgcgaagttgagggacggctgttgaacttattcctgcggataaggattactttgatgggctaaatcctatcgcgtgcgatacacggatctgatgtccttgcattttcagcccatttactatctagaagaggttgatgccttgatggcctttctctccccatggccacgatccgacgaaccctgttttcctaccacaaataggtcggatggccacagacgaattgtgacgatggttcgtggtagcatactatacgagtacacacgacgcatcaaggtagtggctatagagaggcacacgacaaaacgtcacagctatacaacaagagatggcaacaagcaacgccaatagatggcagagccgttgcctgctttttttttttctggccttggtgggagatgatacattagatacgacgagggaaaaaaaaaacaacaaacaagccaaccaacgaaagcgtaggaggctaggagccgttccgccactgaaagagcacggatgacgcactaaccggcggcggggcagacgtgacgctcgtattagcgacccggcacgcggcgccctcttgtccgcccagcgcgacaccgccctctgccctctcgcgagttacgtgaaagcgcccgcgggcctctcgcggtcgtccgttgaggtggcgtggaagccacgaacggtggaacgcgcgacagctcgcgctcttctccccccatcgtcgtccgttcctcgtcagcgtcgagggtcgcgctttcgtttactcacgcattccgacgaaccagccgttaacgacctcggcctcgacccttgtattccggatgatttaccttgctgccatcgctctttttgcgacctgattggagtaatacccggaccccaacggcaagaattgatagtttgaacagcatacagcaacagtcattggccaaaacctctcatcttttttgcttcctcgtactccgtttccgttctgggagaagcccagcgaaaatctcacaattgggccatgggccaggcagccagcgatatttacctgtccaaagcctacgcatccgcagcacaaccacccccagaatcccgtggaatcagtcgagattaggggcaaaaacgtgagaaaagccacccgtttcctcaccgcgacagctagacggccgcgcactacctgcctgcctcctagtagtgggggagcgcgcggcgcgccgtcgtataacctcgcgctgagagcggagcggaatcggaagatcccgaggggtcaagccacaaaagttcggcgccaaccgtgaggaagaaatctgagagcgccgggcaggcggagcagcataaactagaacggaggaagctcccgcggcggagaggaagcggcgtccatttgctgtccgcgaggtcgtgcctgatcggttcagatgggttcgtctgcggttcgctgcccgtcttcgtccagttcctgatcaggtatggtccttctcccccccgaagagatctgcttgtcgtcagatttcgattccactgcgactgggtggaatttgtgcgatttagtgtttcctattgagtgtaggcaactgatgatctgtcagaacgtagtctctgttaacatcaagtaggaattcgccactacttttatttttcagaatccaaatggggacatttcgtcgcaatccaatcgttcaacgtgtactttgatcgccgatatgtgcttcccgcatttttaggttgattgacagcattagggcatccgtccgatagtctgtctgggttggtgctgaagtcatataatgaaattgggggtgacatacctgtgatgtttgccggtggctcttataacagtactaaattaccgtgtagcatttgagattttaacatccatttggatttggattacatttcctgtgtaggtgtactaaaattcagtttgttctttctaatgacagctcttaacaggcagaggacttgggaatgcagaaagatgtgcttgcacgacaggaagttaatatttcgtgcaaacaagatcccagcttggatcaagccgatgttgctggaccttcatgtgaatgtgctgcatagtgataccgtgctgcttttccgtgttttgaagcatagtagattgaaggactccaagtttgttgatcatcacattgacgacgacggataacatctgctgcattcattacctatactttgtagatacttctatagaagtggtgtggtggtgtttgctcattttgttgtgttccaataacttgatatgatggatgggaggtcaatcttgatgggccgttatgaggttgggaagcaattaggacaaggaacatttgcaaaggtgtattatgcacgaaatcttactaccggccaagctgttgccataaagatgatcaacaaggataaggtcatgaaagttgggctaatggagcaaataaagagggagatttcaattatgagattggtgaaacatccaaatgttcttcagttatttgaggttatggctagcaagagcaagatttattttgttctggagtatgctaaaggtggtgagcttttcaacaaaattgctaaggagggaaagctcagtgaggattctgcgaggagatatttccaccaattgatcaatgcagttgactattgccatagtcgaggtgtttatcatcgtgacttaaagcctgaaaatctgctcctggatgagaatgaaaaccttaaagtctcagattttggtttaagtgccctggctgagtccaagaggcaagatggtctcctgcatactacatgtggaactccagcttatgttgctcctgaagttcttagcaggaaaggctatgatggtgcaaaggcagatgtatggtcttgtggagtaattttgtttgtgcttgtggctggttaccttcctttccatgatccaaatttgatagagatgtacagaaagatttgcagagcagacttcagatgccctcgttacttttctgctgagctgaaggatcttatacataaaatccttgattcagatccaagtactaggatttctatcccaaggataaagagaagtacttggtacagaaaaccagttgaaataaatgctaaaaacagtgaggcagccacaacaaacagcatctcttcaggtgtagctacaacctcaggttctgcagagtgcagcacttctgaggaaaatcaagggtccttaagcctcccaaacctgaatgcatttgacataatttctctctcaacagggtttaatctatctgggttttttgaggatacgcatggtcaccaggaagaacggtttaccactaggcagcctgtgacaacagtacttggaaagctgaaggaattggccaaacgcctgaaactaaaagttaagaagaaggataatggagttttgagattggcagcaccaaaggaaggaaagaagggctttcttgaacttgatgcagagatttttgaggtcaccccttcattcctcttagttgagttgaaaaagaccaacggggatactatggagtatcgaaagctggtcaaagaagatataaggccagcactcaaggatattgtttgggtgtggcaaggtgatgagcacctgaactcacaatctatcctgcaaggagagcagcagcagtccccattgccaccagagctaccacaggatcagttgcaaccatcattgccacaacaggagaagcaggacatgcctgaaccaccgttgttgccacaagtaccacaagaagaagtgcaaacatctatccccgcagaacaaacaaagaattagttttaacagccaactggtaattcaaatgttcttgtcatccatgtttgtatccttcttttatgtctttgctgcttgtttctaattcctctggaattgcaaagctgtacctgtttgtacagaagtgcaatgcacttcaattttggaaactacaaaggaacacctccgagtgttactcctgaattttcgaaagagaaacaatcattgatgagaagtattgaaccgtagaagtttttggtgatggggacgtctttggatttttccctcttcactgtgaacagttttggagttttggtctttggttttaatgagcgtattttaggtttgttgaaaattttgttgactggtccctttatttcttccttggatagccgtctactcgcttatgtctgtcatggactgttttcaataagaaatcaattcaacatttttgcaagtgaatccacataactagctttctttcttattctaggtggctgttctttgcaaaggagaatcgacattatattatttctatacgtagaagtgattataaatccgaggaagaaaacatactagtaggttttactgaaaatatccatgctttttgattgtttgagaaaatctcatgtggttttttaagaggttctgaacatcatacattcgcagtttttttatgtagcagaaacctttattacctcatgaagaaatctctacaatggtcagaatttcaaatacattttctatttagcatctagatttccatcatctatgtgaagcaggtcaacgcctcaacggggaatcacaatgaccattggttggtccattggttgatgatgaaacctttcaggtttcctgtgagctttcggagaagaccctgctcaagtctccccacaacagactagcattgtagtcaacggggatcccaactcttagaaaagctccggtaagccattacacaagatcattttagtgcacccatagacccactctctccttgctggcatcgacgggcgcagaagaactgattcgatctatatttgcaacatgagcggggaagtcgaattaggacagccgttgcgggtaattaccttgacctctcttttaagttccattcttgttgctccagtaaggaatgcctaggctacggacaatttagagactagatttcctataacaatggatattgctaatcagtatgttgtgaggtacaatttccattacagcatatcaatttcaccatgtaaatgccatgttttttctttgacttcccctgttgtgcttaatttggtggggaataagactgagccgttgtatgtaaggattatgaatccctaattgttggcatctcctgtcgatttcttgcactgtccgcagttgcgcatcgtctcaactcgctagtctaatgccttgctgaagttggttgaagacttgaatggattgccctttgttgatgtgctgactttccatgcattcccgtactgtttgcagcccccagattctgtaccaagtacaggaagagacgaggaagaagggtcgtcgcaccatggaaatggctcaggcgcagccagagagaacccagagaacccattgccggacctggcgctggcgaaatccgagtcagaccggataaaagccttttaccagacggtcctctcggccattgtcgtgttcatcgtggcggcgctgtcaggatacaaggacatgaagccgctctactcgaccacaaatcacaagaaagttcacctcagcaacctccttgtcatcgaggggttctgcatgattgctaccttcatatgcgcggctgttttgatgatgtacgagttctacacgtaccaccatgagatcgcccgcgaggtcgtcgcaggtgcagggacctcaccgtcctcatcgcggtcgccggagcgatgctggttgcgacggacacgatcctcgtcgtcatcgccaacagggacaacgcggtgttcgccgttcttttcgtgccggtgctgctgttagtcggcatggctgtgtacaccggagcatcgatggaggagcagccgccgaactcgccgcacgacggcgggtacgatgaggcaaccaaaagcacctttgatctggccaccgttagtacaatggctgcattgggtttgcaggggaccatcgtcttcggctacctgaaaacgcccgagaagaagagcgaacatgatgaccctccactggacctcgccgtctgctacatcgcctcgacggtctgcctgaccgtcatggcggtttgcgccatccgctggctcttctccccgaagaaaagcggaaggctctggtcggaatcatcggcagcctcaggcacgtcctgctcgcctctctggcgctgatggcggtggttgtctccgtcgagttcttggacggcttcgtcgtgctctccgtctggccggaggccgtcgcgctggtgctgtactacgcggcacagctctgctcggggcggcagcccgggggaggagtcgggagccggccatggatcgaatttgtcttccggattgtcgccaccgccgggttcacgctcatggccgggctgtacgcggcgttcctcgggaccaaccactacagcgtgtacctcaaggccgccatgctcgtgctcctgatggcagttctctcgagcctcagccgtctggcgaacccggtttacatgcccgagatcgacggagctctccttgagttctgcgtcgccggcgtggcgctcgccttccccgccgtgtcgcttctggttgcttgtcccttggtgcttaaggtcttcgttgacctatatattcatcatagttctctttgaaccaaggaggtgggtggaaccatggtactccctccagcccataatataaaggattttgagtttttgtttgaactgtttgaccgctcgtcttattcaaaaaattttagatttattatttattttttgtgacttactttattatccagagtattttaagcacaatttttcgggttttatatttacataaattttttaaataagatgagtggtcaaagagtgcaataaaaaactcaaaatcattatattatgggacggagggattaggttactaggtttggtgaggccgtgaggtttcccatctgcttgctgttcggacatagagcaaggataacattagcaagacatactccctccgtctcaaaatataataacttttagctctccggatttgtcccaaaatataacaacttttctagcaatattctcttcccactcaatcacaacccttcaccattcacttttcccacctatcttcactactcattcaatcacaaccctccaccattcacttctatctacttttttaataaccgtgtctaactctaaaatttcttatattctgggatggaggaagcaactaaaaatgtagagcgttgttctcatgtaataacaatctacatttgctccgtgatacatacattttaaatctattaacttattaaaggaacagaaaaaggagcatccatgttcgctctcacggcctagaaattatcatattaattgaagaaatagaaaaacagagtccatgtagaaatacaatttttaaatagttgaaattcggaattaaaaaataaggaatattgaaagaggagactagactccatatagaaatacaatttataaataactgaaattcggaattaaaaaataaagaatattagaagaagggtatagagtccatatagaaatacaattaagaaataatagaaatttggaattaaaaataagaaatacttatagaaatacaattaaaaaataatataaattcggaattaaaaataaggaatattagaaatagagtatagagtccatataggaatttaaaactaactaaaattcgaaataaacataataaaattaaaagtagagaatccatataagaataccatttagatgtaactgtaattcgaaattaaaaattaaagaatattgaaagatgagtttagagtccacatagaaatacaattagaaataataaaaattcagaattaaaaataaataatataggaagaagagcctagagtctatatagtaatacaatttacaaacaatgaaatttccgaattaaaaataagaaatattggaagacgagtctagaatccatataggaatacaatttagaaataactaaaatttgatattaaaaataattaataactatcacgtatatacaatacggtatgaatattacacaatggtagtttggtaaagttagtaaaaaatttaaaattatgtcatcattttaatatattttaataataaattgagaaaacatatatgctattatataatagaaaatataatcatgccagccgcgtaatctatgtgggccaccatgctagttcatgcatagtaagaaaaagagggttggctgacctcagggtgtccgtgtcgctcccaccctagggcgacactgacagggggcgacatggacggcgaccaaagatccgccgccacccatccttcctcctccttcggccttgcagccgcccgaaaggccaccggcaaagccgactggctccaaggactacgacgacggggcttcgtatttcccccgagggtgccattctggcaggtggttctgaggcgacccaagtggaagaggtggtgccgtcgcccagatccatgctctcctcggccggatccggtgaggagcagtgacacgatttggagcagcggcagaggtggccgctcatgctgctggatccggcgacaatagtttgcgtgggtcgacgcgatggtggagggtgctggcggcggggaagagggagcgaagtggaggcggctcctttggccgggtcaggagaggagccatggcagggaagagggtgtggaggcgacaagcccggatatcggcatgaaggggcacgactggcggtgggaggctggcgaggtgcatggagaacgtgacacaaaggctcatggctggcaagcgcgacgtggaagcgacgaggtcggcgtggaggaggcgatgaggtcggcatggaggctggagtggtgtggagcgtgctaaggtgggagcaccgcaaggctgggacagtgtggcggcgaggcttccacggtgggaggacgaaggcgacggcggtgcgaccaggcggcccgttgaagagacacgggtagcttggttgaggcggtgacgatggtagcaccatgaggtaggcgttgaatgctgttacgagctcctttccaggcgtcagtcttgttgtggcgatggctagccacattggacgggctagtgggaggagagaggatccatttttctctctcaccctctccctctataacccacccacaaggatggatctggagcacgccggaggttgagatgctactttgatggccaaccggcggcgaggcatcggcgcggtggcaagttgaaagggattagctggtggtgactgttgaatttgacagatacttaatcaatcgttagatttgttttggacgaccgatatgtacaaccccccccccccccccccgcggggggtcccgcgcggcacagcgcccgcttctctggtctccgagtcttttacccctatgccgttaaaaagttgctgcttatctgtgtgccacaaaaaagtttagagtcacatgtatgccatgagcccaactttcgttgacccgtgtgccattttggatggatggagacataacgaggtgttaggggctgtgtaaagacagttttgtccttgtgtacaataacccatcggagccaccacttttcctcacccgggaaatcgccggcggcgagccccttgtcctcctcctccggtgacccgcagcctcccgcgatgcgatccgtggcgaggctgctcgccgcgctccgtcgtgccccgccgcacccgatcctcctcctcctccccggccgtctcttctg

SEQ ID NO: 9471 - DNA, 1632 bp, Oryza sativa
aacttttttgtggcacacatgtaagtagtaacttttttttaagttgcataggggtcttggttctccttctcctcgcgccgcctctactcactctggctcaccgcccccctggatctggttctcagaaggcagacgagagagcagacgagaggggggagagttgcggagcagcggaaaggggtcgccaatcacgaccctatcttcgatccgtacggcgacggtcatcgcgacccccgcgaattgctccgtcgcggcgtcatcccgtgaaccaggtgacactgaggtgaacttcccttctctctcttcctcccccgttgtccctctccctcccctcctgtctgccaacaacagaatcattggggttctgatccagggcattatcccgatatcaaggtgcatacctaggaaggatcatgatctaagtgggtttgttttacgcgtacttgatcagttcatatgatcgattgttattactagtagttcatgacttcacgagatcagatattctcgacatatcaactaattttataaacggcacacatattactgtattgttagggggactgctttatacatacagattattcattactttactggtctggtctagtctggtctggtctggtatatcatggtgctactgtttctgagcggggtctggtctggaaatgtgctagtacccgggactgataaattatgtcctagaacattaccagttgctgcaactgcatgaataactgccaatttgtagtgctcgtatattggcaaacaatgaacagaacgccgttaaactcgccagacaagagcgcaatacaatttgaatccatccaaaagtcagtctcacccaaactcctgggcatctcttgttagttgtttcttccattctgtttagccaagcttacttagtttctttcaattgtgcagatacatgctggtggggttgtgttgattgggtggattgcagtaaacatatcaccttagtatgtcagaaaagcaggagtccatggcaaagcttctgcctgacgatgtgcttacaatcatcctccgttgtcttgcgccacatgaccttgccatgtctcgctgtgtctgcaaactctggtgcaccatcatcgacactcatcgcatgctgcgtgtggacctcctcccacactcagtaggcggcatattcatcaactttcatgatctaggcttgtcagaattcttcgcccgcccctcgacaggccccacaatatctggcaacatcaactatttgcctctcacatccatagttaggggccactgcaatgggctcctcttgctttacagccatatcagtcgtcccggcatgaagcagttttatgtggttaacccggctacaagacagtgggtgcaattgcctccacctccaaggcctgatattgggatcatgcacttagacaatttgtaccttgcctttgaccccaccttgtcgtcacactttgaggtatttcaaatcccctatgttgatgtcttccgccatcgctctgagttgaatcctgcaatagagggaatagaatggccaccgtcaacatgcgttctgcatgttttctcaacaaggacaaggcatgggaggagagatcatttgttcgagaaggggaggctgcaggatctttg

SEQ ID NO: 9472 - DNA, 924 bp, Oryza sativa
ccccgggcggcatctcgcaataacctgagatatttctttctgctgacgacatgctttcagcagcggcaggatgcgcattgccgagtctaatccggccatcagcaatgcaacagcaagaaacgagtgtaatcattgcgtccacaaacaaagatgtccaactaactacacacgatcagtggcaaatctgtattacaaatggacagtgaagagcgcacgctttcacttcgtcgtccctaacctttttctcttcccgcttttccccgcgttagctaagctagctatagctcctttgttgctgctgccatgtccgcggattcgcttcgtgccaggcatgtgcgtgcacaggacacatgtcatatgaccttcacaaattttgccttctcaacaaccaccccccattacctccaccaacacaggcacccatccaccacaataactacgctgcaccgagcaatgagcgcatccctccatctgaccatctccgggcagcaggcagagacatgcagaagcatgaaaaggagcttaatctgggcctgtaccacactagctagctccatcaactcgatcgtagcaggacattaagatggtttagcttagacgtggttttcaactatctataagagatttcgctacaaattaattaacatggagcagtagtcatgcatcatgataaggaagtaattcaaggctttgacagatttttaagtgagtctaaggctgtgttcgtttggacgttttcccagcgcgctacagtgttttgcccccgcgcacgcttttcaaactactacacggtgtacttttttgcaaaaagtttctatacaaaagttgcttaaaaaaatcaaattaatccatttttgaaaaaaaaattagctaatacttaattaatcacgtgttaatgaaccgttccgttgtccgtgctaaaaa

SEQ ID NO: 9473 - DNA, 780 bp, Oryza sativa
tcttcaagatgagatcttaattaatgtcctttgggaactctcccatccaaggtgtgcacagaaaagactcttcaatgaatggttggatacccatacatcctccataatattttgggccaagattgcccaagtcttgaatcttgccaaagcctctaaacttcatggtatttaagtggtatgccagtcctcggctcaatgagtgacttgagaaaacaacttccttgtaagggtgaaatcctagaaaagtaattctaccgtagcgcaaatttctttcgtctgtagtgttgataaaattatcattgtcagagtcccaatcaaagttttgttcctctattgcctcactgttgtcatgtccgtacgcatcaggatattcatgatagttatatcttgtaaggtccagggcccatcagtttgctgaaatgcatgtatgaccagacagctaatagcgttcttctgcacccactccatttttccgtacgattcatcaagaatataaattatgtctggatcatcaaagaatgtacagtacaccctcttctgtgatagtcccatataaatatttgactcctcgtaccgttcaatctctactggtggtttaattattcgatacttgccatctgacaaagatattctgcaaatattggaaaacttagaaatattaaaacatgataaaattgagtgatactatttgttaataaagaaataaattataatacttatcagtgagactacctcattacaaagctggtttgacagcgtacataaagtactccccgacag

SEQ ID NO: 9474 - DNA, 1116 bp, Oryza sativa
gcttatgcaaacaaaataagacaggctccgacatagttacaccacacaccggtgtaaccatgccccacacaactcaagaaaaaaaacgaagaaaaacacacgcgcaggcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttggggcggcagatctctccctgggcgaccttgagctgatgcagctgcgcctccaacgcgtcgaggtccttcttgagctgcagattctcttggcgcagctccaggatcttcaggttgttctccaccatgccacgacgcaccatctgatggaagtcgatacgagccgcgtcgtacgcctccaccatgcgtgccagatgcacgacggtagcgtcatcctccgagctggcgtctcggaaggtggcgtggtcgctggctcctccgcgacgggggtggtagcggtagggcgagtgctgcaactcgtccgggtagcgctggtgaagagtgccgatggcgaggagagcggcgttctggcaagcggcggggaaggaatctccacccgcagtgactgccagcgaagtccactcaggagagccggagaggatcactgcagtgacctcccaaccagcgtgaggctctgcatcctcaccctcctgctccgggagcggcctggcctggtaatccactccatgtggataccccaagaccacgcacatgccccgcagctccaagacgaagccagtcatgtccaaaccacgacgggtaacgctgccggccatctacaaacaaaaacaaaagaaaagcaacattttaaaagatcagattttgacgataaatgaagcagcaagacaaagagagaatagcgggttttcacaaataataaaggatttttatttttgaaaatattgctaaggcttgggatctacggctcgtcctagggtcaagggaggctctgatacca

SEQ ID NO: 9475 - DNA, 7443 bp, Oryza sativa
ttctgctgtgtgcaatgctatatgctttctgtaatgcaatgccagatgttccaaaccagttatgtttattttatgtgtgttactcccctgtcctaaaggagattacctctacattaatgttaagtactgcaaatctagatggactggtaatatttgtctctctctctctctatgtgtgtgtgtgtgtgtgtgataggccatatactgtggagcggcatgcttgtggcagatgaatagctaatagagtaatctgtgtgaaaagttccaacctttgacattatatgaagaaggttttgtataactgtaagttgtccgcacgttataaaccatacttaatcccctccaatcaaaggcgattgaggggaatactagttcaatttctcccccgattcgaggtgattattttgccaaacaaccccttgaaaatggcttgagagcgaagggccttgtgacaattgaggattttgtataactaaagtcgtccacattttacgaacagacaatgtttgactttttgagagcaaaatgatccttttatcccttcgtcagtttaactggaaatggttcgccgcgtgtccatgttctcggctctccccaaggaaaggctgtcactgcagaacagagtgtataatagccggccccatacggggcatttttggacgattgcttcacattgactctagtaagggtgtgaggtgagtcattagcacatgattaattaagtattaattattttaaacttcaaaaatggattaatatgattttttaaagcaacttttctatagaaattttttttgcaaaaaacacaccatttagtagttcgggaagcgtacgcgtgaaaaacaaaactatctttctctctttctgctgcgctcaaacgcagcctaaatatagtttgttaatatagaaacgaagattacttacttatctaagcagcgtaggctgattataaactgtatggcttattaggaaaaataataatttgtgagtaactttcatatatatatgttcttaatgattaatggtaatgctgaaaacacttagattaaaaatacatcaacgtcaagttctaaatttaaattcgatgaaaatatatcaaaattaagttttaaaaatttaaatttagtgctgattgcggaccttgtcgattgtttggagtttcaactttcacggaaacacaacgaagaggctagcaggaaggggaagccatcaggcaatagaaattttgtactccatttcaggttataaaatattttaacttggatcaaagtcaaactgttttaaatttaactaagtttacagacaaatataataatatttataatactaaattagtttcatcaaatcaataattaaatatattttcataataaatttgtctttggttaaaaatattacttttttttacaaacttggttaaacttaaaacagtttaactttaaccaaagtcaaaacgtcttataacctgaaacggaggtagacggaggtagtagtacttaagaggtacgaataggtaccaattttttttattgcaaatttggtatatcctattattgaggtaataaattttatataaaaaatactctaaaaatactccctcagtcccgtaatataagggattttaagctttttacttgcattgtttaaccactcatcttattcaaaaaattttagaattattatttattttttacttactttattattcaaagtattttaagtacaacttttcgtttttttatatttgcacaatttttttaataagacgagtggtcaaacagtgcaagcaaaaactcaaaattccttatattaatattatgggacggaggggacgggaggagtatgatacaatacactgtagaatcactcataaggtaaagggcctttgtcatttgctaattgcttgcagatgttccaaaaactactactactaacatagaagcaaacttaaattgcggctgcttgttttatcctgtggtgaaaattagctccgtttgaataactgaaggcgtatgctactctaaaaagactaaaaatgaatctgcaccatcctcccattgcagggcagagctagaacgagatgaggggtgccacctatttaattgagtaaattacacgagcgatccttaaacttgtaacgaacttttacttaggtccacgaacttgcaaaacatgcatcaagatccttaaacttagtttaatgtatcatcacggtccaaactctgatttgaccatggtcttacctatatggtatgccacgtggacgatgacatggctaaattttctttttccctttctttcttcccatcttttctctccttcctcacctcgcgtggagaaaaatgcagcagaagagagaggaaggaggcaaagtggagaaaaaaaagagataagaagggagaaaaaaagaaggaagaagggagaaaaaaataaaaaaatttcatatcatcgtctacggagcatgccacataggcaaaaccacggtcaaacaaggctttggaccgggatgatacattaaaccaagtttaaggatcttgatacgcgttttgcaagttcgtggacctaagtgaaacttcgttacaagtttaaggaccactggtgtaatttactctgctttatatcaagtttaagctaatacaggtgtttaaatttgtattgagggggtgcacatcagtggtggatttaggccatttctgcggggtcggctaaccccacaactttttaaaaatgtcctataaatctcaatttttatgtataaatccaaaagaatttagagaaatgaccccacttaaatacaaaccactagtaattgaccccacaggtttaaattcctggctccgccactgatgcacatatgataaaattaggttaggtatagctacaaacttttcttgaacggattcctggccacccccctcagtactcctgcctctgtccccatggcatgttacacctaaagacactattaatatcatatctaccttcgacatttttcactctcgcactctccatgatgcatttttttatccgtatttttcaattttataacggtgtaatgataatattgattcctagtagtttatattactgatcaagctttaacgtatagactatgaaaaaggaaaagttaacacacgacaacgacccattgagaacttttaaaacgaaattgccaagaagattagtggcaattgtttttctatgttgactagagtccagagagagtttagtcgtcccctgcatttccccatctcctcctctgagcaactatatcgagtttcgactaccatctcagcttcggtctcgtattctcgtggatcatcggaaagatgatctctacggaagaggactctgattcttttcaggtaaagagaagagatctcttttatcttgcttcgtgcttgttttgtttgtagctttgtaccaatcttttcgtccaatttcatggatctagaccaaaattttcgtgttcctaattagtttcttttcatgattgttttatgatgcaaatctaactgccatgtcaattgttttatcgttagtaaatttcttattgttcgcgtccgtgcttttgaagctaacagcatgatttttttttcgaacgcagctaacagcatgatttggctagtcctttaaaacatgtgtataaaaatcatatgtacatatattttgaacaaagtcacctcttgttaagagagattctaatgatataaattattttaagttatttgcttattagactctgccgagatgctgaagtaacttgcataaagccgataagtagagaaaggagtacagaaaaaaaaatcaagatctaaactctgttagcatggatcatggacctgtttgaaatactgtacagacaactctgacaaaattagttaaccagtagtacagctttcttttcttaggaaaacaactttcttttcagagagtttcatgtcttgttaccaatttctgtttgattccatctctgacatatattcagtgtgttgggacttcgagaccacagcaaaatactacttgggcagctttctaatagtactagatttagctaataagagaccatttgtggatctaatcgccttctgaaggcgattagctagttttactcgggagataaaacatggaaataactgagaaacataaagcctccgccggccattcccgttaaccatttccgctctttcttcttaatctgcctgtgggcaggcacgatgtggtgttcagacatcttcaacgacttcttcgtcggtgtatcgatgatgctttcttatgggtttagcatttaaagtgctaagatagaattgtcctcatagcctggaaaaatattctattgttctctcccggccccaaaactctgctaatctgttatggcaaagctgttggtttatgcctgaactctgatagcctgtaacccgttactcacttttcaatggaaaattcaggtggagaaactcttaccctcgagtgatttactcccaaaaaaaaatggaaataactagtgataattttttttaacccttcccaggatgacagcgaggaactgcaaatgcaggtgacaaagaagacgttgaagcgtgtcatatcactagccgaaaccttcatcgccatagcaaccggcatcctcgcggcagctttctcggcaggcaaagatgtccacctgcaccgccacgtcctggccgccggcggctgcttcctcgtcgtgacatacctgtccgctctcctgctcatctacatgaagctgttcttgtcagatcacaggcggctgcgccgatggcacgtccggtccctgcagctcctgtgcgtgaccagcggcgcgtcgctcgtcgccacgaactccctgctcctcgtcctcatcggcgaaggcaatggcttgctgtcgctcaacctgctgcccgtgcagggcatcgtcggcgtgctcgcgtaccacgcgacgccgacggaggggagcgcgcgcgacgaggcgttcgaggcgcaggtcaagagcgcccgcaaggtcgcgctgttcgcggcggccacggccttcgccgtgcagaccacgctcgtgtttggcgcgttcagcaacgccgccctgcaggcgatgggcggacgccggctggacctctcggtgtcgttcctggcgtcggcgctcagcgtgttcttggtcgtggcgacgtgcatgccgctcgggttcaggaaccagggcgccagggacaaggtgctgtccatcgtgaggtacctcaagaaaggcgtcatggccgtgctcgcggtcaccgcggtgactctcggccaggagttcctcggtggcgccgcggcgctcgcgctcttcccggagatcaccgtcgccgccatgtactacgccgtgagcatgcccgccgacgaggcggccgcggccgctgaccgcaagatggaggtgcttccgaccgtcgtcgtggcgacgttcggcttcgggatgctcggggcggcgtacgcggcgctgttcggcacgccggagtacgacctgtacaccaaggccctggcgttcaccctgctcaccgccgtcgtgtccagcctgggccgcgtggcggggccgctctgcaacgcccagcgtgacaagagctcggcggcgtgggtgacattcctcagcagcatcctccccatcgtgagatgctggtcgccgttccgctcgccgccaaggtaatggttgattttctcgccgttcctggtaatggctgattttctcgccgtgcactcactagcacttgcatgtcttgatcacttgtacaaattcttcgaacacgatacgtgcatactctgacacgcaccatgttgttgttgtactttactgactttgtacaatgtcatgtacttatagtagtggacctctcttggacaccctgaagagcacatattttttgtgtgattttgtctgaaatagtactgctaggagtagtatttgccgcagcagcattgcggagttgccaacgcctcgaaggtattcatgggcttattagattgatgggctgttttgtacagacaatcacggccccggttggctgtcagcctataactccatcagattgtgtggttttggtttaaaagaagagcaattttacaattcgaggtaccatgaggtaccatttttttattgtaaatttgatatctcttgatacctaggtactgtgaggtatcatgagtgaccaatttttacactaaatttttagtacctcatggtacctcctcaagtaccgtagaattactctcagaaggactcattttgatcggttgcaaacacgtagtctcgcagttaaaaaaaaaaccacgtagtctcgtgaaataagcctagaattgatcgagtcgagtacagttcattcagaggggaaaaataaaaggaagattacgatcgtcgattgggaccgaaattccgaacggaattgcaattgctgaggtttgttgacaggcgactgaactcaattcttgtccggtgtttccggctttccccacttccttgaggcacaactcagcccgccgtcaattccgagaacttatcaaatccatgatgaacaattgcgacgttcgctttcgagcgggcaggtccatggagtgtaacaatgagagaataaaaatcgacagtgtaaggcaggaaggcgacgcgttactgtgcacgatgcggacctcgaaacgctctagtacacagcacacgcaacgggccggagttgtagtgaagctcttttttttttccttaacgaacatagcgaagcttgagtatcagaacaaggcattttatacgcatggggatcacatgatgatattaaactacttgaccgacacagcgttcatccgtgaaattatcgcccaaaacgcaatgcctcgtccagccagtagtacatcggctctgggtttcttcattatagttcagttggatcgtcggtttcatctagacaagtatccgaagtaataatctgtcgcatcggtcaatgactatctgctactggctgatgcagggagcagagcatactctgctctcgcaacgtaccgattgacgtacatggcactcacagcaatgcagcatcgtgcagtggtcgatcgacatggtgaattggcgatcgggttggctcggctcggccgtgaagcaagcaagcgtacgtgagcacgacaagtgacagccaaccaccgaacacgatccgctatataagacgctgcatagtgcgcacaccttcaagctcgtacatgtacgcaccgcgacactgcgagtcctgcaagaagccaagccaagcacacgagcgcagcagcagcagcagcagcagctaagctagctagcttggagagatcatcggagatgcctcccaacgcggcggaggtggcgcggccgaagagcccgctccggggcatcctgccgcagagcccactccggatcaagcaggacggcaagttctacgagcggctcctcgccaagagaggtcgcggcgagccgctccttcg

SEQ ID NO: 9476 - DNA, 1149 bp, Oryza sativa
gcgccaccgccaccgccaaggccgaacaccgagctgtccacccgggcgcgcgcgcgtccgagcctttggatgctgcgatttcgcggattccgaagctggagccgcgacgacggttgggcgtaggtcgctctcgacttctcgagtgtatacgtgcgtcatcatgggggattagaacgtgacaaatgaaatgtttatggttgcgagagatgttaacggttgtttgtatgcatgctgttgttgcctagcgtttcatggaaatcatcattaattacgcgttgattatgtttacggatgaaacccgacgtgttcggaacagttgatcatcttttgtcactagtttaacagggtgattaaaaggatcatacacaataatctgattagtacgcttggtattttctgtgataaattaattttattttcccatatggtctcagatatgtttggagatgtagcaaaggaaatgtttgatgtgttcgcttcggtttatcggagatgtgatcagtacggtacggttaaagattcttaattagctacaggccctagattgaaagaccaagaacggctatagagggggtgaatatagcaattcaaaattcacccttgaaaatactcatcaaaacgattttctcaaaattcttactagaatcgcagctattagaaaagccggacctagaaaagaagagagaaggaattcccgaaactagaagagagatgagaggaagatagcaaatctcatcattgcaaagttcaaatcgcaagcagaatttaaattgtagaatttaaatggacaaggcaaaaataaaatctttcaaatcatctcattcataggtgttgcaaaataaccgctcaattaggagcaaacatacaccttcatagaaacattaattcaaacttaaaaacctctcgggcaaacacactccaaactcacaccgaaactctctcaccgagcatcttaaaaggattacaaaaggagcaacctccacccttacatccatctctctatttatagcctaataccccctaagacattgtctcaaatacctcatacctctagggcgaaacccaccctggactcaatctcagccacttgcttttccttctcctcaaaggaatagctccagatcgctgccacgtagtcatccgactcct

SEQ ID NO: 9477 - DNA, 17516 bp, Oryza sativa
caaaatagagagcagtgctcaactgccttgtgttcgatccttggtactccatgtttctgggatgttcgattatccaaattactaaggcggtgaatagaaagaagatcacagtggcaaaccaaagttcttttgtcagtggcttcaagaatacccattcgattttttattcagattcattctccgcaagcacaagcattgaaacaccagactcggtgtacggcattgtaaactccacatggctagctcgatcagcaattatggttatatcccccactgctgcatcgttgatctggtagcaagaaccagaagatatataatattagtacttgattatataacaatgtcattaaaacagagggagtaaggcttacccctgaagatacactctgtactagctcgtcataagaacggtcgaagacaacaaactcataaatcagacggtatggtaacttattcacggcagcctcgaagagatcaatgcagtagccagtgacaccttggtcagttacattcacaaaagctctaaagccatgtttcagtggcacagcaatcttgagtttcttatgataaacttcaggcaaacctcctaagttcctcctcacaacagcatttatcctctcggtttctgaatcagggaccaaaaaaaaaaggttagttcgtgtcaattgtcaatccaatattctcatgtcctatgagcaaaaatgaacttcactgcacaacaacaacaataattctttgcatatatttgcccatttctgttacaataattctttgcatatatttgcacatttctgttaggcgcatttcataggagaagtcaagtacatatggaaaattaaaacatttccatttttccctcctccactatatttttatggatacttgtaaaattccgtgtactgcttgtttgattctacgatactgccatcgcaataaccattcacaaacttggcccacataagataagaaaattttaaataaaaaaaaactaagaattcgtggagtgaacaagtcaggatgaactccccgcaaacttttaataataaaaaaatcctcaaaaaagaattaagatgaacagcgaacgtcctcaacttagatggacggatggatatgggatccacggcctttaggggttgggtgccgaggagacacctacaggaaggtagctctgattcagacggtgtagttggtgtggggaggtggggatgactttgcatgtcaaattttagcccaacataaaaaaaatactctcaaattccgtgcaggtggaattatccacgatcataaatatatccttctaccagatgagtgttatcacaacaaatatgctactacaatttgtaagtaagtatgtagagtgctagacaataaattcatagccaacattgtcaaaatataccttcattatgcataaaattttggggcaattgtgtttttgaccttgttttaaagcctaactcccaatttaaccctgttttcttaagtttgctcatttgaccctcttttttaaaaatgaagatcacacttgaccctattacgagaaggcaacataacggtgttaacctgtaataaaaatatcatttatgcccttgctcatttgaccctactttatcaaaagtttttatttatttacccgattttgacaaaggtttgacaaattaatttgtcttagatttgacgaattttgataattaaaggtttgacaaacgtaaattaaaggaaacttgcagacaaatgtgagacacaagctagtgaattaacaggaacttggcaaagctttaatttgcacttcacgtacgtaaaccagataaacagatatctcaccatacagagagttaatcgcaaggacatagcattgtcgcataattcagaaaatctcgttggataagaaggttcagaaaataattaattctttcaaacgagattagcaacacatccatccagccggcgcatggagatgatgggcgcgcaggagaggatgaaatgaagcagcagaggctaaccataccggagggcaagacatggcacggcacaggggcgtacgtgatggaggcggcaggggcaggcaggtatggcgcgtcgtcgtccctccctccgccgcgcgccagcctccgtcgtccctccgcgacggacggccgagaccgtagccgtgcgccctctgcgcgccgcctccgccgaaagcgcgcttgcagctagctagccgcgccgccgagaaggccgagatgagtgtggaccacgggatgaggaattttggggatagggttgaggggcattttgaccagtttgagctataaaatactccctctgtttccaaatatttggtatagttgacatttttagtatatgtttgaccattcgtcttattcaaaaatttttgtcaaatatataaaactatatgtatacgtataagtatatttaacaatgaaccaaatgatacgaaaagaattaataattacttaaattttttaataatacaaacggtcaaacatatttaaaaaaagtcaacggcgtcaaaaatttagaaactgatgaaatattttattattattattttttaagtgaaatcctaacggtgtacaccctccgtcccataaaaaaccaacttctgtagataaacctggacaagcatgtgtccaagtacatctcagaagttatctttttttttggacggagggagtagggagatataggtcaaacggtagcttcgattttaaaaagtagggtgaaatagtcaaagttaaaaaaataagtatgaaatagtcaaaattaaaaaagtaagtcagattagtagttaagatctagaacatgatcaaataagcaattgtccctaaaatttttagctacgtatctcaatatattgtgatagaattataacgtatagttatataaataactagctgggtggcccgcgcaattgcgcggctagcacccaaacaaaatcatatatttttagtatgattttacttaaatattattaaatagataccttgttgtcttaagattttgaaagaccaaaccttatcacccccgtatttctaattaaatagtttttaaaaatcacaccagttactatcccttacttttgtcatatcttacttttgtcatatccttctttatttgtttgctcaatctatcccgggcgggggagtgatgtgggctgaagagaagggagagggagggggaggagaagaggacttgggaggacttgggaggaagaagggaggactttggaccacatttgacctaaagagagggagaggattatttttgcgttttttattttaataaatatggaattggtttttgttgttttaaaataatttcttatgctcttatacatgtttgattatgtcttctagtatttaacagtaacttttacccgtagggaagtatgggcattttgctattgagttaataaattaaaacccgttagataattacgagaagaagctagcttgatttagggctgaaaaattctttccgtcgaagaattcagggacgttcttacttatgttgtcaatgctcaggcctacactcgcttaatttatggcctgatacatctccatgtagagactgaattcagttcccatcatcgaaaaaaaaaagaaaagaaagaggtcaacgtcttgtgagcaaaccaaaatgattttcttgtgagcaaaccaaaaagaaaacagagagtatacctgtcaagccttgttatctagctaattaaggatacattacacatttattataaccagtagcctattgacattgctaagtattcaaccatgaatataacttaggtctctcacggtccggttaatcttatcgcacgcaataaagaacaatttttcgggaacgcgtaaaaaaaaaacagttcggttcattactttaattactgcccctttcgtactaaaataaacaaacacatctcacggcgagcaccgactcactcaacccttttatcggcaaggcgctcctggtctgaactgatatgacagtgtgacactgacatactctagtaaacgcttgtttattttagtactgtccagaagaaacattataccattctcatgcaacatgtcaaatcatctagctgaaaaccatagcaaaacaggctttttactagtagaaatactagaaaccatcgtaaaattgcttcctggttatctgcaatggaaatccaggacttcttcagagctgcactccaatgaactgggagacactgacttgaatcaagtctggaggagtgcatatgcatatgcacgagagtcttacttgtatgatgtcactagtagctacgctttctaacttttaactgcagagaaatgtctctttcttttctaccttgtgttgtgtgattcaatgtagcatagatactagcacagaagcttcattttaggccgataattccttctctcgaagaattcagggctctttaacgttgtcaacgttcaggtcacaatcagcctcgcaagttcaggtctacagtcttgcaacctaaacaagctggttttcttcattctgattctggaagtaagaaaaacagagggcatacttgtcaagcctacccggatttaatgtgttggcaacttttttgacaagtcgacaagcacaattgcaacacctaaacaccttgcggtgatatagagtctctaaccacctcgatctagccaaagggccaaatcaagatgggttttgcaaaaagaaaagctaaaccggctagcggagccgatttagagatcaaaatcagcctctaggccgatttagatcgatatgaggataactacccgtcttgtgggcaaaacggaaggttttcaggacaaacctacaaagaggtgtcacactctcgcagcggcggcggatggtttacggcgcaaaccgataaagatggactaaaactagggtaaaatagaaaacatagtaaaagaacgattcaagtagattgtattcgggggttttacaatgaaccggccttatcctttaaataggggttggtcttaccctctacaggctcttctccacgtccaactcgggatagaaaccaaaggaaatacgaaacatgccttcccgagcaaggaaacccgagacccgatgaaaacagactcggactcggaccctgacggtctgactgcccacatatctgcggtcagaacggccctactagccggtcagaccgcccacacacctgtggtctgaccggtcctatgaaggaaacccgtcactttccaaactttgtcaatttttccctatttcgtccataggtgccaaatttgggtgtaaacataatgttcaacaataaaagacgataacatctgctttaacatctagggcgtgtttagttcacaccgaaattggaaatttgattgaaattggaacgatgtgatggaaaagttagaagtttgtgtacgtaggaaaattttgatatgatagaaaagttggaagtttgaagaaatattttggaactaaatagtagaggtgaaaacggtacggaaacggacagaaacgacctttatcgtttcgttttcatatttttttcggaattgaaatcggaatcggaaacccccggaaacaaaaacggaaacgaatattatcgaaaccgaaaacggagcgaaaacgaaccggcgcggatacggtaacaaaaatttatcggaatacacaaacccctcaaactgagggtcaaactttgtcaagtccaaatctcaagtctcaacattcaacaatacatcacaaaacacaaccatatcaaatccaattgtttctctcagcagtaccatcataaacacaatctatgcagtctgtaacttcatatttgcataacaaatattgcatggagttgcataacttcaacaagcaacaacagcaagtcagccatagtacatagttcatcacaaaacattgctgagaattacatagttcagcaatagtagaagtataaagtcagccactatataaacatatgttagtaaaacaagcacaaaccagggacaccaaggcacaaaaatttcgctccaggttctccattcaccagtcaccaccactccaccagtggggcttgagtcggcggcggtgacgaggacggcgcgagacggtggtgcccgggacgacgcaagacgtcgggggcggggacggggacggcgagcgactacacgagacgcggtggccgggacggcgcgagacgttgggggcggggatggcgagcaacggcggggtcgaggacggcgcgagacggcggtggcgactggcgaggacgaagcgtagggggcgatggccgggacggcgcgagacgagctgacggcggtggcacgagacggcgacggcgtgaggggacggcggccggcagcgccagatctggcgcgtggtgtcgctgccgccactgcaaatcctcacccggcggctgtgtctctcactctctcggctagttagtggccggctagacagtggagtagtacactagttactagtgtgttgcagtgttgggctgggctagtgactactgctagtactagtgtgttgggctggccggttggacacaggaggttttatggactttgtaatgtcggaaattccgagaaagttttcggaaagtttccgaccgattccgagtaccgtcgaaaactgctattattattttcgattccgttttcgaaaaattccgaaaaaattccgaccggctgattccgttttcgaaaaccagtccggaatccggaaatattccgtaccgttttcacccctactaaacagggccctagtaaaaccatctgaattgatatcaacttgtatctgcattggtgaatctatctgacactgacaagtttcaaagttcactgtcggtccagttctctgtctcactaaggctgtgtttagttggatccaatgtttggattttggttaaaattgaagatgatgtgattgaaaaattgtgtgtgtatgacatgttgatgtgatggaaaaagactgaaatttggattcaaactttggatctaaacacagcctaagatcatttacaatgcaagacgaggcgtgtggcaatgtagagccacgtaggcggagtgcatacgtggaagagaggaaggggtggggctcccatgacttgagctggttcgcgtagcctcgtttggctccgataacctcatcgaaagaaaccagcttttgtcagaagaatcgtgggaaaaacaagagaggaagggtagagactcgaaggaggaggacgaggcggcggcagcagggttcatcgccagagacggcgaggaagcggcggccagggcgtcggcgaggaaaccacgaccacggccatcctcacgccgcgccccgacgagccgcaccgttgtccacgtcgccgcagtgaaggatgagatggcgcaacaaaagctccggtacagagcaatttcagataataaatgcattcactaattaaaatatctacataactagtacataccaaaccaaattaatgccctatttggactgcaaaaaaaattcagatacagctattcaggccctgcaaaaatcagttcctagctgcatcccaaacaaggccgaaatgctctctgtttttgcaatttcaaaggggtactgtacataagtatatatcatccagtgttcatgagttcatctgcatctgatatgatgttcaggcatagggccattgtgcatgccattctgcattattggatgaggcctttcatcaccaccctgaaacccatcgtttccaactttttggacagcttgatcaggtgcagggttgctgtcaatgacaatatgaagtggccttgattcttcagtggcagtgctactagtactgcctccatgctccacatcatgaacatgagcttcgatcaattttacggtccttgagatgagaaagtatcttgaggtatctaaattttacagtaaaatttttggtatcttgagatactttggtacctagaggtatcaaattttgcactagaaaatataataactctaggtactttctcaaggatggtaaaattaccctactaattacacaaaaacttgttgaattcctccatggatgcaccgtgcacatctgaaaattttcagttgagtggtgtacagtaattcccagaagaaaaaagtgaggtgattagtactactggttgctaaatccatggggttacaccggctaatagttactgttgacagtacaaacatcaaaagtttaataacatgttaaatacattggtttctagcaaaatatatgttggttattttcaaagcatataggtttaggttaaaaaaagagtctagtcagttataactgctaaccaagttagtttcaaaaatcattagtaacttctatgaacgagggagtacatcctaactgctgagaaatttctctcttgctacgtagcttgtgtgatccgatgcgtcatagataattacgcagaaggttgattttgggtttgaaaattccttccctcgaagaattcagggttctgcacatttcgctatttagagctgtcaatgtttaggtctacaatcagtatatcttccaagcgaagcaacctgactttcttgcaagcagaaaagagtggacacacgtactgattccctgattcaggctgtgtttagttcacgcgaaaattgaaagtttggttgaaattggaacaatgtgacggaaaagtttgaagtttatgtgtgtagaaaagttttgatgtgatggaaaagttggaagttcgaagaaaaactttggatctaaacacggtgtcaaatgatcaacaagaaaagttagcattgcttcaacttatcacagcctgtatctgcattggggaatctcatctgacaagtcacaaagttcatcatcggttcatgtttttatctcagtaactggtaatttacacaatattttacatatttacatcgacgcaataaaaccgtcaaaacagaacaactctagatggtgaataaacccactaaaatatctactcctacataactatatccaaccaaattaaggccctaatttggattgcaaaaacattcagatacaactattcagaccctgcaaaatcaggaaaaattcccgggtcccaaaacaaagcccaaatgctatctgattttttgcaatttcaaaggggtactgtacataaccacgctgacacatatcatccagtgttcatctccatctgaggatgatgttcaggtaccgggccattgatgcaattctgcactggatgatgcctttcattgccaacacttgcctgcatcagttgggcatcctgacacccatcatttgcaacttcttggacagcttgatcaggttcagggttgctgtcaacaacaatctgaagtggtcttgattgttcagtggaactgctactagtactgcctccatgctccacatcatgaacacgagcttcctttgcgcatttggcgcaaattaccctattcacaacgcttatcaggagcatcagagcagagatgcagccactgatgatgaagaggccagagaaactttggagtgtgagagggtttgagtcactgctgctgctgctgctgctagggtttgcatcacctcctgtggactgttcagatgagccaaaccacttctcttcaatttttgaaccttcagtctctcctgtaaggttcaagatagctgtagagagatcatgcaccagtggagaacctagaggaaatacctgaatacaaaaacatgatgcaaactaattagacaaaaaagaacatattgaatttctccatgtaagcaccacacatctgaatgtttttcgagaacacgcaaaaactttgcgcgatatactaattgtcaaaaagaaaagaaaattgaagaattctgaatctaccaaagtgaacaagattgagaagcttacaaaaccaaatccgggggtcttgtagaatcgattaaccatctgaaattctttctgatattgggggttggataaaaaagaagttaaataagggatctcgtcgacgatcgccgacactcctccattcatggacccctttctcagagcttcagcatactccttttgtgttccataagaccttaacctggatggcatgaaccctcgttttttcaggagtgagccaacaaatgatccattttgatatccaacatagtcaccggtaaggaggagctgatccaagcttttcaccgatggtcggagcctctttgcagttagcatggatgacaagcttgccgtgtagctctgcactaggatcagcactacaaagcaccatatcaccacaacaatttttgacaaagggctcttgataatttgacctgtttgaacattgaaagaaaccaagtaaacctctaatgatgcaattacaaaggagcaattttatgatctttggtgaggtaccacaatttccggtatgaaataaccatacccttttatactaaaatactaaaaatatacctaaaggagaccaaaatttacactataaatgtcatacgtctcgttacctttttcaaagtaaaaaaagatctcgttataataactatgtgctttatttatgtttggaaaaaatgtacaacaagctgtactctctccattcatgaataactagcactattgactatacaactgtcttaccttgaccataaattatttttaaatgatcatattgtaatgaatgaaaagttatatggttatatttacgatgcaacacagtccgataatataactcgttttcaagtatttattaagacaagatcagcgatccaaataaaacatgaatactaccggcgtcaaatatttaggaactggaggagtaaaagtagtaactatattaccatgagaaaacgtcagggtggagaaagcaaagtaggaagcagtgctgagctgcctcacacttgatccttggtactccgggtttcttggctgctcaatcatccacacgacgaagccggtgtagaagaagaagccgatggtggcaagccagagatccctggtcagtggcttcacgaaaatccattggattggcttggagtcgttctcctccggcaccagcagcgacacaccggacgacgtgtatggcatcgtgaattccacgaggttttctcggtcggctgtgatggtcacgtcgcccactgctgcgctgaacttctgaagataccataagacagaagatgtatgtcagcgagaattcttagaaatgtcattcaaagggacttggcgtaaattattagtccctgtttgacaattggcacatatatatatttttttaaagctagctatttctagttccagaaatctttatacctaaatatgcgaatatatttatagcaattgaatgagtcattttgtttgtattttataaaaaaatatacaatttcaattcattataatttgactttacaaactctagttttaaactgatttgttttacaatttgtatgctcttatgttgaggctgcgatattatatgatacttcttaattagatttcccaaggaacatacggactttactaattattttctataaaattttcggtaaaattcctcaattacaaatgatatataatgcggttaaatctaatatctcccatataaaagtgaaaaatataaagtgctcttttcctggtaaattggttaagcttatgcctttgatttgttttagttttcttatatttaatataatcagccttgttaggaaaaaataaatgttttagaaacataaaactattgtttttactactatctcaattttaaattaattattgttttagttttgtcttaattccaaatatgtttatctttgaacatcaactgatttctgtaaaatcgtaataatttaccacacatgtgaattatatattatgaaagtattattcaagttaaatctggaaacataaaccttattgtgttaactatattagattttagatttttagaaatattgatagtcaaagaccaaagtttgacttaggactacaaaactagaatgaacaaataacttaaaatggagggagtatagataacataattttataatttttaataaggtaccctggagagctatcatattttttacatgtagtaccaaaaattttacagccccggcatatttgtaaacgaaaattaatttgtgaataaaactttttatatgtgtttttaacaatataaaaacaaaggctgaaaaataaacttcaatgaaaaaaccctaaaatcagttgcaaatttaaggttgagatttcaaattttagctgataaacataagcataagtgaaaagatgaggcccctcgtgtaaaatttaggtatctcaagttaatttcttaaggactaaaaaattcaactaaaaataaacaagttcgtgggagtaattaaggcttacccctgaagatacattgcgtacaagatcatcatacgatccgtcaaagacgtggaactcgtacttccggcgaggccgcactctagccatggcggcgttgaagacgtcgatgcagtatccggtgatgttctgcctcttggtgtccgggtcgattctcacgtcgacgaaagcctggaacccggtcttccgcggcacggcgatccgcagcacctcgcctgatgatgaccttctccccgccaatcgccggcggtcgagacgacgaccagtcggagcgccggcgttgtagcggcggccatggggcggcgagccggcggcgcgccgtgctgatgagaatatggcggtgaggatgccggtgagcgccgccctggctgaagtgtgatcggcgccgaacggcggcgccgtcgccgttgcatggtggggtggatgatgtgatgacggcggaggagcaccgccggagatggggaaggtgaggatggggacgcggtggtggcggcgaaggcgggcaaccacggccgtatccgcctccgtggtgacgatgatggcctgcacctgtgcgttcttgataaggtcttcggctgcatacacaaattaacacagcccatgcacatacctttcgcataagttacacccacaaataagttattaatcaaaatatatgtcgatcgagttagtagctagaaaagatgtaacgggatgtaagaggtaatttttaagatggtactctctccgtcccaagatataacaatttttagtcttcagaatttgtgccaaaatataacaattttttcactaacattttcttcccaaccaatcataaccctccaccgttcacttttctcatctacctccactactcattcaatcacaaacctctaccactcacttctacctactttcttaagaaccgtgtccaacactaaaacttcttatattctgagacagagggagtatcatgttctttagtgtaaaatttgatactttaacatattgtacatcgagatactaaggtttttgcatattttcttgagtactgtgaagtttctctctatatatgatcccttaatttaccaaaccaaaataaattctgaattaactacatagtagcataatactctctccgtttcattttaagtgcaaccatgagtttccgcgctcaactttgatcgtccgtctaatttaaattttttttataattagtatgtttgttgttatgagatgataaaacatgaatacttcctccgtcctaaaatataacaacttttagccttaggatttgtcctaaaatataataatttctccaccaacattatcttccaatcaatcacaacccttaacattcactttttccaactagttccactaattatccaatcacaaccatccaccacttacttttacctattttcttaataaccgtgtccaaccctaaaactccttacggagagattaatactttactcgtgacttatgtttttaaattttttcaaaaatttttcaattaaaacaaacgatcaaagttgagcatgaaaatcatggctgcacttagaatgggacggagggagtataagggcagtcccaacccataacactagatatagtttccataaacaccacatcatcaagaaactagtactagacactactcttccaatgcaaacaccactattccatacttcaatttaatgctacttatctcacatgatatcttggatgttgggtagaaaccatgtctcatacaagacatggtttccttctctttcctcatttattcacttgccacatcattttttatcctatgtgacaacttatttaatgctatggacatcatcctagttattgggttgggaatgccctaacataacagtttagaatttagttaggttccttaattagtacatgatgatattcatttatgtgcatcctttatgggagacatgtatgtactgtcaacatgaactttttttataaatgaagttttgtttcgacgcctgcaacgatgcgcttgctactacctcgctcacgttgcaaattttctttgactttacggtggttacacacgcgatttattccagtttggctgtcaccatctgccaacgcggttgtatatatgcagtttaattttctatggtgtactgatatactagtactaaattactactaattaattaacaagtgtgaggggacttgttgggttctgcagggcatattgtatttttggctaggccgtatctgtaaatttgtactgattctaatcacctttagttttatattttgaagagaaatatactactccagctatatatagttttttagaaacactggtttgcaaagaagtttcaatggttttgctgaattgatgtccaagagatgtattcctaagatgggattatatataccataatatatggtcccttatacttataatatactattctatcgctataactcttcaatgacaaaaaagaacttaagagacctggtacaactaattaacatatttgggtttttctacaaggtcgcaattttgaattttcattggtgtgcatgttatcttcaacttacaatcttacacacaagtgaaaaacatcgtgattgcgacattttattacttatttaatttgaaattttctccaaactcattactggttttagagacaaagcctgtgggtcatgatacttctggtcggttccacagtctatttatacacactactaaaaaatcgattttccgacatggcgatatgtgtttttttcccaggcgggcatcgccctcagagacaaaacggccgcctacgatattagcaatcggggccatgctagccgtccatctgcgaagattgttttttgcaggtgaaccatataagatgccgcctgcgaaaactatcttcgcaggcggaccgtatttttgtgacggtattttggcctataggctagctcttgagtctggtagtgactctattgtccgtttttctcactctaatatactgtttatttaagttagcttaatgcatgctatgtctgaaatttgaactacgaaatcaaaaacgaaaaaaagatgcaactattttaccggcgcgtgcagctgcagcaccatcgtctccacgcgagtccctcacccgcagctccaccaccgcggcggagcccggacgatgtcgccgccggtggaagtcctccaccgccatggaaatgccggcgaggctcctcctcccctcgccgctcgtcatgtccaccacgacgcccaccctcaccggcgccggcgacgccgccgccgccgcattccggagagcgagcagcgagaggaaagcagcagcaacagcgagcagacggcgacgctgcctgatccccatgcaatgcgacggcagattaattctcgcacacctttgatcgagtgataaattagttgctgtgtgtacgtgaaaatgcagtgattatatatacacatagctatatatagctgttacagcagtggagaaatttcgtcgaaattttcggtttcgagctgaataggatgacgtttcaccagttcattttcttttacatggggaaagaatgtgtgatggcgttttacaattgttttttacgctggagacatatcactagattttgttagtagttcgtattttgatcaagtcaaattgaatttatatacgtacgatcttatcgatctgttagaaaaaaagatatgataatgtttgcatataacgtagcaactaggggacctgatattatatacgtgttgcgttgcatgtgtgacagctgggaactagaggaaattaaattaaggttcctagtcgaacatttttttaaataatccatttcttggtgtttaatggaacattaactcctataaaacatgacatacacaaaaccacatgatcaacaacttttgaccttaagatcatgttagtaaaaaataacagccattggatctagaagttacttaattaggggtgtccgtgttcggtgttcctatgttgtgctacctgaggactgatgaggtcactgagacccaaaaatttttaatcttttgttgttttaacctatattaagcacattattagcttaaaattagaatattatatatatactatcatatgtataatatttttttgtttgccactctaattacttattatctatttaattcaatcattaattagtcatccttttatcccccgcgcttctagcaacatagtgcatataagcatattaatgcataaatagcactaccttttccatcgtaatctttcttcatacggctatgattttttttgggttaattctcagagtactaagtgcgctaactataatttagtttatatatttttcacaatagatccaaatttattagcatgggaatgatgaatggtaaatgtctttcctttctaacaacctaactcaactggagcaagcacctaaaaatatgccactccatctctccattaattattaaatttttaaagtttttagaaagagttccaagatgtacttaaatcatcgcaaatatcgatcccacacgtaatatataaatatattttgaactaatattttctattttaccaaaaagaagtttcgcagcaacgcacagattctcactggttatacttaatttgctcaaccacacccaagaacagtaccatgcatgttgcgtgagttcatgaaaggacggcaaattattttcaagaaagaagattttcaagaaagaagccagagggaactagctagcgtggaattcttacaaaatccctcatatataaatatgattatatttgtcctgatctgtggtcattgccttgcagcatcgctgtcattttcagaataacatacgacataatgtacaagaataaattactaaactataggatttaatgaccggacacaaacatttatttaccgacgaactgttagtattttctcccttgatgatagtatttcaaacccgccattctaaaaagtttccccgaaattgcccatatgcaagaggaatgttttgaatattctcaccacgtacgatttttataatagatccaatgtattgggtttttttacaaccaataagaaaatggattattgctctagctaacaatctgatccaagactccaagcaatttagtactataaaaacgaaagaaagaagttttttggaaatgtcaaataattggaagaactgttttatatactcttattctagttccgaaagggctgcaggaa

SEQ ID NO: 9478 - DNA, 1112 bp, Oryza sativa
atagttccatggtcaggtctatagacttgttcttgcagttctgattctgactttctgaccagtttgtgatgcccccaggtacatatatatagtaagaaaaatctgggtattgatcaatcctacagttaaaatttcaaggtatcattcatctggtaggctggaagcaaatcagtagttttttttatctgcagagaaataataatacaagagtagatatattttttggggggggggaaacaagagtatatatattgcctttggaaagtagaagtgacaattacatttttgttaaagaatatcaattgcaagtgataaaacataagacgtgatcagttactaaactatgcatagaactatctaatccaacacggcctgcggtgaagcatggctagttgctgaatgggaacatcccagactaatttctgcagcagattattggttaatacctacaataaatgaagagatggagcattcttgtttttatatttccagagcacgctcagcatgaccatgtaattcatactgtctgggtggaatttgtaggcacagggccattctgaattggtcgaggctcttcgccatcagcacgttcgacactcccatggatatcctgggaactgtcaattctgaacttcatggaggtgtatatcagccacaatgcaacccatgctgttctgtgcttgattagattcttcatgtgcattgtttcgaccacccacatcaggactttgcacatcagaatctctaatttgggtgtaattggcaagaattgacatggagaacctaatcatcagcatgagagttgagatacaccagtgatgataaaaagaccagagaaactccgcaaagtgagaggtgctgaatctgtgttgggaattgcattacttggagagacagcctctgcaccaaaccatttcgtttccatacgtgacccctcatccccacttgttacatccaacatggcagttgaaagattatgcaccagtggaaaaccaggaggaaacacctgaaggggaaccaaaaaagaaaaaaaacatgatcatgccagttaggccagaaaattttgtccagaatgtagcatagctcttaaaaggatgatgagtgaattcagt

SEQ ID NO: 9479 - DNA, 4140 bp, Oryza sativa
  unsure (1)..(4140): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttcaattgattcgactccactaagaacatgatagcatggcgacttgacaactcccatcggctgcttctagaactcggaagccgatagtgactttcagctgatgatgactttggacttaccaaatttcatcgttaacaggaagaaggcgtcgtagcagtcgagcggcgccttgccgtggataacggggagctcgtcgacggcgaagaagtggcagtcacggccgctggagcagtcggtgaagaggatgtcggggtcgccagagtggagcgtgacgcggaggctgagcccctcgtcgcgggccatgtcgacgacggctctataccccgcccaattgaacctatccagcgactccagctgcgctcaagtcgtccctcctgccgccgccgttgcagccgccgcgatgcgtctgcctgaacccgacccttgtcggcacaatcccggcattctcccggcggacaccgccgcacctcgctgcgtgcgttaccaacaccgagttcatggcacacctcgccggattgctcgtcggagacacgagagaggaaaggaaagtgaaggagaaaggtagagaagaggggaaagagagaaggtgctgagttggacaccctgacatgtggagcccacataggtcccacgctgactcagctgtcccatcggacaaaaccggggttaaaaccacggaaggacctaaagtgaacagttttgtaagttgagggatgtcatatatctggttttgcaattggaggacgattttgtaagtcgatgacaagttgagggaccttcggtgtactttttcctattatagatagccatagacccgaggctcgatggcccggcccaaggcacggcattttggcctagcccaagcacggcacggccttaccgccgagccgtgcctgggcttccccaccgacacactgggccggcccagcacgactaggccctgtacgagagtgtggggatgcataacagacttaatttcaaccatatgtagggcacgagggagcaaaaatagacgtattatataacaaggcccaaagaatagggacataaaatagacttattttagctacatatatgtcacagcccaaagaggagagaggagaaatagacttatttcaaagaaggcacgatggaccacccgtgccttcaggctagcactgcatggcccgattgctagtaggccatgcctaggccggaggtgcagcccatgggccagcacggcccaacacgaagtgccgactgagccgttccagcccgatcgctggtgggccgtgcctagcccgatcctaggccgggccgtgccgggcgagccttatggccatctatagattatatatgtgacgactatctgttgcaactaatatatactctgaaaatatacagagataataatgctactggataccttgctcacaaacgcatgaggagatttcagtgcagcagataacttgtcagactttacccactgatttgatttcagtatatcttgcacttgcagtggttcaattccatttttcccatcagactattgactgcagcacaagtagcagcacaggtgattataaatcacaaagcaatcctccattcctttcaactgctgaataatcaaaatttcacataaacatgtaccagagttaactacaaaatgaacagtgacgtactggcatctttagaattaagaaaccaattttctttagaaaatcaaagtctatgaaagaagatgaaaactgaggtcacgataatttccaaatatattttttaagatcaagatagaatatgaaaaagttgaaattaaccgtagtataacttagacttttttcagaaaaggaatatacaccgcatcacgtatcatcctctcttcctctggaaaagtcccgcacggttaacttattttgggacagaggaagcacacaagattaccattccttcttggtttccgctccaaccaaaaccaagaaagcatttgaaacgaattttaccattgcagtagacaacacataaattaagagtaagtttatagtagttactagtagtagtaaatggtacagttacttaagtgcaggagacaattacaacatgcggacaacgaaggtactacctctgtttcataacctctgtttcataatgtaagactttctagcattacctgtattcatatagatgtcaataaatctaaacatatatgtgtgcttagattcattagcatatatataaatgtggacaatgctagaaagtcttacattatgaaacggaggaagtatcatttttattatgctaaagtaaaattaggacgagacacaagttctcttaaagagagagacagaaaattattcaaaggatggggagtcagcccttaaattaatcagaaaactgccgtgatggtctcctcaccgcagctagacttgtgacatctcgatttgtgcttgatcaatccaatattctcatggtcaacattggcatgggtaaactctacaccagtcaggacagaaacattctggccactcaatccatcgccaaagtcaccagtgtgaaagaaccttgcaatgcagaacttggcagaccccaggttgacaagctgagggtcccgtatctgcttccatccttggatgagtgactcatcaagttcgttccagcagtggcgtatctgtggttgcaggtactcgtccatggcagagaggtcagcaacagcaaagtggccatcgttgggagtgaagccaaaccagagcttgagctcgtggacatactcaaacttgccttggaagggtagcatccacttgcccacttcaatccaagtgtgtttcacagtgtcaaagcaataagtaccaaccccgtcgatggatatgcagatctcagagccacctttaaccaaaccatatgagatgatctttagaaagtcaacgccacatttgacgacgtatggcggcggtggtgggaggagttggcagtcccaggactttgataagtagctggaacagaacatgcggtacaccaaagcctcgaacaaatagtcagcctcctgtggtttcgcaattctatccatgataaaaagagtaccgccaccgccgccatcaaggtcatccagatctatctcagcgccggggatgtagagggcaatgggttccaacttgggcttgtggagatttggcatcaccaccagacgggatgtgtctgcctccagaaggaggccacgccccgactggtccaaagagaaagccctgcgctccaaagcagggaacatgtgtatccgttcgcctggtgctcccaagttgaagattgggctgggaagacaaatcttctccatccttttcttcaatccgtttccgttcccattcagtgtcagtgcagcaggtgttgtagtgttgaacaacttgtagcgcgcgagggtgaggtcgatgcagcgcagcgatttggctccagggatgcggttgtccacgatcaggttcagaaaccgacgagagaggcccatcgtcgattggattgggattggatataatggtcagcttcaaaacagaaacaacaattaatctcgtcggtctccgtccccccccaaaaaaaaaaaaaaaagctatgctatgcacctggagaagtaaacgacattcaaggaaggaagagtaccgcaatagcagcagaagccggcgattctactcgatcccaagtcgactgaactctcctcctttgtctttccttgcgatcgattcagctaacagccgcccggcagcgatgcctttaaagacggaaggaagggatggcttcacaaaagccaaacaaacaagagaagaataacaaacaaaggcgatgagaaataggataataaattagcttttgatcaatgaaaagagggttaagatcaa

SEQ ID NO: 9480 - DNA, 6841 bp, Oryza sativa
aactttttgtaaaaaagtacaccgtgtagtagtttaaaaagcgtgctcggggcaaaacactgtagcgcgctgggaaagtgctgtgccgaacacagccgatatttcagaggagctctcgcgaaaggggctctgtttactgaggatcaatgggccgcttttcacaaaccttgacaaaaagggtcacaatgggccgctatttgggctgtctctgtaaaggggctgtatatgtataaacaatcgtaaaaagttcattttgactccctcaacgatcgcctgagtataatatcatgtcctccaaccacaaaaccgggtatatcgacccctccaactatcaaaaccgatggaaactatgtctctgggtggtttaggaagcgattttggctcacgtggcgcctacgtggcgttgttgacttggtctctatcccacgtgacatcgacatggcgcttttgtggcattataataaaacaaaaggcaaaaaagtacgtgggacccatctgtcattcacagaaaatattgtgggggtcattggcatgtgggtcatacatgtcctcatcttcctcctctcatcccttctctctccttaccatcgcgtgtcaccccgcaccgggatgacgctcctcattgtcaccttcgaatggccacgacggggtcgacatcgtcggcgccgagctgtctcctctgttggcggagtcacccaacgacagcttgaggacaagagagaaggaaacggtgaggccggagccaagtacgaaggcgaggaaaaagtggcagggagaggcagttggacccgcaggagacgtggagggaggggagtgtcggtgcggcggtggcgagcgaaggatggaggtcagtggggttgccagtggtgagggacggaggtcctgttgtatcgtctacttgaaatctcctgcacatcctctatcgccgcttaggccctcgctcaccctccacggtataaaagggacccctggggaggggtgaaaggcatccaattcaatcgccaacacacccaccatatattacgaagccggagtacgtggagccaactcgtcgggagatctcgtcaaatccctcgactacgatctcaccggtatcatctgattcgactactctctttgtaatctattctcatcatcataaatcccatataacctggactagggctattacctgataaggggcctgaactagtataatccttatcttttgtttgcttgatgtcggactacgcccttcaaccgaaaaactagatgcaatgggtccttcaactgtcaaaaccagtgcagatgaggtctctcggcagttttgacgtcggttttcgctgacgtggcgcatatgtcgctattttgactcgtcttcgcatcatgtgccattaatgtggcgcttacgtggcaattcatccagaaaaataataaacttcatgggacccacatgttagtttacacataaattaataaaaaaatggtggggcccacgtgggcccacatgtcatctaaaaaaataaagatggtacgacccacgtagaccccacatgtcattctcatcctcctcttcttcctcctctctctccccaactccctgtattcatttttctcccttctcctctgtcctctccaccgagcgaggagggaggcggcgcgcggcggccgggcgaggcggggcaaagtggagcggcggcggtaggccgcgtgcggcggaggtggccggaggaggaggtcgccggccacatgtgagcagacacagaatgaggagtgaatgagagaacagcgggacttggggaatcgggtcgacgggagatgccgatggagggcatcggcgccggcgcagcaagacggacgacgagaggcggcgtagggagctcgtccctcgcatcccggtgagggcgccgggccagcggaggtggagacgagctcggtacccctcggctgcgtcgtggcgggcggcggagtcgaggaggtggtcggcggcgagcgcaggtcgacggtcggccggtggagggtgcggaggagtcgagggcgccatggccggcggcagaaccacgagacgatggcggaggttggctagcggcttgctccaggtgccgtcggggctcggcgagcaagaccgtcggcgtgaagacgatgaacgggagctcgtgcccccggccaccacgcgtcgcctgcaaactcaccatgcctcctcctctcggaaatttcggatccgtgctatggccggggacggcgagcgcggtgcggtgatgccgtacttcgtgcccgtatcaagactcctcgcgccgcagtgcccccagcggaagaagctcgcggtggcgagaagggcggatcgtgatgtattctctgcgatagacctgtagagttggggagagaggaggaagaagagctggcatgtgggcccatcattttttattgagctggcatgtgggcccatcattttttatttatttatgtgaaactgagttggggagagagaggaggaagatgtgggcccatcattttttatttatttatgtcccgcttctcccaggccgggcacgcttacatctggcagctttcacacccaggaagaatttcccggtcggccacccatcctaaattgctccaggccaagcacgcttaacctggagttctttagaaatcggcttccggaaaagaagttgcaacttgttgatatgagtattctattaatcctattaagccctgggccgggatgtcacaatgctcacccccttaagacaccgacgtcctcgtcggtcaaccccaggccaggaacgtcccctcttagccacgtccgtgtgtcagtgccagtgcatgtgccatgctgtgtgaccactccgggtccacaccagccatgcgcacgtcggtcaaccccaggccaggaacgtcccctcttggccacgtccgtgtgtccagtgccagcgcatgtgccatgctttgtgaccactccgggtccacaccagccatgcgcaccatgcctgcgcaactgcgacaggagtgggtccacaccagccatgcgcacgtcggtcaaccccaggccaggaacgcacgtccgtgtgtccagtgccagcgcatgtgccatgctgtgtgaccactccaggtccacaccagacatgtgcaccatgcctgcgcaactgcgacacacgcgcctgtgaaaccgcgagagtcggctctgataccactttgtaacgtcccgcctctcccaggccgggcacgcttacatctggcagctttcacaggtcatagactgccctcacagaccaacacaagtcttttctgcacactttgtcactcttgcgcacccaggaataatttcccggtctgccacccatcccaaattgttccagaccaagcacgcttaacctggaattctttggaaatcggcttccggaaaagaagttgcaacttgttgatatgagtattctattaatcctattaagctctgggccgggatgtcacatgtgtgtcccatgaagtttattattttgaattgcaacgtaagcgccacgtcatgtgaagaccaagtcaaaatagccacccaggcaccacgtcagcgaaaactgccatcaaaacctccgaaggacctcatcggcattggttttgacagttgagggacgcgttgtatctggttttctggttgaaggacaaatatcggattcgttgacaagttaagggacctcgaatgaacttattccactcctcattgattcctcagcccagtagttgtaatggttgagcccaattgatattattttactgggtttagaggcccaaccatccataagtctacctctcgacggcttccgattaattgttcatttatgttccatcaattctcctctatttatgtgtgcttctcctgcatatatgttagtagcataggacatagtggaagtatatattttatttgaaaattatgcattgcaagcatagctagtcttcattaaatggacaatattaacggtcgaaattggtatgaccgtgccatcggcggatggccttgaagaagaagaccaccttgctagcgtagatggccgcggtgacgcacatgagcgcgacagaaagcgcaccagagcacctggttcaccttggtagtgatgtgaaggaatctcatcggcgttgacgtcgccactgtcttccacaggatctcctggctgctcatgccgaggcagataccgaacgccgacaccgggaacagagcaggaatggccacgttttgtccgacagaagcaccagctcctccgatgactgatgcgacacaacacacaccatgagctctctccagtgttccagcaaatcaaagcacatagatcgatgtgtagttccggaagaattagctcaagaaacttacccggagtttgtccagtttagggccctccagtgcggcgaagaagcgatcaacctgaggcatggacttgatgtggtggctgcggatggcatcgccgtcgcaaccgtcctcctcctcctcagggacctccgtccccggcgctagccagatgggtgagttgccgctcaagcttcccggaccacgtcttgaacgagtcgtagcgcctatcccgagacagagatgaattcatgtgctttgaaacttgaataaagcttataccttagtccagcagcagcactcctctcatcctctggctcaactccaagccaatttcatggtttaattttgggttcccgtcggctctaattgcctaatagcatggatttttttttaaaaaaaatgtaatacagataattgttcattctattgtgctaattttatactgctccacaaaataaaattcagaagtaaaattgtacatgaccaccaaaaacactatggatatcatcaatcagtaactcccctaatctcaccatttttctcatgatttttttttctatctgactgtcttacacgtctccgtttactgttctctgctcctcggcctaacttgcatgtttatgcgttgccggtgcgccggttgcctgcttaattaggccggttgattggtaattagttcatgcatttggggtttggatgccggtcactgtgatggttgtttccggttgggtggcgcgttgaatggcgcgtggcatgctgccatttcttgttttggtccacttgtatgttatttcagatcggtctatctgttctgcactctgtgcctttgtgattttctgtttaggcccttaacttttttgtaaattgaatgtgaagaaggcaaattactttactagccaaatgatttagaggaagactggtgcttggtcaagttcaagaatcaaaacaaggttacagtaatacttcaggacatgagaatccattgcaaaaaaaaccttaccaaattttggtaatgccaaattttggcaattatgccaaaattttgataagatttcttatatagttatcaaattttggcagcaaactaaatgtagccacttttttggcaattttatcaaaatttggtaaggttggaaatggcatcaaagtgaacaggccctgtataaacttccgataatttggtcatcacgccacgtcgccacacaagccagctcgctccaagcatggcgatcgttgagtcatcgacggggccggccgtcgccgtcgccgccgcggtggttctggacttctggtggtcttgacgtggctgtggacggcgctggtgcagctggtgtggaggccgtacgccgtggcgagggcgttcggccggcagggggatccgcgggccggcgtaccggctcttcgtcggcagcgacgccgaggcgaacgcgatgcgcgcggcgacgtgctcgacctgcgctgccacgacatcgtcccgcgcgtgctgccgcactaccgcgcgtggatgtggcgctacggcaaggtgttcgtctcgtggagcggcgccacgcccgcgctctgcgtcggcgactaagccatggtgaagcagatcctgtccgaccggacggggctgtacggcaaaccggagcccgggccgagctttctggcgctgatcggcaacggcctcgccttcgtcaacggcgacgactgggtgcggcaccgccgcgtcgtgcacccggcgttcgccatggacaagctcaagatgatggccaagacgatggcggagtgcgcgcgggaggtgattcgggcgtgggaggcgcgtgccgccgccggcgagcggcgggtgcaggtggaggtcgggcagaagttccaggagctgaccgccgacgtgatctcgcatacggcgttcggcagcacactagtggagaaagtgtttttcctcccggttggtaacccccctatactcccggttttgcaaccgggagtagcaatctgggactaaagatactcatctttagtcccgggtgaaataaccgggactaaaaatctatctttactcccggttggtgataacaaccgggattaaagatagtgatgccagcgctagtaccggccactgttttttttattattttctcccaaatcgagttggaactgcacaaatctcttccaaatcaaccaaatcaagttgctccctgtatccccaaatcaaaatcaaagtatcatcacaaacatagattcacatcacaaattctcaagaaacaatacatcaagaaatacatcacagattatacatcacatatccaatgaatcacaacttctaaaaattctcagatccatcacaaattcttaagaaaaaaaaattgagttgccgccggccggctgccgcgcgccacgccgctgccctcccatccgcgcggcccgccggctccagccgccctcccattcgccgccgcccgtcctccctccgcgcggcccgacgcgccagccgccgccgccgcccggactcggtcaccggctgcccgccagcgcgggtacgccgcc

SEQ ID NO: 9481 - DNA, 1913 bp, Oryza sativa
cctggttggtgttaccaaccgggactacagatcaaaaagtttttaaccgggactaaaaatgatctttagtcccggtttaaataggaaccgggactattgtggattttagacgaccgaccaaagatggtttctctagtagtgtgcgcagctacagggaagggaaggaggtgttcgtcgcgcagcgcgagctccagtccatcgccttctccaccatatacagcatccgcttcccgggcagcgagtgcatcgcgacgaagacgaacctgcgccggcgacatctcgccaagaaggtgagaggcacgctcaggcgatcatacgcgagcgcgccaggccgccgccgccgccaaggaggacagcggatatggcaacgacctcctcggccgaatgctggaggccaacgcggcggtcggcggcggcggcggcgagaagagcctactagaaaaaatatttttgcaggcgaccaaaagtagtttttccaggcggggggaaggaccgcctctataccaacaactgtgacggcacaatcgtccgcctgcgaaaatgcactggatgaacaaaaaaaattggcgccccgccggccctgcgcctcgcctcgccgccgccgccgccgccctccccttgtcggagtgtaacatcctgaaaattcccgacaataaaaaacactaaaattttgaactttttaaaacttttgcatcatgctggttgttatggttactattgcttgccaaactataaactgtcacaatggaaaattaaactaaagctatacaactaagtaataattataataataatatatttatcatgaaccctataaatatttacgcacaagaaatcaaagtcagacaaaagaagtaatttaatttatggattaaatattaaatacttgaaccatgcgatgagtgtcatgatatctgtatacacatgaaatgatatccattcaaataagtcgagctctatctataaaatagttttactgggaataatcaattcgatattacataatttgtattgaatcacaaatattgaattgtagaaatccatgttgtggtaaaaccaatctaaaaagataaaccaatatgtgtgaaaacagataaataccaaaatcccaaaatataggaaattataaaaatctaggataatattaaatattggacaatattaaatttggagaaaattcacatttgaacacttaatattgtcactcaaatacttttgattaaatacacatttaattggcaaaatttcctcaaattataaattaagcaaaaccctaaaagaatggaaaatggagaaattagaaaagtatataataaaaataaaaatatgtgctatattaaattttaataacttaaacatggtgtattttacattgtgacaaaaatggtggcaatagtatatttttcctaatggcaaaataccctctaaaataaaaaaaatagtcggctagcactgttcattagcccctaggtgttcgatttggatccttgccaccctagccctcttcctccccactgctgcgacgccctagctggccttgagccccaagccgccatcgccatccatcgccgtcgacgtatcgtcgccgcgcgcctcttccggccgcccctcgcgccccgcgccgcctcgcgccgtcttgtcgtcgtcgtcgtcgccctgccgcgccgcttactgtcgctgtcgccctgcgcgctccgctgccacgcctcctagcgtccctttccgccacacgccgtcgtgtcaccgtcgccgtcgctctgctgtgcgccgcgcgccgtcgccatcgccactgccgcgccgctgccataccgcctcgcgccccgtgccactgcagcgccgagccccatgccgagctgcatcgagtcccgccccacgccgccgcgccgcgtcgccgttgtcattaagcactgccc

SEQ ID NO: 9482 - DNA, 16867 bp, Oryza sativa
aaagagaggatagagtggcccacctgtcagtcgtagtaagttaataattaggttggaataaaaataaaactattaggaacagtgccatttcgcaattagttgaattaggaactttgaactagcataactcactcattttaactcagattatagtgaaacttgaacctaaattcatctaaaatcataagctttccaatggtatataattcactatttaataaagtatatatatatttataaaataattaatatcaaaagattagattattggtcaacttaaaaatatgctagtaaataggattgatattgtaaagtagagtagatgtaataatattggtctttaacatgttttgtcactgtagcaaccacataaataattataatcaatgtttcaaattaatggatgtataggaaaataatagtgccatttattaatctatgtccaaatataattaaacccatgaattatcagttatttaaataaagttagccttataattaggtaaatcaaacatgaatacacatagatgagtctttaatttgtttatgaggaataggaacagagttgttatgatagaaccacccaaataaggttgagttggttagcatccaataattactcaaacaggaaaatcacttgtcaacccacttaaatcacatatactgtacaatccatttaaaatcatacataagaacaataatctaccttttgcatatattaaaccaaggagtctatgacaaacatttgtagtggataaatactaattatagtggataaatactaattatagatcttgacctaatataatctaagttcaattgtaaattaggattattcattgtaaatctacgtgatgggataatctgtaaccataatatgattaacctaaacaactctaacatacaaagcatggataattgttaaccttttataatttattgtgataaataaaatatgttaacaattaaagtaaagcctccatcaataaaacaataatacaaatgattcactgtacttatttgattgatcctaaatccatctgacaacaaaacctctagtatatgaccattttatttagatagatgcatgtgtagccataatctttccaaagtcattagctagactaaaccacatattagccagaggtatatctcatttatacactattggttactcctaaatagaccacgatgacaacataaagattaagaaactttagtccttatcacgattggaatcccttagcaagcacgaatagtatgagcaaccctaggttcgaccccaacaagtacattttgttgtgcataattgattggtgtttgaatattggtttttcttgcatattatagaaattgtatatcggttaatcgtgagacaacgtatgcagcttctaggaggagaaggttgatcaagaattatatcaagaataaggactatcctgagcaagcaagtcatcactattccttgaacatgttgatccaattgcgaaattattttgtctataaataaaattgcatgcaatgatgaacatcctacatgtgattatgccatgccttgattattgtttaccccttattccttcgtaaccatgtttacgtatgaagtccctagtcaattatgataaatgcttagaaatgctattctagaatcatgcatacttatatttatcaaatgctatatgcttaggtaattacctttgggaaggtaattgagatgcggcatataaagacatgagcgccacattgccatgatattgatgacatgatttgtaaaagatgaaataaaactaaacaactgttttcaactgggcggacggaggatttgggtggtatctggaaaaggctactaccgtccccgtcaattaaggatcaagccatgaagttaagcatgaaacgacccccgtataaccgtacctcttgaatgggtataggcctagcggattagatagccgagcggaggcagtatccctgcatagatggttcacccctaagtgaggcagatgcgctacggtggggcagccgttgaggtagggccgcgaggtgtgccctacatcggtgtcgccattggtaggactgccatgagagtgtgagagagaacttaacgtgtgtgtgagacttcttccccgggagcgccagaactcctctcactgctagaaatatagacgcctagagtgcatgaggatgtaagttcatggagcgggtactgccaatgcgaggttatcgaaaagttttgccgtgacgcgtctcatgtgttgggacgagactcatgtgttgggcagtcgcggagtgcgggtaaagtgtacatccaatgcagtgtgagtaaaacaaatctattcgaatagccgtgctcgtggttattgagcaccaggacgtgtattacacttggctagactctaaattcttaacttgtgtgggatggttttgtgtggttttatgtatgtcttgttttatatgagttaatttccgttaaataccaacaatataggaaaatgggttatttaaaaaaaattgttcgactaggaaccttaatttaatttcctctagttcccagctgtcacccgtgcaacgcaacacgcatataatatcaggtcccctagttgctacgttatgcaaacattgtcatatcattttagtaacagataagatcgtacgtatatatatatataaattcaatctgacttgatcgaaatacgaagaactaataaaatctagtgatatgtctccagcgaaaaaaacaattgtaaaacgccatcatacattctttccccatgtaaaagaaaatgaaccggtgaaacgttgggtctgtttggtacagctccaactcagtcaaacagtttcagctccatcaaaattggaagtgaagctgagtggagctttctcaccaaataaactagagttatagagctgggtttaggtaactttacaactccacttcagacctaactcctatagctaaatttaggagttggagctataccaaccaagcccgtcatcgtgttcagctcgaaaccgaaaatttcgacgaaatttctccactgctgtaacagctatagctcaatgtcagtgtgtgtgtatatatataatcactgcattttcacgcacacaccaactaatttatcactcaaaggtgtgcgagaattaatctgccgttgcattgcatggggatctgccgtcccataaaggatgcacataaatgaatctcatcatgtactacctccgttccaaattagtagtttcttgtaatgtttaaccactcgtcttattttaaaaattagtgcatatataaaaatgtagaagtcatactttaaagtactttaaattacaaacaaaataaataataattctataaatttttgaataagacgaaagataaaaagttacaaacaaaaactaaaagcgacaagtattctgggacagagatagtactaattaagggacctaattaaattccaaactgttatgttatattatgctactatgtagttaattcaaaatttaatttgatcatgtaaattaaggtatcatatatatagagaaatttcacaaaactcaataaaatataccaaaactttacactgatatctcgtgataccagtatctgaatgtatataccaaattttacgctagaaaatatataataccgtcttaagaattacctcttacatcccgttacctcttctctagctactaactcgatctctactttgattaacttatttgtgggtgattaacttatgctagaggtacgtgcatgggttgtgttaatttgtgtatgcagccgaagaccttatcaagaacgcacaggtgcaggccatcatcgtcaccacggaagcgcatacggccgtggttgcccgccttcgccgccgccaccgcgtccccatcctcgccttccccatctccggcggctctcctccgccgtcacatcatccaccccaccatgcaacggcgacggcgccgccgttcggcgccgatcacacttcagccaaggcggcgctcaccggcatcctcaccgccatattctcatcagcacggcgcgcaggcggctcgccgccccatggccgccgctacaacgccggcgctccgactggtcgtcgtctcgaccgccggcgattggcggggagaaggtcatcatcgtcatcgtcatcaggcgaggttctgaggatcgccgtgccgcggaagaccgggttccaggctttcgtcgacgtgagaataacccggacaccaagagacagaacatcaccggatactgcatcgacgtcttcaacgccgccatggccagagtacggcctcgccggaagtatgtgttccacgcctttgacggatcgtatgatatgatgatcttgtacgcaatgtatcttcaggggtaagccttgattactcccacaaacttgtttatttttagttgaattttttagtccttaagaaattaactcgagatacctaaattttacacgaggggcctcatcttttcacttgtgcttatatttatcagctaaaatttgaaatttcaacattaaatttagaactgattttggtgtttcttcattgaagtttatttttcagcctttgtttttagatcattaaaaacacatataaaaaagttttattcacaaattatttttcgtttataaatatgccggggctgtaaattttttggtactacatgtaaaaaatatgatagctctccagggtaccttattaaaaattatattatctatactccctccattttaagttatttgttcattctagttttgtagtcctaagtcaaactttggtctttgactatcaatatttctaaaaatctaaaaactaatatagttaacacaataaggtttatgtttccagatttaacttgaataatattttcataatatataattcacatgtgtcggtgatatgggaccgggagtattgcgcccggaggcttgaggcagatggaatcgcccacgtggcctggcaccttcggggacgtcgggcccgagggtgaggtgtccgccctcctcctgatttccccgagggggggtcgggttgctcctgccccgaccccgagggccgaggtgccccgaccccctgtggggtttgcactatgtacataggttgggtgaacacggtagggctcacctaaccgcatttattgcggtctggtcaagcgtgtcacgttgcatgcagcgcaatgcagcgcgctcttttatccggtctgtgaccagtcacagaccggtcggatcaacggttaggtggcgactggtggtctgacgcacgcctcgccccgtcccgtcaagacgagagcctttaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctccgtcatctggcgcgccaggtagggggctcagcgtgtgttttctgagctctcatactcttccgtgtgggccaagtttcccttgttcagcctaatggccgagcaagcaaaggcgcatgacctctctccgagtgtgagcggcgacgacggggagccaaacccgcgccatcgagctcgtactcccccacctcctccgcgccaaagtcccaagcggggggaggcgctcgagagagtcgaaaaatccgcagcatcgccagtcgcgggtggtgcaggagaacggcgagatggggagcgtcgcctcctcgtctacggcgacggcagcacgccccagggagtgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccactaccaggacctccggcgccgccaccaccggctctgtgtcatcaaggcggagggcgcggcgagcggcggctgctgcacgccattcggctaccactccctcgtcggcgcctccgactcgggaggatcagcatgaagagccggatgcccgcctcgacatcgagcgccgatgtagtgatcggcgtgctccccgcgcaacggagggtgcctcttcgtccagggtgtcacctcgacatggacgtgagggccagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccacccgcgtcggtccactcctgggaggatctgtgccagcagtttaccatgaattttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagagctttttcagctcgcggaccgagtggctcgtaaggaggaggcctggacctggaacccctctggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacatgaggcaggaacgccgtgagggcaagtccgcggcagttccctccggtaaacggcgaagtgaggccagacagaaggcccccgccgttgacatcgatgacggtgatgatgacctaggtttccaagaacctggggccaccattgccactgtcgacgggggagcgtgtgctcacgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttcccccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcctgcatggagcagcgcgcggaccacctcgctgctgcgaccaagcccgagggtggtgacgagaggcttggcacctccgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgctgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttatacatcaatgcccttcgggttaaagaatgcaggtcctacttttcaacgaactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgctcggggccgtttacttggacggaggaggctgaacatgccctcactcagttaaaggcatatctcagctctcccccggttctagtcgccccggagccaaatgagcccctgctactttacttagcggcgaccccccaagtagttagtgcagcgttggttgtggagcgcgatgaaaacaatcctcatttcgtgcacccccatcctgtgctaacttggcccgggagcgagcggggaggagaagcccccgagtcggacggtggcctacggcccctgacgaccggagtcggccctctgcccgcttgtcagacggtgctaggtgcccccgaccctcaggagggccccaaggccactgcgggaaggccgcacttaacgccctctgaccccgaggctaaccctgtgctgactcgacccgagaaagagcagggagaagaggcccccgagtcgaacggaggccagaggcccctgacgaccggagttggccctttgcccgcttgtccgacgatgccaggagcccccgacccccaggacggccccgaggccactgagggaaggccgcccctttcatcctccgaccccgaggtcatcggcacagaagacaagtgcaccccgaaaggccacttgaacgaagaacgccccggggatacggcccctagcagagaggatcggccccaccgaaaggtgcagtggcctgtctactttgttagtgaggccctccgggacgctaagacccgataccctcaggcccagaagatgctttacgctattctgatggcctcgaggaaactgcgccattattttcaggcacatagggtcactgtggttacgtcttaccccctcggtcaaatcttgcataatcgagagggtacaggacgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagctgcctcacaccacctactgggtgatgcagttcgatggttctctgtccctccagggtgccggtgcgggggtcacgttgacctccccgacaggagacgtccttagatatctggtccgccttgactttcgagcgaccaataatatggcagagtatgagggactccttgccggactcagggtggcagccggactggggatccgccgtctcctggtgttaggcgattcccagctggtcgttaaccaggtctgtaaggagtaccggtgctccgacccgcaaatggacgcctatgtacgccaagtgcggcgtatggagcgccattttgacggaatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccgacccccgaggcccgtcggagtccaggcctcgggacccgaagggagcgctccaagctctcttagattgatcgcttggatctctgagatccaaacatacctcacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccaagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggccgggctccgtacggctggccacgggcgacggcactgagctgccgaacccgtggaacatcgaacaccttcgtcgcttctacccctgagggggggggtcgggtgtcaggtttcgggctcgggctaaccacgcacccccctcgggtgtgcagggttagccgggggctaccacacatgcacaaccttacttttcttatttcagcatttcaataaaagcagtttcaatttcctaaaggttgtgtctgtgccgtttttccttctaaagaatcttaacttgaaataaggtcactcgtgctcaaccttgccctcgggggctcggttcggtcagctaaaatcgccaagcggggcccaaaaccgagccgtgccccggggcgtggtgaactccgggggggaatcggcaaaaacccacaatcgggtcacccataaccctcggtcaccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcataacaaaacaaagttaacatagaaatttttcatcatttttgattgcagattaagttgatctatacaaaaagaagaaagaaaaagaaaaaattggagattggcgggggcctgggggctcattccaatgcgcccgggtcgctggccccgtcgccaccgtcgtcctcgccgctggcgtcgccctcctcgtcggagctgggggcgaacgcgagccgaggggccgacccctcgaagctttggacgatgtggttggcggcatcccggacccgcgcgcgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcgaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgtccgcgacgttgagttcggcagctgcgaggcgggcgactaagtcgctttcgcccgtagccgccccgccgctgcgcttcctcgcatccagctccttttctcgcgtctcgaggttagcagcctgctgctccagcgcggctctctcggcgcggatgcattccagattgcggcgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcccggatagcggcggcggcctcgcggtccgccaagctggtctccacggcgccggcatgatcctccagcgccatggcacgggcttcaagggcctcttcgcgccgccgggacgccgcttcagcctccgttgctcgctgctctcgggcagcggcggcgtcgaggaccccctgggcggcgtcgagctttttctttagctccgcctcccagctcccgtgttgaaggcggagggagtcctgcgcctcaatcatcgcggtggtggcgacgagggcggcctctcgctcctcctccacctctcgggcgatctccgccagcgccgccttgcgggcttcaagctccgagatgtggcggcggtgggccttacggcccacctccaccatggcgtccaccgagcgccgcccctcctcgacgcgcgcccatgcggcctcgagctccgctcgttccgctcgcaaggcctccactgggcgctgaatccatctagcaccgcggtgtttgcggcggccaaggcttgcagaaggggctcggcactcagcggggtggcagaagacgaggagaagagccgccttggagaaaatgcgacgcggctcggcccgccagaagacgcactgagctcggggatgtcccccggacccgtttggtcctgggcgtcgcccgagggagcgggcccaggcgatgcgcccgcggccctgtcgcaagccgccccggaggttgtcgcctgagcgtcacccgagggagtgggcccgagcgacgcgccggcggtcttgtcgtaaaccgcctcggaagacgccatgcctctgcctggcgagcccgggcggtttcctcccgggtggcttcttcagcctgacgagcccgggcggcctcctcccgagcggctttttcagcttggcgagcccgggcggcctcctcccgaacggtatcctccgcctgccgaacccgagcggcctcccgggcggcctcttcagcttcccgaaggcgatctgcggcctctcgccggtcagattctcgcctccgttcctctgcggccgccggatcttcggcctcggattggccggacttgggatggcgggagggacgcgacgggacatcgctgaagcagaagaaaaaaccagaaggcaaacaagatgggtaaggtaaaacttgcttttgggatagaagaaaagacggtcgcaaagagagcgggacgaacctgcgagggggtcggttaaatgaccaccttggaggggaaattaggtttccctgggatggttctgtctcccccatcttgcgcagccgtttcttcttgcgctccccctcgggctgcgatgttggcgcggccccctccgggcgcctgctgctggcacgcgccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgccatggcccttaggagcctgctcctctgaggccccgaccgccgtcataatggtcaagatggagacgcgatctgggtcgctgcagagggggaggataccgtgggggatgagggacgcctccacggagttgagatttagcacccgttggatcagtatcttgaagtcctcgggggcccaatcccatctgaccccctggtgggtccgcatatagtcttcgggcccgatgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcaccgggggctggctcggaagtcggagatgcgcttcgtcggcgaggggggtgtagaaccagtcgctcttccagtcatcccactttttgcggaggacgcaggggatgtagcggttcaacaccggcccccgcggcaggaaatagcagccgccgaccaccgacggcggcgacaccgactgcacggtgaagaaccaccggaacagccgaagagatgggcgcaccccaatgaacatctcgcacaggtgcgcgaagatggccaaagtcatcactgcgttgggggtgaggtgcgccatctggagatcgtagaactccagaacatccataaagaaagaagaaaaaggaggaaccaacccggccattgcgaaggggagaaagaagacggaccgccccgggtagtctggcgccgggcgtccctcacccagcattactatctcacggccggtggcggattccggcatgaagcggcgcggcagcccagcctgcctctcgctcacaatgcgggaaggcggtagtacgctaccgtcgagcagagcggagccccgtgccatgtcgtcggagaaagagagggttgagaacgagtgtgtgtggcgaaggtgaggcgcagcaaagagagagttaggggcgcaaacggcgaaggaaaggggaatagtggcgaaaaggaagggagcaagtcctttcctcgatagctttatacccttgccatcgctgagcccggctcctcgtttctcgtgcccactatctcgctccctcgttactcgctatctcgctccctcgtttctcgcgcccacgcttccactaaattccattcgcccgcttacggcgcataaggtagatatgcggttgtggcagtcgagatagatcgtatcgtgtgtgcgttaattacgctcgctgaccgaagcgacgttaccatatctccagacgaaacgaatctacacgcccagattcgagcgctgctcaagtgatgtggcagtcttgaagagaccgcccatgactgacggccaagacaccgttaccgatatgcgtggtttgagaccgttgggtttctgcccaatcacggagaccggtcccacctgtcaccaggctttatgagtggcgtcatgcccgaccgcttcccttgagaaggatgattgccctgacataacgccgggggctactgtcggtgatatgggaccgggagtattgcgcccggaggcttgaggcagatggaatcgcccacgtggcctggcaccttcggggacgtcgggcccgagggtgaggtgtccgtcctcctcctgatttccccgagggggggtcggg

SEQ ID NO: 9483 - DNA, 1088 bp, Oryza sativa
gtcgcgtcagcaacagacagccacgatcccacgttgcgcctgtctccgccgggagtggaggtaggtgtgggttgtcccatcgaaatgtcattcggacggcaaccataccaatctccgtccataaagagaagaaaagtccagtttggaaaggaaagggtacatgtggtatccccttaagatataaaaggaggaccatgcccacaaagagagggggctggattttcccgagagaggagagggctggttgattttttgtaacttgctcttacacagatccaccaaaaacacaggagtagggtattacgcttcccagcggcccgaacctgtatacatcgtccgtgtctcgcgtttcttcctggcacgcgatctttccacacacagcgagagcttgagatctcaccctaagcccccggccgaactggcaaaggggggcctgcgcggtctcccggtgaggagccccgagctctgtcaacatgtgtggtaaattattacgattttccataaattagttgatgttcaaagataaacatatttggacttaagacaaaactaaaacaataattaatttaaaattgagatagtagtaaaaaatactttttatgtttcgaaaacatttgttttttcctaacaaggctgattatattaaatataagaaaactaaaacaaatcaaaggcataagcttcaccaatttaccacgaaaagagcactttatatttttcacttttatatgggagatatcagatttagcagtgttatatatcatttggaattgaggaattttaccgaaaattttatataaaataattagtaaagtccgtatgttccttgggaaatctaagtaagaagtatcgtataatatcgcagcctcaaaataagaccataaaaatgtaaaacaaatcagtttaaaactagagtttgtaaagttaaattataatgaattgaaattgtatattttttataaaacacaaacagaataactcattcaattgctacaaatacattggcatatttagatataaagatttctggaactagaaatagctagtttttttaaacaaattatatttgtgtcaattgtcaaaaaggg

SEQ ID NO: 9484 - DNA, 5581 bp, Oryza sativa
agacaactcagaagggcaaatacatcttttttacctgaaagttaacggtcaacagacgggagtgacatgggagggtgcacaaatttggaccaatgccatatagggaaatagccaattttcagtgacatataaaggatcaaaccaattttcagtgacatataagggattctctctatcataagttatatgatatataccttatgtatcatgctaacgttaatatagtaggtacgcacctatatgcatgatatcccataacaagtttgctattccctccatttcatattaatataagtcgttttttaatataatgaaactcttttaagtcaaaatttttaaaagctagtttaatcaactttataaaaaaataatagcaacacttatagcactaaattagtttcattatatttaacactaaacatattttgatatttttttaaaatattgttgtattttttttataaatttagttaaacctaataaagtgtcactaagaaagagcctgtgttcttcaactttctctacctatctgatctcactatctaaaaaacatatgtctagctagtgtgctagtatatatctacctttcttctattatatttatagtcgtatatccatttatccaactatattagtacttcttttggtttgtttcacattataagtcgttttgatttttttccctattcaaacttcttaagtttcactatatttatagaaaaaaaattaacaatatctatacaacattaaattagtttcattaaaactaatatttaacatatttcaataacatgtttattttatgttaaaaatattgctatattttctttggcaaaattggttctatagcatcgaaagattgcgattttggttttatagcatcagaaatcaccgattcactttattagcaccgaaagttcgctccattagtgcatatagcatttctgtcatacttgaggctaacttctgttaaactgacgacgacggtgccccttcgtctcgggtgtctcggtcaggctgagacaaatcagttcatgcccccttcatcttctccacagaaatcacaagccatgatgcctctcattctaaatttctatcccaagcggcaacaagatgcgcagcttcaggccccctcgactgctgcttgctgagcagggagcatatcaggagttcaggactagagaaatactagtactagttactcttacgatctacacatgcacataaaaaaaattgattcaattgggttgtgatcggagtcaatctagccagaggtcttcttgttgttgtcgttggcccagatgaccagaccacatacacatcattcgagcgtgtctgttctataccactgccgccggcggattgctcgatgacagatttaaggggacggcgatattccaggcagctacacgggaaatttaaggtgtgataatgtgattggtggctgttaggggcgggaccgtgtggaatagctcaaggagtcgacggcggcgttggctgctccagcacgagggcatggcagcgacggcggggccgccggcggtcgagtggaagattgacggaagcagacaggcatccctgtgcagtaacggaagcccgatggaaatgctatatacactaacggagcaaacttttagtgctcccaaagtgaacttgtgactttcaatgctataaaaccaaaatcgcaatctttcgatgctatagaaccaattttcccttttttttataacacgatcaaactaactttaaaaagttgaaaaaaaaatcaaaacgactaatatgaaagagggagtaattttgattcttgaaattattaataaaataaaatggttttgtccttaatacttcaaacaaatgtatgtgcaaattatataataaaaaaagatgagttatgaattagttttaacacggcgaaacaccacaaatatggcggtggaatcgttcgttcttgacttcacctaccaagatttgcccgaaagttagaaattctcatattaattgagaaaattacaataaaatgtaagtcgtcaaatcatggtaagacgaaattataactaagtattgatagcaatgccatatacaaagtacagttgtatatctctactctcttcttaaattcggactcgtcctcctttcatcctctcgttgtaacacgcaacgtgttcaaacgtgaaatataatcacttttcctccttgtaattcacatgcattggtatcgtttcaaaatccatgaatttttggagccattaaagtatacccctggtcttaaaaaagacaattgatttggtatcatctacgacatacgacatatttgggctatgtttagttcaacgcgaagtttggattttggttgaaattggagatgatgtgactgaaaagttgtgagtgtatgacagattgatgtgatggaaaaggactgaagttcagccttggatataagtttatctaggaagtatcaaatcccatctagattatttttttttagggagtactagactcttaaaatctgaataaggaaggatctagcttatccaaaaaggccggaaattttaggagaaagacaaggcagcccatatttttagggcggaggtagagtaacatgtcgatctcgtcgctcatcgcaccaggtgtagccgccgccaaaatcccccctctccccttcgcgacccaggccgcaggcccctcgcgccgtcgcgcggctcgccgccgcccttggggcagcagcccgcctcctctactcatgggtcacgtacgccctccctccccgtcctcctcccccgggccccggtgctgcactggtcggcatcgtcctccgccgcccccaaatcgctctcaccgccaacggtgagtgccgtcatgggccacctttttcttctgcttttttttttcataagattacacagcaccccgcgaatacgtccgctaaaatatgggctaagagacgaaaaccaacggcacattcataatatcactgaaatcctgttgaatgtttacctacatgtgtctaatatttatgggcaccagaatttgaaccctggtgggtggagtcatgcaagtcatgcacccacgactccaccaccacacccttggtgcttcctggatcgcagtggtgaagccaccgggggtgccggggtgggcctggcacccctcatccctatgcgttgcatgcaaaccccgcgtgattagccatctaatccatacaattagttcattaatcagttgcaagttgagcctatatctaggtgtctaataggttttatctttaagtaattacttgagttaattaacataacgcgatgtggttgcaagtctccaaaactaaaaagcatgaatataaatgatgttgtgtcattctaagtattgagtaaagttggtgctatttagtgacctagtttaaaaatggttctttttattctatattaaggtacattcggactcagacatacacccaccattctaaaataagttcacttttatatatgaatctagaagaatgtgttgaaataaatccaaaatcatatcaacaatcattttatgtatatattagtgcaaatgacaaatagccacaaaattcaaaatataattatacgaggggcgactatgtattttagagcgaacaaaaggcgactaggtgaggccaatctgccactctgcaggatttgagccaccaagattcacaccattgcctaccgaggcgccggtgagttcttaaggcttgtgccagcaccccctatctctaaatcctggcttagcccctgcctggatcacccttttcttctttcgtgaatgattaatttttttgttgatgcgctatacaaatcggctctgcccagctcgctgagggctttctcgcattctctggatggccctcaattccggcctggagtttgtttccattcctatgagcattccaaacacgatggttttgtcacttcagttcctgccaaaatcacaactcgatcctgttccaactggaccaaatcagtttgtcaattccgcattaatcaagtcagcggtatttccttcaagatcttttactactactacttagtattaagtggtagtgttatatcatagtagtgttaattataagacaaacatctctatagtgagttatatacctaatgtcttacaggtatttctggaggatctgaaaagaaaaaaaaactaatttctacatgcgctctttgtcgaaagtaggaaaatttcaatgttttctgctacagatatacctattgatgaagctttacataaattgtgatggacagatcctatgggctgtgcagctaaatacctgacgaagaatgatatggcattcgtcattagcagggaacctcagaggttaaataaagaagtcaattttgctgctttcctggataatccgaacatcgatgatgtgcacaaccaaagtattctgctctggtcatacaatgtaataccagccactgccacatcaactgagatatgcaggctcttcagctcagtggtccagacaatagagagagaattgggtcagggtggtgtgcttgtagccagaagaacacatgccgactcagcggacaccatatcattttatcagcttgctgagaagctcaagctatcatcgtacgagattgtaaccatcactggtgaaggtgcgaggggagtatgttctaggacatcatattttgggctcccccaaaatcgaagcaccagcaactatagctttgacattagcagcaatggcaatggagctgtaacagaggattctcaatcagcttctgtaggccacaatagggttggattagcagtaacacatggcactaaaacaccccttaatccaaaaactcagagaagaaatgctattgaatcaaaggacaaatgctcaaaaagtagttgtggaagtgggagtgagaaatctaacgagacactcaggattgctgtgacacgaaaatatggttttcaaaattttctgaacattactgatcttcctaatggcaagataaatgccactggttttagcatcgaagtatttgagaacgctatgaagaagttagatcatcctccatgctatatgttctgtctctttgagggttcatatgatgatctagtaggcagcgtctcttctggggtgagccttactcctacctgctttcttggcattttgcaaggcttgaattataaccttttaatttcctgtcattctctcactgaatcgttcttctgattttcagaagtttaatgctacagtgggtgatgtcagcataactgccgaacgagaaagacatgtagatttcacaatgccatacacacaatctggtttgtctattcttgtgctcgctgagaaatactccaaaccgagaattcaatggatatttataaagccgctgacatggcagctgtggttggctgctgtgagtagtttcttatacattgcatttgtcgtgtggatgattgaacgacccagaaaccaggagtaccaaggatcaagctcgaggcagatcagcacttctctctactttgctttctccacaatgacattttctcatggttataactcacatctcaaacatgcagatttatttattattctataatatta

SEQ ID NO: 9485 - DNA, 751 bp, Oryza sativa
ccaaattatcacaaaactacatatttaactcagtgtatcacaaaactacacatttaacatcaaatttatcataaaactacacatttaagatgaagtgtcacaaaacacatgtttagtaactaaattatcataaaactacgggtttagaaccaatttaatcacaaagtaataatgtttatagctccaccataacaatggtgctagggatttaaactccaaaagttgtagttttgtgataagttcaatattaaatatgcatttttgtgatacttaacctaaaatctgcagttttgtgataaatttggtactaaatgtgtagttttatgatataactccttaaatctgtagttttgtgataatttggtcaaaatacctgtagttttgtgaaatttactctacatcttctgataaaaaaaacacatgttaaaacatggcctgccctgctatcattttttttcttctgttactagttcctgccaagatttcattcaagtgacagtatatctgctggaacttgacctctctcattttcaccctctctgctagttgtatgggggcattaaaacattcacagtggtgctgttttatcttcattctcgaatgtgactaatttcgtttatacttatgtgtatgaaataacttggtgtgtgttcctattgcagttgcaagcttggtgaaggtaagataattctctgcgaggaaggcactaagcacaagttgcagaagcttcagcttaactatccaaggttag

SEQ ID NO: 9486 - DNA, 16526 bp, Oryza sativa
  unsure (1)..(16526): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccatgtaggccacgaaaaccacagagcatagcataagatttgtaaattataatatacctctgaaaaagatagccctgcatttctatctgtgtaccaatagaacattccttcttgaatgtccacgctcaaagcaagagacatgtacatgtaaacacatggtcgccatacttcaggacattttaaggttgccatcattgttctacttgcttctacaaacttcatatgggcctaattttttaacagtagacaggaaaatgtcaatccaggaaaacaaaatagtacttatatctgacatgaaaaagcaaaattgtttaccagctcatatggaaagttgggcatatggacgtcctttatcatcattccagctaggattaccagggcagaaggtattgccaacatgccaagggcacccttgagaaacacaagattaatctatgatgagacaccgtcacaagaaaaactgaaaaagcagcagtggataaaagagagaagcaccaccaccaccacttcacttatatttatgcagaaacaggatctttcagtggagaataatttaaatttaaattgattgccaggactatagtaaagtggtataaccattgtgattctcatttagaagtacaaagtactaacaaacaagtaaaaccaacgatactcacttgagagcctattgcatggacaaggaaaccacttattgagaatccaataagccctcccacagatgcacagaatccgtttaagcttatcatgtcagcagcaagatgagggtgcactatactgttttcagcaacacaggcatctatagttacatcggctattgccacactagcacttccggccatcaatgccaacaacgcgaacaatacatgaagcttgctgtggagagataatacaagcatcgcgactactcccatgaagcctgcaattcctcagcaaacagggaggcataatcaataaaaataattccataacctgtaactgaataacagtcgcacttaatcaaaggaacattatgttgaggaaataacagtagaaaaaaacatatcatcagacttgtcagtactaaataagtcaccgggaacatgaaactatgccacgttcctcgtcccgggaacgccgttcccgttctgggaacacgggaataacctcgtttccccccatgttaaaacataaaaaatgtagcgtcccatgttccttgacccatcgatccgggaacttttatgacataggtactaatgctaccgtgctacggcaacagctgatatatttgagttagacagcaaggctgtttatagtaatgcacctacataactgcattgatccatccaaattaggtaatggacaaaatttgctccttcaacccttttatgtagttcaatgatccaaaatattaataactcaatggaaaactgttctatgaacttcggcctaaataattaacactcctcagctaaagcctagtaatgaaaagagatagtgtcccaaggagcatatcgaaactcgatacgcttccttgctacaatttcagcatctaatcatcagacatcactactctcaggtcctaaaatttcagtttgcgattcatgattaaccagtaactcgtttttttttaacaaaagatgattaaccagaagttttccattgcaatcatcatcagcagcagcaaaatgggaagcgtgaagtactgttaccacctgcgatgacgaagtaagggcggcggcggtagccggcgatggggaggacgtcggtgaggaggccccagagcggcttgaccatccacgggatggaggtcaccccctggtacacctgcgccgccgacggctgcacccgctgcacgtccttccagtagtagtccgacgccacccgcatgacgccgccgccgagcccctggctggcgccgtacgtcgccaccacgcccgccacgaagctccagtgcagctccctccccagcatcctgaaccaccccaccggcgaccacgcgccgccgccctccgccgcatcgacggcgaggaggacattggcctcctcttgcctgctgctgctcctcccccccttcccctcctcctcggcgcggaggtcgtcggcggcggcggtggccggcgacatcttcttgcgcaaagatctctcgcctggttttacccgaattgctccggcttgaatctggagctcggattccagcaccagatttgggtttcttgaatccaaagctcggagctgcgaggtaggtgcatcagtaatcgaatcgatccccaaaaagtcttaaagaatcaagagaaaatgtcggggtcttggcaagaacatcaaatccaactgctgcttcaacctctcagctcctttcacatgcttactactccacacagatagaaaacaatcgccaaaaacagaacagaaaaaaaaaactatatgctaaatttgccgcagaatgctgcctaattgcatccaaaaacaccactcgagtatataaacagcagagatttggtgcctgaaaacaagaaagaaaacgggggaaagaagtggagccgaggagttattaaatttgcacgctagaagtgaggaagtccaaagaaattgagagatcccttctggttggtgtgcaggtgtagtagaggtatagatggccatatggcccgaggcccacggcccggcacaaagcccgcaattttggcccggcccaagcacggcccggcccgattagggtcgtgcccgtgccggcctggcccgacagccgggccgtgcctgggctgcaccctcggcacggtgggccggcccggcacggcccgatcaaataaaaaaaatatagggacaaaaaatagacttatataatcgtataaggcatggcccaagaaaataggtatacaaaatagacttattttccagccatttaaacacaacccacagagttgagggaccaaaaatagacttatttccagccatttaaacacagcccacagagttgagggatcaaaaatagacttatttccagccatttaaacacagccacagagttgagggaccaaatataaactctttctgtgaggcagcacaatagcccatcgtgccttcgggccggcccggcacggcccgactagtattgggccgtgcctgggccgtgtatgccgcccgtgggctggcacggcacggcccggtgcatcggtcgggccgtgccggcccgacaagcctcggcccaggcacggccgggcttgggccgtgccgtgccgggcggcccagatggccatctataagtagaggagaggatagccgtttgtcttattaaaattttaaaattttaagagaaaattcgatctttagtataggaaataaagcggtaccaacaaataacacaaaaaaaaagtttccactttcgatccatagcataggccaccgattttttttcgtcctgtagcacttccgtcgcattttgaagtaatagcgttagatcgggagtagagaaaatttttgtcggactcatttgcccttccttccccacattccccaccaggtctcctcttccgctccctcctggatggcggcgcggcaaccatcggcgtgctgggagaacgcctcgtctccccgccaccgccgagcgagctgcggcgctcgtccggcgcatttcttccccgccggcgactacttctcctcctccaccggcggtggcggctgaacagatgatgatgatggcgccggcggagtccgtggcgcacttcgactctgcgctcagctcgctcgtgtcgtctccgcagggcggcggtgatgagatggcggccatcggcgacctgatcggccggctcgggagcatctgcaaccacggcagcgccagcgccaacaactcgtgctacagcacgccgcgaacgcgagcccgaagctgtccaaggtcgccggagccggagacgacagcgactcggcggcggcggcggaggataagctggagccagccacaaagactacatccatgtgaggatgaggaggggacaagccgccgatagccatagcctcgccgagagggtaattaattaattacctaattaatcaactaattaattagatcctaattagctttttgctggtgcactaatccgcgcggctcagcttcgccaagtaggagcagcatctccgtgaagccgtcgccatcgtcgtcgaagatggccatgctctcgctgtagcagcagcgagcacgctgctcgacagcccgaaccccgtccacgaagtcggagagcgggacggtgggtgctcgctggaggaaacggcggaggaagcgccacttgtgctgctccatggcgtggagctcgtcccggccgcggtggtagggcccaatggacaccagccggggctcgtacagctgctgctgttgtcacgacgggagccggcgggaacacggaatggtgtgcggctggtgacggagacggcggcgacgcgactggggacggggatcgtcgccgcgtcgctgtttggcgacggcgccatcgtcgtgggcaccgaccggagagaacgagatgacacaggaagacgaagggcaaatgggtccaaaattttttttctatacttcaatgtaacgctgttagctccaaacctgatggaagtgctatggagcgaagaaaaaccggtggcctgtgtttctaatcgaaagcgaaaaatttttatgctattttttggtaccgctttttttcctatgctgttgatcgaattttctcaaattttaactgtaattctgcgcgctcgctaactgaaacctacccctatgcaatctcacagcttctgacaggtgggacatgctggttgggaccacagagcagtgagggtaatgcgtgcctgtacgacgagtgactagcttaaaaaaattatacgagttgcttcgaaaaatcatattaatcatttttcagaaaaaaaaaatattagctaatacttaattaatcacatgataataagccacctcattttacgtgataatacgtgttttacgacctctaacataccgaacacagcattagacgggtacagttaccgaaaattggcccttttacaaaatttactgtaagagtgaaccatgtcgaaaactaattgtaaaagtgagtctgacctcagcgcatgtagatgtaacatcttaacactagggttggcactgtgctactccctccgtcctaggaaacccaacctagtatgtaataggtgagttttttttttttttgacagatgaagtattctccaacgtgactcgaattttccaaattagcatagttcagcaccatgagagctccggatcgaatgaacctgttcatggtactaccatgtatggtgaagtggctctagcctagtggtagagcacctttcactctcatgtcttggtggctgtggttgtggttgtgggttttttctttaaaatatcacatgttttgttccaattttattttataaatatcacaataaaaaatgagaacttaaattataatattaatattaatacaatatttagctcaataactataaatttgtattttttgtacatcttaataaataaaagttacatctttctgtttaaatttaaaaataaacttaagaacccatttgaatcgcaggattgaaaaaggtgatgaatagaaaaaatacaggattctaatagaaatgtaagtgtataataaaagattgcaaaacacggaaaaaatacatgaatgatcgtttaattgtaccacaggaaaaacgtatgaatcggatgagatagattcaaaggaaatttttcaagaggttgggctcttgctaaatttcctccaaaatctacacacaacgagtcatttcataggattttaataggatttagaaagtttcaattctttaaatcaaagggccaaatagaaaaattttctataggatttaagtcctacgagattcctatataaattctttgattcgaagggactctaaaacatagtatgaactatcagtagaaactagttttcacttttcagaacttgatggtaagcctcccgtgaaaagaaatggaaaagatgaagtgcatgggggttcaaatctatgatgcaaggataggagccacagacccgaactaaatttgaaaatatattgtctatttattttttctcagaaatattcgggattcaattttttttgcacaaatataccgtcggtatcgctcaacggatatgcgaaaatgacgtgggcgtgacaacgctgacaatgtcgcacgacgacggcgcaaaaccactcgttctcgcgcagcgctggcgtgagaccgagcggtctcgcacaacaaaacagattatcatttcaaaatggcttaattagtgattaattagcctgattagcgaattaataaattattaatcaatcactatctattattaattaatcaataatcatgacaattaatcactaatcaatcaattctcaaaacggtttcgctgtttggccgtgcgagacctctagcattgtcacgtccacgtcattctcgcgcagtggttaagtgatatcgatagtatatttgtgctaaataatttgaatcccgaatatttctgagaaaaaacaaatgaacaatatatttcaaatttaattcccactaaccctacaactgagctaagaacgttcaaacaaatatggcttccagcatatttggaggcagcagaggtcggcgccaagccgccaactgtgttggcactgagatctcatgacgtaccgaaagttgccacctcggacacaatctcagcgtcaagaaagcttaagtgattcagacacgatgccactacatctaattcgtttcccgaaagttgccaccttggacaatacaccaatagattgaactaggagtgtttttcccttaccccaaaattcttcttctcaatgtatgtcaccgcgaactaaaagcgcacaacgcgaactcaactggagcttccgacggcagtagaatccagcaccagccagagctcacccaccacgcaagccgcacaattaggaatatctgattgaaaataagaatcaatttgcacaattaggaatatctgattgaaaataagaatcaatttgccacaatggcagtgtttggtttggttcataaataattctttcgtgtttggttcataaataattctttcgattttacatgcgtactggtctcctcctggagcagagtgtagacgcggctcaacacctgttgtgctcgtgacttcgtaacaaacgtagcctaaactgcagtttgttcagctcaatcacaacattttagtgcttacctttttaacggaccacacaatctcatcagtaacgaaagatattagcaaaaacacatagcagccaccaacaacacatactcaacacatagggcatactcctgtgttcttggtggctgctatgtgttcttagcactacgaaagatattagcaaaaaacacatacgaaagactgctccaaaccgggatgaagacaagatacattcaattcttaaatctagctacagcactaacacaatttactgcacccacagagcaatgtttgtcagggtaagtcatcttacgcttacccctattcatctagaagaccaatgggtatccataatgaaccgtaaaaccaacccaaccgtaaagtctgtaaccaatatcccactaagactgcatggcatcatctcctgcttcacccggcacttcattgaacatgtactggctctgatactccatcaagtactgcgtcgatctcttgacgtccaggaacagctggtagaccctgcttatatcctccatctccacaaccttacccttgcgtttctggcaagctaatgcagccgaagtgatcaggtggatagcatacctcagggacgtctccactcctatctttgtgagcaaaaccttagcatctgcagacatttccacatcttcttcatcgcacctgatgtctaggatcttccggatatcatcctcggtgtaaggctgtgtcgtgatgattaacagacgatcaaggaaatcaggtggtatcccatgtggtgatcggtagtttgtcccacgtatggatgtgatccctcggttagttgcaatgactagaattggagccatgtcattttccaatgcacggtttaggaaggagaagcattcgatatctagcatgtggacttcatcaataaacagaacaccagggacaatctcagccttcccttcctccctccactcagcaacttttgtatcaatctgctctcgaacctctgcacgaatttcaccagtgtcaccagtgaaaagtgcaagaaaaccttgtgtcctggacagcaataacaaaaaacaaaaatgagtttgtgcaaagatagtctcacttaatttttatggtaggtagaaaaccacatctgaaagccaataatcttggtctaatgaccaaaaaactaccaagccagttataagttagatttttggtgattaaaaaatggaatgttcaaaaagattcaccaaagaatctatttagaacacatcagatagttgtttggctgataacatacttagagagagagagagagaggagagggagacagaacacatcacaatcacgatcagttcatgatttcaaactagttgaagcatattcatgtaccttgtcttggaacatggttcatttatgtgcacatgatactccctctgggctgataatacttgtcgttttagacaagggtgatgtcaaactttagaatctttgattatgaatcatttttaaaatatttttctttcaaatatggtgaccaccacatggatagattagtcttaaaaagcactttaataaaatcatatatttgttaacacttttatacatattataatgaaaaataatggtcaaagttgttttttgtacactgtgcccttgtccaaaatgacaagtattatcaacccggagggagtaattgctaagctatccaaagtaccattaggcttgactaattttcatcacattatgtcctctagcaacatcgtgcaggtcctttctttcacaagagttacaacaggaggctgctctctattgttatttctctacgggccaaaagaaaaattagatctgatttgggcagctgaattgtatttcagctccaagcccaacaagatcatatatgccatccagtagtcagtagaccatattttcttagtattggctaactgtgtggatgcggcacttagtagggagaaactgatccaactagggctgtccaaatccagtttaaccgagttctgtcaacccgcattttacatgtctgcaggtgaatgaatgagatgactaggtgcgacgtagtcactggaacactatggttagctatggtttggccaattttgctaatgcaggaatgctcaaccctttgatctagttccagcgtcattcaataggatttgggtggtgctgagaatgggacaggggttgtacagtataatgcagggacttccgtgcaaagagcatggtcacagtgtaaggcagctaagcaagattaaccgatttcaaatttattatgtgattctgatcactgcagatacacgacacagaaattattttccattcaggctcagaagcaaaatacaagattgtaaggcagtccttaatttggaatttggagcgacaagctgacaagtgatcctttgtgtgcaaacgctggaacagatttttcaagactgaaaaagaaactttggtggctaagctatcacctggataattaacatacaagcaagcacacagcacatatgtccagggtaactgaaagtcaatgtgaaataccagagctgatagaatttgaaatacttcagttggttatttcacttgtatctatttttcagttgagtgataccaaagctgacagagacttcacttttgtccgcttactcgttgcagtaagatgtgataacaaacgccctttaatatgtagttctctactatgccaaaatgattaaatacttcaatgtagatttcttgtcaggtagtatgaaatatctactccagtaatggacgaatttttgggaagggaatgtgaaattaccggctattgatgacatcaatttcatgtaaggtgacacaatgcacgacctccttgcgcttctggagctcgccctcggggcacttgacgaacttggtgtgaggaccaacagcatcgtaatcccgcgacctcccgattgagcggccaagcttggtcaccttcccggaggccttgtcgagcgcaaccacatccccgctctgcaccttctccttccccagggcctcaatcatcttgccgccgagctcgtacacggtctccatgtccgtggtcttgagcgtgaggcgcccggtcttgccagccgcggcgacaccggaaggcgcggagctgccggcggcggctgcggcggagacggggcggtcgatcgagatctcaacgacctcgccctcgatgatctccgcctcctccttgatgcggacgccgatggagcggcggaaggcctgggtgagcgcctcggtcttggagaggtcgagggagaagagctcggacgcggcgacggaggcgaagggcgtctcggcgccgagggacttggcgatgcccatggcgagggcggtcttcccggtcccgggctggccggcgaggagcacggcgcggccggcgatcttcccctggcggatgagctgcaggatgagccccgcggcgcgccgcgcggggagctgcccgaccatcccctccgacgagccgcgggcctccagcgaggagtccagccccagcccccggatgtgggagtgcgccccgatgcgctcgatccgcgtcaggtcgcggctctccgacagccgcttcagctccgccatggccaccacccgccgccgccgccgacgaggtgcttttggcttcccgagggtactaaaagagaagaaggtttaaggcgaaagggggggaacgagttctagggttttgccagccagcttgggttgggttgagtggatggatatatgaagacgaagacgaaaggggggagcacggagaggtgttgcacacctgcacttgtgacataatgggccgttactagttgggccagatgtctttttcggcctgtttggaaccaaagtttttcctattggattaagtccacatgacgttcctagtctattaatcgagtttaaatcgcatccccgaaccgcaatatctttgacctcccaacttgcaaaaccgggttgaattaggtcctccagtagcatataaggccggtttcgctgacgtggcatggtcaacctacctgagttagcatgggccccacatgtaagtcgcaaaaaaaatcccttctctccctggccgagagtagtcgccataatagtcgggtgtggcggcagcgaagctatgtgtccttggctgcttgcaggtccaccagccttgcgtcccgggtcatcgcgtctccgtcatccctgagtgggaacgatgatggatctaattttatgcaaattcaaatggcatgactacgtatatacgatttgtaatgccatttatctgaattgacatatctgcaatagcgtggatccaattaacccttacataaattccgaattcatgtgtttcccctgtaccctaccccatcattgaactctccctttaataacgggggaatttaactatttgcaactattaggtttgtcaattatctaaatgcccctcttagaattgcatttatttttttgccattgaagagagagaacttcttaattctttgccacttttgcatatatagcacgccaacaaggttgtcccgtcatcttattccttctccacctcctctctatcttctctcccccttctctctcacctccggcatcttgttggacaaacggcgagctcctactcgtcgagcactgagcctcgctgagccctctgaaggaggagctcgctgaccggatggtgcccaagtatggccgtgtcacgtgaggttgggggttgcggcagacattgtcgactgcagaagtgtcctaaggaggatgacgaggagagtccatggaccgaggcacaacgatgaagcggggatgcggcggtgtggaggagggaagggtggacttgaggaaaagaggcttgctactggcaatggcgctcattcgcggctccgcgacccgtttcacttgacctcactgttgacaatggcgctcctccttatcaacatccaccgcgagcacaaaaccctcatcttgtgcgccttgtcctcctttggtgacagcaagctcctgggtccctgccgcgccacatctccacctaaccagccaagacaagggagctcgctggctacccaagaagatagccgaaggtgaggaaggagagagaagatagagaggagggggagaaggaagaagatgacggggcggctttgttggcgtgccacgtatgtaaaagtggcaaaaaaaattaagaagttgtttctctctaagggcataaaattaagtgcaatttttagaggggcatttggataattgacaaacctaatagtggcaaatagttaaattccccttaataaccctctagggccagattctcaaattctcatcactcgaggggttaaaatgtaaaagagcgaaaaactcccgcgcgccaaatcgtgatggaaccctaaactccaccgctcccatctcgtctcgatcccctccatttcaaatccacactccgcctcccctctccggccgccgccggcgagatggatctctccgccaccccgtccagatccaaatccggcctcagatcctccccgaggaagcccgtcgccgcccccgccgtggcccagatggacctctccaccccgtccaagccgacccccaggcggaagcccaaggcgccgccggtggcggctccgatgtcccccgtgaccccgtcctccgtccgccgctcctcccgcctcctcgagacgccgaccaaggtaacttccgagacccccgtgaagcccaccccaaccccgaagcggaagcgcgccgcgccgtcgccgtcgccgaagacgccgacccagtccgagcccaagcggcagcggcagaggcagaggcagaggcagcagccgaagaagccgaagaagagggcgtactaccggaaggtggtgtacgacggcggggagttcgccgccggggacgacgtgtacgtgaagcggcgggatggcgcggagtccgacgcggaggacccggaggcggaggagtgccgcgtgtgcttccgcgccggcgccgcggtgatggtggagtgcgacgtgtgcctcggcgggttccacctgcggtgcgtgcgcccgccgctgcggcgcgtgccggagggggactgggcgtgcccctactgcgaggccgagcgcgcggggaaggccatcgagaggcccaagccgccggaggggaagcgcatcgtgaggaccgccaaagagaagcttctctccagtgatttgtgggctgcacgaatcgagaggtcagtgaaaattgtgctctgtggttattttgtagtcagtatggtaggcagaagttgattccgttcaattattgtttcgattcatttcaacttgcttgaactagccacattacgacgaattctagtgaatcttatagtcagaatgaggtagcattgagcagtaatgacgaactggtggtgtgattgtgtgaataggatgtgtaacggcgcatccttgtcatgatttagttgttccagtaatgaattctgcatagacaatcgtttgttctggccttgaattaggtctgataccccatgtccccagcaaaagaaggttgcatcagtaattggggttggtgcaagatgcacctggataatttctggatgtttatcgttgcaattaaacctctagttctctactgtaacaatttcactcgactgcttgtaaagtttgagacatacaatttcttaccaataccgttggttgcaacagtttatggagggagccagatggaatattctgggcaaaggtaagatggtatattatccctgaagagactgcagcaggaaggcagccacataatttgcgtagggagctgtaccgcaccaatgatcttgcagacattgaggtgataagttattttcgagtgataaattggttcctttggatggtatttttgttcattattcattctgttccttgcttttatggcttttgcagatggaaacaattcttagacattgttatgtcatgagccccaaagaatttaaggatgctagtgatcaaggagatgacgtattctactgtgaatatgaatatgacatacactggcataattttaagcgtctggcagacatcgatgatgaacctgaggtacatgtactgaaacttggttatagactgttcatagtaggagtgtaggactcaggggcaccattctggtagtcaagaagtgaacctcatcctactctgttattgtagacaaaggaagatcctggcgacgagccatacaatgctggtaatgattatgtcagtgactcggatgaagattctgaatatgatgaggaggaagaacctactaaatgtagttctgctagaacacatcaatcacatgcgttggctgcggtaccaaccattcctcgtcctccccccctcttgcctgtctcctctctgctagtgttgcacttcatgctttactgaaatgacatgcccatttgcagaatctgcggaaagggaggacatatggcctacaaaaaattgggatccgtaaaattcctgaacatgtccggtgtcatcaaaagaccaatctggagaaggcaaaagcaaccctgttattggcaactcttcctaagtcgttaccttgtagggataagtatgttagtacatttttgcagcttgtttcaaccactttcttttgcaaactgcttttgagttgaagtctcatgtcagagaaatggaggagatatctgcatttgtgaaggatgcaatttgcaatgatcaatgtctaggacgctgcctttatattcatggtgtaccaggcactggcaaggtaactaaccatcctttactgtcccctatgatggtttgatgtccttttctgtggctgaaggctaagcaatattttctgtgcctactttttcaacctgtagactatgagtgtacttgcagttatgaggaggctaagatccgagcttgattctgggaatctgaggccttattctttcatagagattaatggtcttaaattagcttctccagagaatatctacaaggtatgtgaacttctatcttggttgaatactatgattgtctagtaaaccatatcagccatgttaaaaggattataatgcatataattttaatatatgcaggttatatatgaacagttgagtgggcatagggtagggtggaaaaaagcccttcattatttaaccgagcacttttcaggtggcactaaaattggcaaacaagcaaaccagccattatttgctcatcgatgagcttgttcttctttacgagaaatcagtcggtaataatttgtagctgaacctgttgagtagttcagcaattttgtattctattgtttggaaaatgataattgtttgatatttcgttttgtttgtcactttgttttaccatgtagattcatgttcattgacatttgagctaatgttttgtcaggtgctgtataacattcttgactggcccaccaggccaaattcaaacctagttgtcataggtacctatacttttgtttgttttacgtgtgattttagatggccttttaattactctttggctgttactgaacgcaggtatagcgaacacaatggatcttcctgaaaagttattgcctcgtatttcaagtcggatgggtatccaacgactgtgttttggcccatataattatcggcaactgcaggagatcattacaagccgtctaaagggcattgatgcctttgaagaccaagctattgaatttgcttctagaaaggtttggaatgcagtgtcatgtgtaaatcttttctattattcacccatgtcttttctgtgactgttgctttgtccatcctatttgcaattttttttcctgaagggtgaatttatgcaacatgtcttttgttttaaggttatttcattattttgttctctgcatatgaattttccatgccattaaacacctttttgctaccgcttgtccgataacaaaaactttggatgttctgagttcctagtcaaactaataaatgagtggcaggtgctgtaatcactctacacttttcccttttccaacaaatactgtacagaacacattgtctgtttagtcaatgattgcatgccatacgtgtagcagtcttacttttgggggatgaacttacaaactaaggaacacctcatgatctaggagatcaattatttgtgtcatctgtagttagttacttaagacacttagcaatttcttttcattgtagttcctttttgtatgttcctgcaagttcagttgacagttgacaccaacggaagccagtggactaactgcattcacagcactgtggtttggttgcacactgactgttaagt

SEQ ID NO: 9487 - DNA, 1472 bp, Oryza sativa
tcctgcagcccacccatgtcaatattatgcaaatgaaacatcctactgaaatagctattattcggttttaaatttttgaagaggactttactaaattgttctttcatctaggacagcgatgatatctgatcattctcaattgttcttgatcttcagacaagtgaaaaatcgtaggtcagttttgaaggacatatttcctcttgcaaaatacctattcctgtctagagggccaatccactatcctcagctcaggaaaacataatggatgaagctgtcaattgttccactgagaaacaaacacaagataagataatagggaacattcatactgcattgatctctgctctgagttctgagcaagaggtaatccttatgaactttcttatttgatttatttctgagatgtgcttattaaatttttgcatggtggtattggtaatgttatattgactatcaggtcaatcttgacgcttcttgaattgaatcaatgcaaaaagaggatatttatttttgctctttgtatcatggagaattagtagacatttcatgttcagatattatagtcatatctttggaatggcaagacaaacctataccctttttaagtgctaagctatacataattatttttatgttacctcaaagatgcgattcagaatatttttaggttttgcaaattggacatactacagagtgctgaggatgcagtaacatacaaaaccttcgttagccgcacatgatatataatataattgtgttttcagatgtgccaaatgacatgcatttgtagctcatctcctgatgaaggtgatcatcccagagcttcagtattgtgcgagctattctgagatacactgccactagagtcgctccaatgtaagttatttcaagcagttatgttctacttgtgtggttatttgtttaaacaagaactgactgcccattcactttagatttggggctcccatgtaatattatcccacctaccatactgtcttaaatctagcaatgctcatggtttggtcggtctttgttttgtggtgggaagataagaacaaggatatgtttttctgtgttggccttgggatcaaccaactgatgttccagctattgccaactcaccgacctaaatgaatttgtatcgccgattcgtaatattgagcttctaaaaattatccctacaaggattgtgcatattcaatcaatggtgcttgccatttctgaaatcaggttcactaaatggcacaaaatgcccctttgtgttatttgatatagttgcaaccgttgtgatcgaagatgttttgccatatagttactacatgcattgattcttccatgccaaatatcccagcatgacacatcactctgccaggatataatgcatctccaacagactatgtaatccaagcatgaaaacatgctaacttcctgaatctaactggaagtgtacattcttaaaccatagcagtacg

SEQ ID NO: 9488 - DNA, 25465 bp, Oryza sativa
agcgatgtttttgcaaaatggtccataatttccagttaattacgcgcaagtctccgctccccaccgtccgatctcatgttgcgatcgatctggccatacacgtgtcccgccatggcggccctttcacacccgtgggatcgtcggatcgcgaacggacggcagagatttcgctagcccacaccaaaccctagccctcttgcccgcttcgcagcctctcccttctcctcccctcgcgttcgtcgccgccgccaccgctgccggcgcagccgcgcagcccgcgctcttcgagccatcgtcgctgcgtggacgagaggaacgcgagccgccaccgccctcttatccctattcatccccatgcggccaccgcttccctctcctttgcgctctccactccgctaggtgaggtgctcgatctggttcaggggccgccggaagcgatggtctaggacgccccaccagttgatccagtcgcccttggtccgtcctccggtgccagggacacgccgccttgcacgcgctcattcctgcgctccctcagctcctccgtgcacctgtcgatctcgcgtccaccccgacggccggacgacctccccgcatcccttgcctgtgctcccgcagccagatggccagctcgacgctgcaaaggccatgttcacgtcatcgcttcctctggtacctccaatctctcctctggctcttacatcctcacttctgccaaaggcttcctcctgattggcatctgttcttttgcagtaccaacgccgctgcccccatgtggttctctgcttgcagttgggactttcatgcatttattcaagtcccagctgttctctgctagcttgcagttggttgccaaggtaaagttctttcttggactgatttgaggttcatatttgtgctcctttttttccctgcgtaagatgtacactaagaaagattacagtgcagatccatctcaaagcgtttcagagcataatgtaaatgccctactgtattttttatcagtgcttattaagcttctctagatgcaggtatccctctctagatgcaggtattcctccagtgcatatggagtggtacatatctatgtaaattctgttttccctccatacgaattagttacttttcttaaaacatcatatgaagtcatcctaacctatttagaactgaaattttagctatcattgaccatgcggtggccatggaacgtttttgcatgttatttttgttccttaatttggtttgtcctcttagctagaggtatactgagaagcactagctaggttctctctttaggagcactaatgcattttggggaagtaggatatctctcctgaggtgtgcaaattcaggcgttcaaaaaaccatatacttatgttatagtgtttttctacaattgaaatagttattgatagcagaatatgcttaacatgctacatacatagtcatatagctaaaatgtgacaattcaaattgaagcctatataccattagagcagctactgtgttccaaaactcagatattttatttcaacagccaagtaggctttcagttattgacagccagttggggataataggatatgggatgaggtagttcttagtgtaggaactacgatccattgataatgtttcactgaatgcaaattaaaggaggcttaagtgcctatataatccagattttaactataatgtgccagggtagaatgaatcaaacttgaccatatgaaattattttttttctcagcaacctgtgttccaaactcagatagttcatttcaacagccatttcttcccccttgtgcagtcctaattctttgttgtgttcattctttcatgcaggttgtaattaatctggcctgttgttgccatttcctacgcatccactatctttccccttctgcgaatcagtcagctaacacagcatgatatgcagttatgcaccactacttaaaccatcgatcctccctctaagttccgataagatgtttcacatattatatgtatatgtagctgatatatacgaatcccatgatatctcttctctgttcttggtttgctacttattgtaagttccatattgatgaaatatcttctttcagcagccacttgccaattgttgtgcttctatttggaccgtatggaaattctttgttgtcttctctaagaggtaataatcttggtcttctaaatactcaccgcatttccatgatagtatgctacgggcagatgctgcatctcttgagtctcctcaacttccttcccttttcatcagatagtattttatttattaatttgtgcccactatttttatatgcagaatgacagagtatgtatgatatacttttggacaatcttatgttgggaatattgattgatatgtcatcaaagattctccgaacttggcaatcttggtatatatcgcattgaacctttcagtttgtccattcaaaggtattgttattcgtgcatttgtatctccatttttattagcttaggccctgtttcttttagcttgagattattataatccagattattaggagtaagctgaaagaaacagacaacttattgaagtagcttattataatctcgagcctagcttattataatctgataagctcatttaggtgagcttttttcagattattgggtgaaaaattacccaccatgccaccccactccttttttagacttgcaaacctaataatctaggttctaataatctaggaaagaaacaactaaccgcttattctactacatattataacaatctagcttatagtaatctgactcaataatctagattataataatcttaagctaaaagaaacggggccttagttccttcatctctatatccattatgagacaacaagcttattctgagtccattctcccaatcctaggcttattgattacatttttaagatgttgcattcggtaccaacaaatcatttctttatggtaaaaggctacatctttatatgatctttcttacacaacaaccaatactactgtgtcaatcaagggttatggaacttactgacaattacaaggaatgttgcacatctagcaaaaaaaaaatctatacttcggttgaagattttgatattagctagaactttattagatcacaaatatacatatttatattgtcttcgttaggtcagtcaggctctatgtataacaagctaaatggcaatatgtcgagatatgcgctgaatataaatggcagtatcaataccagatgtaaatggctaaaattgttgatatgaatagtccatgttttcttttttatctacattttgggcatttagatagtatttacttttttagaattctatatatgtgtagtaggtacactagagagtagagacagatcaagaggtgtgatgtctgtagtagatgcatgctcttctcaattgttatcactagcagtgctgcttgagaaatcatcaagttcaatatgtaccttatgggttattctgtgttcttgatactatcactcttatttatggtctctttttgttctcagatggtgccaatcaatattattaatggtttatcttttctggaagtcctttgtttgtaggtatctagataaccaaaacaattggagctgatgacatgggattccaaaaaatgcacatgctatatatgtggagtctagagatatgttttattttgtttgataggaatctggagatgtgtatgttcactagatgaatgtttgttcattacatgtgcaatcattatattgcaagggctcaggaacaatgaggtgatgttttagctaaaaaatcatacatccatactagctaatttatacctataatttggtccgcctttgtgctaaatatgtgtgcacaacaaattgctagcttacatataaatcttatctcatgtatgattacaaattaccagctgaaaactaccttttattcatcatcttaaacacacgcgcagcgtagcgcgctgttattgctagtatttataaaacaacaacctattgaagtattgataggatcgtgtaacaattaccaatactcatctataaaacaagaaaaatactactacagaacgggacaggatgatgcctccgaggtgatatcttgcatcagccgattactactactatttgactattgtgtactcaactactgtactactactgttgagctggtccctgcagctgagtggttctggttcggtggttccccaaccaactgatgcggctcgcttattctctcctccgcgccgccaccagccatcgccaccggcgctccacctccacgccggccggatacaccgaaagcgacgacgacggcgaagcgccgccgcagctccgtcggcagcgacgagacggcgacgaggtgggccaggagcgcggcggaggacacggcggcgttgatgaggaacagcccgccgaagctcctcggcttcagccggagcttgtcgtcgccggtgctgttgctctttctcgcgcaggagccgggctcgccgaaccacttgttctcgatcctcgcgagcctgttttcctcggccagctgcacgatcgcgcgcgacacgtccggcaccagcggagaccccaccgggaaaacctggatgacattacacgcacaaacatttactctctcgtctcaaaatataagaacgtataaataaataagatattttctaatacttcctattccaatacattatgctaagaaatatctaatctaattttaagttcttataatttaggacgaaggtagtatataacttgttagttttattgttactgcaccattaacaacttagtgaaagaacaaaaatacataaatactaagtgccctatgaatcgttttaaaaaaatggatttaagcgccctcgtgtctcgcatgtgtttcagatagttaaaaaaacatagaccatggtctgtatacatcctagctagctcggatgtgtgcatccaaagggatgcatagtccaggttttaacctttttttatatataaaaaaaatcccagctagctacgttaaaaaaggcacaacagtattcctcggttatcctgaaaaaaaaagaaaaaaaaccccatcggttagtaaagggcgaagccaggaaccataaatagggctaaatcactagagtatgagcttcttaaacaaattttaactaaagatcagcaaattcctttgtgtttcttttggcacgtgtgggacttaagctcaagctgctccactcgtggccacccctaaatttagaaaaaaagaattaccgtataagaacaaagtatgagctaactgccactttctatatgtgttaatttcttggtaaaattctacgattcttgaggaattaaggagtaccatattttgtagtttaaaattttgataactttcagtaatttctcaagtaccataaatccattttctatctaaattatgttgtgtgaaatgtgttgaaagggatgataaggacagacgaatccaaatccaccgctcttgtacgttggaccaactatggcgtagccttggcagtactgagacacaaagagcttcaagtagggcacttcgtcaataattgccgagacaccgccgttatctgaccccatgtttagggcttcggcatactggtcaattgtggcatatgcccttagtctgtcctcattgaatcccatgtcttttaggatgttttggacgaatgatccctgctgataacccacatagtcgcccttctttaattcgtttatcgtcggctgcagctgtcccactgtcaacatcgatgttaggtttgccgtgtagcttgtcgtgatgataagaacagtaaacacccatacgatgaccacgagcttcgacaggttgctctccaacttctcctctgaaaattaaatcaggattagtgtcgtcatcaaaagggaatagtaacaaaattgtgcaatcatataataatatactccccaatcttaaaatatagtaatcgagtattgaatttgatataatatagtactatgaacttggacagatatcgtagtactagattgtttctaattcaatactccctccttcccaaattgatcatcatacaatgaaatttaaaatttctcaaattgatcatcatataaccgcatggacacggatttcatcagaatacaattattaatgcagcacgggagaatgtgtgtatgctaaggtgtgtagttggcattataatttaaccgatgcatgcattgtgagagaacgtgtgcatggtatcttgattgttgtgatttaaattatctttgatcttggtgtataaatttatatgatgatcaatatgggaaggagggagtactaaattactatattttagaatgatggagtacttaaaaaaaggggggggggcaagaacggggtttactatgggagaagactagagtcgagaatgcaaagtagaatacaactccgaactgattacatggcgtgccatggaatcgggggttgatcctgtgctcaattgcccacacgacgaagccggtgaagaagaagaaagccatgctagtgatccaaaggcccggagttagtggccttaggaagatccacatgttgtttgccttctccttttccgccacaaccatcgacactcctgagtcggtgaatggcatcgtgaatgaaaccagtttcatccgttctgccgtgatcgtcatatcagccacaaccacatcggctttctacaatacaatagtattagattggtatattttgagacggatgcatttgttaaattttagtatatttaaatgttctatcttaatacaattctatcctcaacaaggtcaggataaattattttagtggcatgtcattgtttatcggcgggagtggattctaatccctcgaaaggatatcccctcgtatacatttttcttccaaattcgatacaaatagttgtgaaaaaatctaaaaaaaattgacaatgtagagtataatgatacctactagtccaccaaaattcatgttcaaattcgatctacacatcgagaaacaaaaaagacaaatttagatataaacagtacgctactattcatacgctgaatttgtcttttttatatctcgacgtgtgagttgagtttggacttaagattttgtgaagttgtatatatgtgttgtatgaatgttgtcaaatttttccagaatttttcataaccatttagatggttttttagcaaacgagggaacatcccctcgagggattagaatagtttccctttatcggcctatacttgtagcacatattgtttcgtacctccttcgttctaaaatatattaatggtattctacccatttaagttaaaaataaattttgtgatcaaagttgaagcaataaaagttaatgctgccaagtaaacgcaaattaatggaggtggtaagtagacactaaccttttcatgcaccaggttcaccattttgtcataagataacatgttgtcagtgactggcacatactgatatgcgactggatacgccagcttcgccatgaccgcttggaacacgtctatgcagaagcctgtgatcattgccccgccggcgctcgtctggttttgttgccttcggatcgccacgaattggttgaatccgaccttcaccgggacggcgacgcggagcggccgcccgttcgccgactcgctccacccgatcgggacggccgccgtctcgcccggccataggatttgcttcagctcctcattgctgccactcttggggcggcgccgcgccatgtcctgggagaccccaagctccggcgtccagaaacccaccgtcctcgcgccgctgccgatgatgttgacaacctcgtacgccgacacctgccgctcgccgtcgaccagcctgaaccttccggccaggccttgaaacgtggtcgcgagcagagcatcgagaaacgtcgtcgtgttgtgttcttccctcgcgttgctgctctggtggagacatcgatcggctgcggcggcggctgcccatgccgtgtcgtacagccagagcagcgacgccgacgtgtgcgcgacgtcgtcgtcgtcgtcttcgtcgtcgatgcccgggttatcacggcgaaaccttgccttgagccgcctcgtgaaactcctgacttggcccgtcggctgcacgtacgggcgtaggctgacgacaccctgcatgtgctcgatgtcgtcagggctaaggccgtccgccgcggcgccgacgccggcggtggcgatccacgcgtagccctccgacatcatgccggcgacgctggcccggcggaagaggcgcgcgaccagggcggggagcatgtgcacgacgtagacccgccacggcatgatcttgacggcacggagcgccgcgtcgaggcggccatccgtcgcgtcggccggcacggacacgctgtccaccacgccacgcgcaccgtacgaccctgccagcagctgcccttgcacctggaacgcgtgaaccagcgccgggaggatgccgatgccgtagagcgagtcctcgtgaaggagcacggccgcgcgccacgagaacacatcgaggattgcggcgatgggcgcggcctgggaggcgatgctggcagcggtgcgcacgaagaagcgtgtcggcggtgagctcaacgccggtgaggtagtaggggagaaggagaggatcgggatgtggttgcggatcgcgatgccagcgaagagctcgacttcggctgaggtttgaggcccgatgatggcttcgacctgggcgttcttgttcatcaactcctcaactgcaaggacaacgagaagggataagtagtccattaatttaattttatccccttcaattagcgtttgtttataaacaactataaactctaatatcggatattgaaccacccttaactcttaaaaccgttcttcttcctggtccaaacccaagtggttttgacgtacgtgctgagtgacaattcgataagcaaaaatatatttcctttgcttttttttacattggttattttaattttaaactaatcaacgtcaaatattaaagaatatagatactacttatcaaaattcggaggtgtcacttagatctataaacttgtaaaatacgtatctaaatccatcaactcggtttaatgaatcatagcaggttcaaacttcatttgaccggagatgaccaccgacatggcactccatgtaggcagaaattttgcatccggcctcctcctcgttcaatactaccccaaataccaacccctcccccctcccaaaaaaagatctccccaatctagatgaatgccagagaacaaaaaagagtgaagatacttacgatacacaggcatgcgcaccggttcatcttttcccctaaatttggggtccatcatggacactcctgcaacgtccccaataacgtgtaacatggatgtcgatctaaggagaataatacacgacgaaatgaatcgtcttgtttccaacaattattcttctagacggtacaaacaaactcctagaagctacaaacagacttcgacagattaaggagatattataccaagtaataattaaaaaacgttttttgtactcaacaaatattaaaaaaaattcaacatgtatttaactaagagatatgagaaatacacatattacttatacacggaggaatagatcgaggatacgtagttagcaataacattgtaaacagatgcatgtaatcaaaataataaatatgatggaatatttttacaaaattaagtaaaactgaaaaacggtttggtgcatactttctctgtaaaagaaaaaaaaagcaacttttaaaaataaatttagataaacacttgtacaaatttatcatcagaagttggttttctccggtatactgaggtagctagcagatgcatgtgcagccgaccagccgtgtaagccagcaccactgtcactactggagaaagtatctttgatcagtcgaccaaattacataatagtcctggttccaataaaaaccggaactaaaaattctttttaagcgcaacgagactatgtgttcttcagttccggttggtaggctatgtcaggccccccgggatctttactctcggtttgtaacaccaaccgggactaaagatcctaactgactaaagatcccggggatctttacaccgggttggtaacgccaaccaggactagttagcttcctttatatatgtactccctccgtcccacaatataagggattttcagtttttacttgcaacgtttgaccactcgtcttattcaaaattttttttgcaaatataaaaaacgaaaagttgtgcttaaagtactgtagataataaagtaagtcacaaataaaataattaataatttcaaaaaaatttgaataagacgagtggttaaacgttacgagcaaaaactcaaaatcccttatattatgggacggagagagtattttttatccaacctgagccaagcttcaaaatttcttcttgaggaggggaggtgttgccgaaattttttatgaatttattttggtgattatatacaaattggaggtatctaaaaggtcagtaacttcatcctccaatattttttggttatcatattacatttagagatatgttttgtatacattattgcctctgtaattttgatggaagttgatcagagagaaatttttcgtagggaagaaagaatatagaaatttttaccaaccgacactaaagatcgatctttagtcccgggtatttgaaccgtcccggatctttagtctcggtttgctatctaggactataggatgttacaaaccgggactacaaaccatttctccagtagcatgtgcatacgttacatctagcttagctagctagcttcatgtgtatagtagctgcactcaccggcgtgcgctgccgcaaggacgtccccgcgcgagtccctgacgcgcagctccaccctcgcgcgcgcggccgcggcggtagaataatcgttggcgccgtagtagtcgtccaacgccattgaaatgcaggcgaggctcctccttccctcgccgccgctcgccaggtccagcacaactccgaccctcaccggcgccgccgccgccgccctactgatggcaccgcaaagcacgaccagaagagaaaggcgagctactgcagctgccgaagcagcaacgggaagcggccacctctccataaccgataactcgatcgtgtttagctagctagcttgttctttcaattcgctcgatgatcgggtgtaattaagttagtttactcgatcgatgatcgtgttatgaatggcatacatatacacgtaggagtaccttaactggagacacgcggttggtcttgtgcgacttgtacaatgcaagtcgcaggaaatttcgcggagtattcttccgctggccggtgggttaattttgtagaatatcaacatgctcgatctcaactctgaactattaactgtcaaaaaaaaaaactctgaactattaaggctgtgtttggaacattgtgttcccaactttccctctcatttttcgtgcgcacgttttttaaactgctaaacgggaccttttttttttaagtttctatacgaagttgcttaaaaaaatcatattgatccacttttggaaaaaaaaaatgagcaaatacttcatgagctaatgagccgtttcgttttccgtgcacacagcttgtgttggaaacacagggtttccgaacgcaaatctcctactataattttatttagtcgtattagttagtactctctccatctacttttgatagttatatttcattttggcacacagactaaggataattaattctatttatccatttaaacatgctactagtcattcctcgtaaacaagcgattcattaatatttatatttctcaatacccatgtagccaatcatgtgtggaagaatgaatagtcatgcattaaatccgagaaagtcattaaaatgataagttgttgaattgaaatatgcctatcaaaaatttttttttagatctggaaatatgattatcaaaagtagatggagaggagtatttgagaacgttgatctttaaatgtcttagctaaccagctattaaaacactgttatattgagagaaggtgagtgtttgtttttacgataaaattattaatcatggcgttggggaaaacaacgtatgcatagaattcgatatagcagcgaattactctattggatcgagatagttcgcctgtagtattcttgctctctgatgcgtataccgatcaagtcaatgtctttttaattgcgtcaacgcgtgtagttttatttcaagcggcaaatactaattaggatgaacggcaatgtaataatgtttgcaatgacgttctaggcgagcgagattcatcatatattatcttgaagcaataatacgtagccacgtgcccacgtacattaaagaagttctgttttctggtacctataaagacaagaaaccgtgagagtgcatatagcctagtggttatattgatctgagtagcaccctaagcatgtttggtttggagactccttaggataggttggcgccaccctgttttttggaacagaaaatctacacaacagtgtcatgtcccaacgggataaattaattaatgatgcaattcatttaacaaatcagagtatcaggccaccacacacacattacttagggctggtttagttcgcgaaaagaaaattttttggtatcacatcggatgtttgaccgaatgtcggaggcttttcggacacgaatgaaaaaaataatttcataactcacctggaaaccgtgagacaaatcttttgagactaattaatctgtcattagcatatgtggggttactgtagcacttacggctaatcatagactaattaggctcaaaagattcgtctcgctatttccaccctaactgtgtaattagttttttcatttatccatatttaatgcttcatacatgtatccaaagattcgatgtgatgtttttggggaaattttatggggaactaaacggggccttatcctctggacctccgggaagctcatcttcctcccctctctctctctctctctccttgttcccctcatgctcgtctttccccctactccatcatgtcggtgaaggttcgtgcaaatccaccgtgtatgtcgacctcccccacactagtgttgctctgggctcgatcccccttctccttgtcctatgcttcttccactttgatggcgtgccctctgtcttctttggagaaaggaagaggatggagatgatgatgctgacaatggaggatggggagagcttgccatggaatactatgtaggtgatagggagtacaagcaaggcaggttccttgccagcgacgatgccttttagctctattgctaccggatttagatattgtctttgtgtgtcttctcttttgggatggatggatggatggatggatggatggacggtgcgaggcatagcatggccgttgccgacaacgccgatcaggtataatgtcggcaacagcgtttctagctccatagttgctagacttgaaccttcttttgtctttgttttttgttgttttggatcgatggatggataaacagataaatgggttgtttggatcttggttgcttttagggtagtggtggtaccagcataccaaggatgatactagcacattaactgtgtgtatcaaacatgatacctaagtattaagcatgatacatctaagtatcatctctggtgcatataggtatcggatatggtacctggtacccagatatggtacatataagtatcatgagtattaagcatgatatatctaagtgccagctctggtatatataggtatcatgtttggtactcatagataccggacatgatatttgataccagatctgatatattccagatctgatatatataggcatcagatatattgtgtatggtgctagcctgctaggtcgggccttgtacctcacatcagaaacaacactagcttatttttcagtgagtggtggctacacgtggtgtcgacgggtggtaccatgactatggtatttagatggtatggggatcgtcggtaccagggtatatgcgagattgaggtaaaagagatggagacaaggatttttatacaagttcgagccccttatttaacatgtaatacccctacatcctgttggcctaaaccggtgttgctctttattcatctgaatcacacaagttcaatatttgggataacctatctagttgtcgtcgacttggcggcatggataaccaactcgtagttaacgacggggtagtctcctcctcgaatatgaactcatcgtgatcagagatggcgctagatccctcttgccggcctccgtaggcaccggatggggtatatttaggctaatctctgatgtcgagatctgccagcgtgtgttggcttgcgtatatgttgtgtcttgttgatctgtcccctcctcctagggggggcttgtatttctacccatagatgcccccttgtccaagtagaacttgggagaccaatatggatacaatccgagtagtccttgtcgtttccatatagaactctatttgtccttccttatccggaacttcttctatatacgaggtatgattccgtataaggcatggtatgtggtgggccctaccgagcttagttgatcactattgggtatgtgatatccataaccctgacaccatggccttacgataggagaccgcatgcgatgtcttaacaaaaagaaaaaaaaaggtagcgtgctaggagactaaagcttggtgtgggcagattcatttaactatcccatgactctcaatccctcaagggatcccgtgcgctagcggttctctttttggaataggtccatccaagttgcttgtttggttgaagagggatgggatggtcctagtttttgtttggttggaggattaggtgggatcaagtcgaaggcatttgattgagcacattgcgagtgccaagcgtcgcactgtcgacctccgtcgagcttcgtcgggcgccgccgtacatagtcatgctcctgcaggcttcgtcgcgtgccactgcacgtccgcaagtcgcgagctccgtcgtgctcccgcaagctttgtcgcgcagctgcacgtccacgagccaggagctccaccgcactttagcgggctcgcgccgtcaagctctatcccgcgcgtcaccacccgtctgcgcgctaggagctccaccgcgtgccatcaagctctggcccgcgcgtcgccgcacgtccgcgagcaacgagcggcggcgcccgtccacgtgttgtcgagcttcggcccgcgtgctgccacacgtctgtgagtcacgagcgtcggcatccatcggcgagccgcaagcttcgccctatgtgccgccccatgtccgcgagccacgagtgtcaacgagcgtcgatgagtagtgagctccgccccgtgcaccgccacccgtccgcgagctgcgagcgtcgacgagcagcgagctcctccccttgcgccgccatgcttcccagcgagcttcgcgccgcgcgcccgtccacgagtaacgagctccgtccatagttattgagaccgggccggtaatcaaaccggtgaggctcttggttcaatggttcactggttcaaccaggtgaaccactggtctgacccggttcaataactattaaatgcattactcattctatcaaaaacacaagaagcatagtaacctgatggttggcgagttaactccctcctatgtggtcctgggttcgaatcccacctacccatatttttcctcacttttcccccagcatcacccatgcacgcgtgcccatcccacatacagcagccacgagaccgtttttcccccaccatcacccatgcacgcgtgcccatcccacatacagcagtatgagaccggttcagcgccacgagaccgttttcccccaccatcacccatgcacgcgtgcccatcccacatacagcagtatgagaccggttcagcgccgattttatttccggtttaatagcggttttacctcaaaaccgggcggtctcaccggttcatggctgggtcgattgcatgccggtcttttacctggaccagaccggtaagggctctggttccagtttttcccgatccggtccggtcttaataaatatggctccgtcccgtgcgccgtgtgctgcccagcaagcttcgccccacgcgttgccgccctggggaagaacatgggagagaaacccaggtgggttcaattggtccgggagattttggcggatgagccaaactcggatctgagaggaatatttccatctgggttcaacccacttcatgcattccttctgacccgtcccgcccctgcaaccaaacacatgctaaggtactgagttcaaatcttcataggagcgattttcagactgggttgtttgagggctaagttcctaatttaaaaaggctacatatatccggttgtcttgttttgtatctcgagatacatgtaccgtgaggtaccaatcttaatccgtccgttgattgttgagggatacgataggacgtgacaagtgcgcgacacgacatgtggtcccaattgccaaagttttttttagcggctagcggttgtgtcatcgttcatccctattagatccattcccaacgccacactacgcattcgtcggagctgcccctgttgccgcatctgcatccgccacaagcgccgccgccgccagagtggtgtgtgaaggtgcacttaaaccccctagtgggttttggtgattaatgacaaggtggttaaaggggactaacgtgtttatcaagtttattcacaggagtttagtcccaaagcaagttgtgatggctaagaatgcaaggagaccccccaatttgaatgttcctaagtgcgaaaaacaccgaaggtgattagactaggtctttcactttcgaaattgagtttagaaaaaaccgtactataaagaggggtttcaagtgtggttctagggtattcaaagtgctctgagtcatatccatgagtctaaaggtttttggaatcttttttggaaatgtttttccccgggacagagaggcctacccggaggttctggccggaacctccggacaccaaagtttattttctccccgggacagagagggctacccggaggttctggccggaacttccgggcaccgaagtttagctagattttttcctaagtgctgcccggaagttcctggcacttttgcccggaacctcctggcaggtttccagttcaaacttgtgagtaacggctagatgacgtcacctagccgttatatatatggatttcgtccccaggtcaccctttggccattccacttcagctctttcatgttctagggttttctagccactcccaagcttcctttgcttcctccactcaaatctagagcctatcttgtgagattgagagattagattagagtgtaggagtgttttggagatggcttaaagattaggtttgtttgagcactttggataccttgtgggctgtcacttgggcttattactcttggagatcttctcctagacggttaggtgtcgcctgtgagcttccaaagatcttgtggatgtcccggaaaagtttgtgaaggttttcctcacctccgcaaggaaacgaggtaagtgagtaaagattcttgtgctgagttttcagaggttgtcctaggtagagcaacttgcacttgtggtcttttctagaaggaattgtgagttggatcttggtggtcactcaattctagaaaatgacctagaagtgttgagttgaaggctgtggacttcttctgggatctttgcataagtgaggcaaggggttaatcgagacccggctctttgaacacctcaacggagagtaggatccgtgtgatccgaacttcgggaaaaaatcgcctttgtctctcttgtgcatgatctgtgtttgaatctgctggtatcttgtgatttacatcttgtgctaccttgtgcctgattgtctctagctaggacctgttttacatccccgatttcaattttctctgttgcccggaagttcctggcccaagaactccggaagttccgggctgctcatcactgccaggaagttccggtgttcttcaccaggaggttccgggccctggcccaagaactccggaagttccgggctgctcatcactgccaggaagttccggtgttcttcaccaggaggttccgggccctgttaaattaaccgctgcgattgttgagaaaatttcaggaaagcctattcaccccccccccccctctaggctacatctctgcgcattcagtgtgcatccactgcaagggccgccgccacagctgcaagggttgttgccgtaatggttctcgctgaagtgcattgtgacttgtcgccgcaaccgccaaccttgttgtcacggcaaggagacgttggatctggcgctgccaaggtcgaggggaagccaccgcgtcgcgtgccgtcgctactgccgcaccatcttcgtcgctgccttgcgccacccgttcttcgcgcctgaattgagaggtcatcgaagcccaccactgttgtcctcgctcgccgctatatttccggcggcgagctccagcagcagcgaggtggaggagagggtgtgggtggtgttagaagtataatatgttagttagagataagagtcaaaaacaaattatagagataagatatatcctaaagataagatagagtactagagatagaatcatagagataaatctatttttatttgtattgtactccaagtctctatcctatatgtactcctatatatacctcatgagagggtcaatgtaatagatcaggaaatatcagaatacaacaattagatttttctatagatggcggctgctagggttcgttgtcgcccctgagtcgcctgtgcgtgggcgacgcgatgggaaagttaggttttgtattttgagtcatcgtatgggtgtttgtcgcgcttattctgacctcaagctacacggcaaacctggcaatcaatgctgacggtccagcagctccagccagcagcaaccaacgtccaagatctcctaagagacagcaaacgtcgggtatcaaaagggctacaccgtggtgcactggcttgaggaaatgggcttccggaaggagagaatttgtgcggttatgcctcgttgggaggagtatgatgactcccttaggaggggctctaaaaatatatttgacttttaactatttattttatgtgccatatgtctatggcatatgaatacaggtgataaatagttaattgttatatctaagagcgataaatagttaaatatctcgaaaatgggtttttttgcggtatctactgtatttgacgagataccctacctgaaggccttcctctcaaattattgtcaaggttacagcatggttggcccgacctaacaagttgggaggcttcggatttgtaagtctctctcgtctgttaaaatacttcatcatctactccagttaatttactgggttagtgaacaagatttgatcaattttgtgatgtgtttctttcaggcatttccgataggatcgccgattgtgcacgacatatatatagcaagccttcatgctgccctcggtgcaggaggagatggcacggatagataggaaatggttcggtgacacacaatccggcgaggctgcgaggcaagagcagctgcgtcgactcgtcatcatccagccttgggttcagaggtagatgtgttcttcatggaggcgacacgttgatcctttgaggaatggcattggtactgcaagtcaactgaagaaagctagattaattagatgctacggctggtgatcgatgaatcaagcaagaggaactgaggaagtatcttttttgaaagagcacgattggtacctccatttcaaagataaatgctagtagctgcttctgaatcttatgcaagaatttgagagcatcctagaaatagatcgtgcataaacatctactagcatgtaatgtgatgattgcgtagaagagcttcagagcctcagaggtcatgtgcggtttcgagattagagaagaaacggcagagttgaaatgacttcttgatactccatgggcagtgcaattcttttatactacaatgcgccgtaaaatgatgccaaaatatgtaattcagtttgtgaaaatattgacatgattttttcatgttaacaggtatggatactttccatcttttagttgaatttacaaagatttagagaatatgttctctaaaatagcttgtaagccactgtctcatttccagattagaatatatagttcaggttcagaacaattattctctccttttaaatataaccactggcacggtatctgtgtatttgtgtggctggattttaatattatatacatgttcgatttagacgctttggaacactcttcaatatttagaatgtacatgtcttagttgatttaaatgctaaagtttatatctagatgtaaccagatgatcataataccgattaacaaaatcatgatcaaatcatatgttagattgatccttcaattagttaattaaggctgcgttcgttcgtaaggtttggttgggattttaagcggcacgcgaaacaagaaaattcattaatacataattaactgagtattaattaaagtaataaattttagaaatcattactttcatggtaaaaaatggtagaaagccatattgttataacttgtgacatataaccacatgtttcatggtctaagtattccattaaatctcacatttattcaaactgtaattaattttatcatatgtgaaaaatattgaaagtagtgaagagttaaatcgtagttaaaatcaacaattaaaaattccatatagattatattttaaaaacttaagtaaatgtgtgctaaacacacacacacatatatatataggagcggggttttataaaaccataataaatgagttttatataacaccagtcataatacctgttatataggttgaacggtttactgaaaatctactcaattgatttatataaacttaaaaaacagatttaaattaacttttttttagaaataacttctatataagaaaaggttctacatgcaatacatcgtttagaagttaaaaaaagagaatgtttgtactttgtagaatgcaatactcttctttttttggaaaaaaaaaagagagaaaaggttagtcaattaattaacggattaatttgagaaggacacttgggcgcattttgttgatataaccccagcccccgccaattccgatgctccccctccgtctccagatctccccccacccacattccccagcacctgtcttgctccggtccatgtagagcaccccgccttgtcggaaccgcgagctcgaggagagagagatgggggcggagaccggcgagcccagctccttcctcaggtcagcttcttcttcttctccttcctcttcttgtttcagctctcccctttcccccacctcttcttcttggccatgttcttgttgattgggaaaagaacttcgtaggcggcggatgaggctcgtcaagatttctgttttttttttccttttctttgcggtgatttcgacagccgctgtgttggacttaccgctgtagcattcggcggaggatgtttcttgattcattctgaagtctgaatccaagaaaatgaggggaaatcgctgcgtcggctcgcgggctgtagcattcggtgattgaattgattgtttcttgatttactgtgaattacgaatccaagaaagaggggacaaaaagtgtattccagtgagtgatggttgcttgagatgtcagtccccttcttcaagacgcaaacacgtgcattatgcatacatcgatcaagacctgccaaggcccaaggccatctcccatctggcattgcaatgaggcaatgagcattctgcaggctaatggaggtggcagaatggtttttttttccccttaagaacatcctgcattaggctttagagtttacaagtacttattttcacttgagaaagcaggttgcttcattacttaaaaggaataggtagtcaactatctagcctcgcagtgtggtgcaattctactagtatttttttagttaagctgcacggatgcctgtgcatgatgattaaataaaacgcgctagatttcatcatcccgagctattgatataatgatattgccaaagatgccgtggggggaatcttcttgattatttaattattggaaactagagaacatcattactgcatttgttatcatgtcatcaattcctgagatttaagctctgattgtttggtctactgaccgataaacgtggaaaaataaactgagcaaccaaaaacaatttatgggcaaaatgtttataactgtgttctttacagcttaaaagccaatactagaaaataaactacaatgaaaaaaacctcaaaatcaactctaaaattaagttttaaaattcattttttgttgtggctaacaagacaacaagcagaagatgagaggccagccacaaatattgcagttttctatacatttatggatctgttggttcagacctaattgaagtaggaaatgtattggaagttctgaccatttccctctttatcttctcttgcagcttatctgctgccttctcctatggaattgcatctatggcaatggtattcgtgaacaaagcaattcttatgcagtatgctcactcaatgactcttctcaccttacaggtataattatgaacaaacatcagccatcattcatcagtgacaacaaaaaaaaagttattttttcctatgtttgtctgagcctgattattttgttcaatatcactatttctgcagcaaatagctacagcacttatcatacattttggtcaaattctaggagtgtctaaaagaaaagatttcagtatggcaacaggaaggaagcttcttccgctgtcgatcttctacaatgcaaatgttgcatttgcgctggcaagcctaaaaggggttaacattcctatgtatattgcaattaaaaggctcactccccttgctgtactggtggctgggtgtttacggggaaaggggaaaccaccaacacaggtgagtgcattttttttagtcattttatttcttttctccactaggttttacagagttatggttttactttacacatgccaatgcctacccaagatgttacttttggattgtgaaagtcaatttagtggcattacaaggtgaattgtcctaataaagttaggtaggatatttcgatagaagtcccaattcaagattttggccttctaagatggcgtcatcatcaattcatactccccttccccgcaaaaaaaaataaataaatcatactcccctagtttttttgccagtcagctacttgagggatccatatgctgcttataaaatcacgagagcactaaacaacattgaataggtcaacttaatgttgccactgaattgcaagatttaccatgcaatcctttgaagattttcaatggactcaactatagtatattagtatccccttgggaaggaatatatctttaccaccatatttggctctttccttcaaaaatattttgctcttcctcactactacaaatttatttaggtgtccctttcagtcatctgcacggccgctggagtccttattgcagctcttggagatttttcctttgacttgtatggatactccatggctctaacatcagtcttcttccaggttgtaatatgttcactattgttgctctcagataattgtttggatttctaactgtaactgacaattgagtgtgtatgcagacaatgtatttgattcttgtggagaaatcaggagcagaggatggtctttcctccgttgagttgatgttttataacagcgtattatcactaccctttctgtttttcatcattatagcaacaggagaattcccctattctctttcagtactctctgaaaaggttagtagtaccaatacaggcttatcaaatttaagtaggacatcaaagatagcaatctgttttgcagtgctttcctggatccaatttcctaatctacataattggtgtcacttgcaatgcagacggcctcgctaacattcagtgctattcttcttgtttcgctggtgatgggtatcgtcctgaatttcaccatgttttggtgcacgatagtgaactccgctctgacgacaacaatagtaggagttctcaagggtgttggatctactgtaagcagttctatctctaaccaaattactgaaacaccgtgttttcgaagttccaaaacattgacatcttataccgtctcacttcgtcggctctttcagaccctgggtttcgttctgctgggaggtgtggaagtgcatactctcaacgttactggattggtgatcaatacatttggaggtgtctggtattcatatgcgaagtatatgcagaagaggaagatgccaaagaggattgcacctgatgtagaggcacatcctcacaagtaacatcattcagtagctctgaagcatagatatagtagctatgtagttaagcttcatctttaagcagataaattattgaaatgccataccagttccaatccaatttttacctgactcccattctaacatcagcaaaatagctggtgcagtgaaggaagctaattaacttttttttttgtgaaagaccagttgatcacctggctgtagtgtactccaacatcagtcccagtaattcaatagtagtaatacaggtttcgcatggagtctttatcttgtatctttcaatccaaatttcagttgacccgcaatccaaatcagcctgagcaaagcttgcgtcgaacagagagtttcagcggtttagtagtagaaatttcgcacaaatttcatatagaagtagaacagacaatttctgtgctgccgaacaggagcagtagaacagagattaattactattaccagcaagcagtagaacagaatgaatgaaaaacaatttcagtgttcctcctgtgatttacatatacactcaaaaacgagaaacatggtgtactcgccgagacgctagaatttgctcggcgagtcaaaatacaacaatatgctactacgaggtcccaagctgttgccaacaatatccaacacaattacaagtttacaactggattaacagcatgaccaaagggtaaacaataatcactaagctaagcctacagcaacacaatcaccaagaagaaaagaaaattaacgtggttactatctatcattctgtctccaagatcctaactcccataccaccaatgatgctttcaccgtgttaagttgagcttcagcatttcacctatcaacaatcagttacctgtcaacccaaactctgaagcgtgatcatggaacgacaacaagcagaaggatttgcagcgcaaacggtgatttcacagtagcaaataatgtaagctactctccgcttagtcgtcatgctcagctgagaagtctggct

SEQ ID NO: 9489 - DNA, 15818 bp, Oryza sativa
tagaacagaacaggtcatagaaatacccaaataaacagctgttgatgttatctcgtaaaaacaattctaattaatgcattgcatgatattattggaagccttgtttatatcagcttccttcaagacaaaaacccaaacatctgctatttaaatccactatggtactatcacacatcagttcgaatacaatataatacaatgtaccaggaatgtgctgcgtgagtgcaaaaatataagattgttacaggggaaaaaaaactttatgcatgttcaccattattggacaccaggaaaaatttgtttcaccattcctaaagccatagtcaaatgttatagaagcaagaaaacgaatcacaatttgcaatgaacaaacttagtattggcgatatgctcacccaaagcctcaataaatatatattctgttctttttaaaaacaatactttaaatttgcatgtatataaaacatcataaaatagccccctctagccctagtgacgaagaaataaggagttacgtttcatcttgcaaacatacattttctagtgcttgcactttttttaggcaaacaaaaaaaggagtttgtagcaatgcaaaaaataataataatcagaaattaatagttcagagggaaaatgatggtatcaccaccaaatctaggcaggcactagaaaatagtttgacaaaagcaagtaaaattacaatacagaaatttgttcagaaaaaatatttatatatcagacaacaaaggaatgggatatcaaaaatgaacaacaaagttacttcataactaaagcattttaacaatttgtaaatggagtttacaccatgaaagtacctgcacatttccaatcaaatgcgcaaacaagacgagaccaagaactgccaagaatatagcatacagcgtctcaccaatataagtactcacagtcagagtctgcccatagcaactgtttaacaaaaaagaatcacagtgcatgttagaatatattagaatcttcatattagctattattgaatcagatcataatagttcaaattaatcagataaaaattgtaataatgatgggacttataattgtatattcttttgctttaacagtgagcacgatgtgtcttatattcaaatttcttctccttaattacaagtctcagagaagatgtgtttagagtcaaaccttagattctgcaaaccccaccaaaggcaatagaagaacttcttcaggaagccctgatcgggagcttgatttgataataatggtgtgaacataccaaagtcaaaatcaattgttttgttagtggcatcacatttattgaagatagcggtgctgattttccaatttgaatcagactgtatatcacaggccaggtatctgttttggcagcccgcttctttgctacagtatttttcccaacacgcggtctggcgatcaacagatagcaagtaccataatgctcctaaaacctgaaaaggataagtgcatcttgactatccaaatagcaaaacagaagaaaacggtagcacaaattcgaagtaaccatgccagctagtattaaatggcgaaaggagtaaaattgtagagaactcgcatgagtaccgtacatgactagcaatcatgtataatagaagattgtaagcagctccttgccaagccgtctttgaaaatgctccggtaacttcaacaattttagagttcaatgaaaatacgaggtataatcttagaacatactgaaaaagagcaatcagaagcagtatatcatcgtcatgttctgacaaagaatatttgacggatggtatcacagaccagatgatgatctgcaagaaagggagaaatatgtcagataacttctatacctcgaacttcaggtacaaaagtgcagatgccctttttaactaatgcaagagaatgtaatcagttgcattaaagaagtaataatacaacactaaaaggacttgagcagcctatgtggattgtttcacctaaaagacacaaagatttataacctcgcaactaaagcaggaaatatcttagtatatgaaatttgagatccaatacttccatgtttggtaagagcgttcttgctagcccaagctttcaattatgcaatgaattagatggataaaggctcaagttatgtcttgacagaaaaacagggggaagaaaccaagttacctgcggtagaggcaaggaagccactagatcaaccacaaagctagatctcaaataatgctttgcgatattaccaggatctgtgacaaggtctcctcgactgaaaacccctaacgtggagcttggattaatatatgcagtcctgaactttattataatttgaagaacataaaaaaggtcggtaattgatcggaagacagtaacgatgatggctaggcgtgtatctctcccgatacatgaattcggagtgccataatagattttaggtacatagaagtacagtggatccataaatagagccacgaagcatgcaatacggaggacatagttccatgtcaagatgaaatcacttgatgggtcaataattttcttgtaccaaagctcattccctgctagaaaaatcttgttcttctccgaaatccccaggccaagcttactagtagctagcccagcctgcttctggtgagtgggtatagttggttttgctctctcctcgtggaatctggggacgaagacagcattagaattcactcaaaaagtaagactattattaatttgctagattcttttatacaggagtagagagagaaattgttagagtgattctaaaagcaagaaatgatcagcaatcagcatgacatgatcttcttaggcttatcagactacctttcccatctcattctcatttataaatatatctctaattgtgctcatcaaagttaagcctgaagttagcaaacaacttgtgggattcactacaagattatccataatccaacacaagaaattaaacctaaccatttaaatcgaacataactataactgatgagctaaacactagtccaaaaatacagcagtgaccaactgaccaccaccagcaaccaaatccactcaagaattcatcttctcctcgcaagaaatggaattcttcttgaattccccactaataagtgggagaaagactgcccttgtcatgccttcacctccgcgccccccaacttccccccaagctaaaaacaaactcaaaactcaaagaccccgattccccaaagcaaagcaagtagtagccgctctcacctcacggtcctctgcttcctgagctccatctcgtccttcaccctcctcgacccaaacatgggcttacctccgccacaaccaaaccaccaaacaaactacctcatcctcctctcatccatccagcgccggatccttccccgcgtgagccaccagaggagcaggagagcagagaccgcgctgaatcggggagctgcggcggctgtcgggatcgagcgggagggagggaggccgcggccgccgcgcggagttcgaggaggggaagggagagggaggaggaaggcgagcggaaaacgaaaactaccgtggaaagggggaagacgatgggggccttttcgctgaagaccctatgatatcgtatatcgtatgtgcagatactaattataaatattaaatatatattattaataaaatatatttataatgttggactaattcgcaagacgaatctattgagcctaattaatccataattagtctatgtgatgctatagtaaatattctttaattatggattaattaggtttaaaaaaattatctcgcgaatttacttttatttatgtaattggttttgtaagtagtatatatttaataatttaaattagtgtctaaatatagagattaaagttaagtccatgcatccaaaccttactttattattactactaaccgctgttaaatcggtgggatttggggtaaatatcgcggttagtgtgctgacatgaagggtgaaggtgtgatttttagtcgagtagagagattctttcttttggtctgctgcttttggtactactccagtactagactactagtactagtagtagtattgattgacacggagacctggtcaactactcttttgttaaaagaatgcatttttaggctgtgatggatccgtgtggtcatatgagcctgtctgcctgtgcatacgcatgtgaagttcattttcttctccaggctccaacatataccctccatccaatctaatattggatgtatagatttattgtattaaaaatattatcttcaatactaaaactgaaatttatgggacgaagggagtaagcatctgcattggagataatattctctattataacaatagattaaatattttgataagtaaattatttaatctattgtttcaatattttattataactaaaatatacgctcgtaggccatatctgaatcagattattaattttattataacaatagattacatattttgataagtaaattatataaataatttaaacaagtgatatgctcaaacaacattgtactacattcgtttcatgctataagtcgttttgatatttttctaagtcaaacttctttagctttgataaagcttataaaaaatatagcaatacttttaacataaaacaaataaacttcaaatgtattcaatgttagattcaataaaactaatttagtgctataaatgttgctatatttttctataaacttaatcaaactttccaaaagtttgattttaaaacgatcaaaacggcttataatatgaaatggaggaagtagaaaagagttcattctgaaaaggtattttaaagacgtggagcactccattgtaataatctggtgaagtatctgaaaaagaaaataatatgacccccaagttactacatactccatctttctaaaaaaaaaaaatccatttctagatatgtgttctcgactctatgttcagttgtttcccaactaaccaaagagtcgggggctacacaaatataaggctcaaaatttgacaaattttatataagccaatgagtcaactccaggagtcattatcttcatctttgcttcggaacagacattctacttcaacaacttcaaatatttcggtttgaacgagttggacaacaacatcaactctcctccaagtgaagcatctacaacagctataacattaatttgatggattattgtcactgacatcatcaccagcacctctgcttcatcgaccctgacatctccgctgttgctaatggatgattatgttttcgccgacttattatttcaccttcacggttgacctactatgcaaatgctgatgagtgtcttttgtcattatcattggttggtacactgctattggctggatcaccgacatcgtcttcttcatcatgtcggttgcgtttgtcgtcgtcaactattttcttcatcttcatgattggtggattttgtcatcacctttgatctacctcgtctgtcaccgactgattattttgctgccatggctacacaattttgtcgctgggttccttcatcttcattgttagttgatctgtctgccgccgactggtttcttccctccatgactatgcgacttcattactttagattggtatcactatcttcactaccaccagtattgttgccacctctggtgggcaatattatctctatattggtcgtcttgtctatatgccaactgcgtcagctaccatcaatggacgattgtgactacgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattgttacacctattttggagtatcccataagggataatcattcagatcagaagctattcatatgagctacacttggtctatattacccggaagatttattactcggaagcatgttacatgcgtcatcctttaaagggtgtcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacagtgcatcttaaaaggtgtcaaacagtaaagctttatatagctgccccgctgactttttaatatagtcatggtgctgtttgggtttttaagcaattgattggatacaatatcgttgcttttcgccacgtaagtgtgcatttttattgaccaatattatggcttaggctgattatatattgtggtcattttctaggcggttggtaaatcctttatgagtttatttactcggattttataccacatatgccatatatttccaggtgtggtggaaccatgtgtcttctagggactcaagcacatctgttaaagcagtgtgcgcatggcgtatgcccaatactttggaaatttctttattcacaacatacaagcttctttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaagccactcggttggttggattatttattccttgactatatgcttggtttgttcacttaaccgcatagtcgagggctacacctattaggtgcatctagttgatgcatctgactttatttttcagccctccacagtcttcatatttggtaaaagtacttcggagaccatggcgaagatgattgaagcactcagctttggagtaatctagttcgagagaagattatcttttcgactgtgaaggtctcaggggctactgtggagattatgggtaccccatacccacatggcatagttatccgactggctataggggataacttatatctatggaatatgtaacagatcatgacttgggtattacgtttccttgtatgttacggaacggcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctctgcatccatccacttttaggtctcgtgcgctacctccttttattattgccgaattcatgtttcgacaatatgaatctggacatatgcgtgtctaacactccaggttcgaagttagggtttgtcttttttttaagacggagtagtacttcccaaaatataaaaatttaacatcggatggaactttttttaatacaatatatcggcggcagagccccagctaaggtcgacaaaaaaaaagcaaagggatcgtccatcgatcatcatctacctaatcctccttcctcgagccgtttgtttattgagcccgtttcgatcgggataatgtcctggtgcgatgcggcggcgcctcgcatcaccaacccatcctcctttccatactctactttcttctccccatacatcatccatccacgcccacctgcatcatctgcgtgcgcggcaccaaccaaaccacccggtcgtcggctcatgtcccgccgtcgcgagtcgcgactcaagagagagctgtttggatttgaacgcggaggaatttgccccgttttcgtgcgagattgtatcgattttttttcaggaacgctacgtatcgtgtgccaaaggttaacccgaacggcgcaacggagaacagcgtcacgatcttgggacaattcgcgcaacatgaaccggtaggcgaacggcaaccaacagttgatcggcaagaaacgtcagctttcttcatgtcaccaccagccttttggatgtgctcgtgtcttacactacagtgagcatcttgacgttgatggtcggttaggcatcttggccacacaaccaaccgagtcgggataatgaaacggcaatgcagtgcaaagggcatgcgatgatatgaataatgatcacatttcgacgacgaaatagaataacatctggcatttttcacccgtagatccctaagaaataaccattcaccacattaatttgacgaacaaatgctaagcaaatgaaatcaaacgtcggggaagcaatggaaacgaaggcgacgtcggggaagcagtggtggcgaaggctcttggctagacggcagcacgcagggtaggctgaggcaggctgagcgagtgcagaaggaagatcatggagagcaaaacctctggctgcatccaacaaaatcttaagcaggcttgcacagatacagtgcttgctgagctgaaatcggccttgtcaaaaagcactcctctggtgacctcatttacctgccacaaggcgtgacggactgggcaggggtgtaaatcatccaactgaatactgcagctcctcggattgcagattcattttctggagtctatgcctacgaagaactttgtttcaccaatacttccagatgctgcacttactgttgttccgaagacaatatgaccaaatttttattacgataaaagaaggcgattactgttttctgatgagcagcatcttcaacgaagtatatggatcacgaagaggtgttgtaggcagcaactaatggggctgtatgacgtttgcatgaagcaggcgagggcgcgcgtagaatgaagagcgaagaacacaaccacgaagatataactggtagccgtagtcggccgagtcgtttaagcagtgcaggccgatgccttattgacacacagaaagacagttgaacttagttgaatacacatccaatcataagtttctcgagtaatataacttcaaacacaaagcataataaggtagataagttatgagaaccttaatcaaagtccagagttgatgatgatatttggagtagggcattgttcatagctgacaacccacaaagtaacatttgtaacagcagtctttagacatcaggttcagctctaacttctgctgcggcgatatctgacaccataaatggaacatattagagattgtcgaagagcgaacgatgaaaatggttaactcagttagaaacagtaaaatgacaactgcttactgaaatctgcattacccgttatcataggcaggagattcatcacggccacggttgtattgtggtgacctgctatagctgcgtgcacgagccggtgacacactacgacgccttggagagcgccctgcagggctgtaacttctgctcacatagcaaatcatttataacattatcagatatgttattcttcttcgtgtaaatatactagttacatacacaaaacagggcataaatgctacactattctttgctagcacttactatcctagatgttgggaaatggcaacaggtggataaatactgaatagaaaaaattgcaagctttatcttagtgtttgtaaatttggaccataggcaaccctaaattaacaaattgtgtgcatgtcatataatgttttacaatgaatacagaaagataacttagttgtatcaaagagtgagtagggttgcaaaccactaacacttcacatccatagcagaaccaacagtcccaacaatggtattgtgaccattaacttatagtaacaaaaagcttttaactattgcaacagtgtaacagttatttgacattttgattaccttctgccatagcttggactcctgcggtacctgggacttcggctgcggctgcggctcctgctacgacgccttccactgcctagacccccggaaccaatcctcaaacggcattcacgagcaaagtgcccagtctcaccacattcataacacttgctctcagagctaccatatcgatcacggccaccacgaccactgcttgcattacgagacagctcaactctccatccattcttgcctataaaagaagccatttaaaaattagaaattcagagttgtcactactgtttgttttacgccttatcgcctcaccccacttcccccataaatgtaggatcttgaccctcttgacaatgtccaaacagcttatacgtccaagtgattaatgcacaaacatgaaattgctctaacataacagtgcaaggaggtgttttggtggatgagagagagggactgggaggaaaagcataatctaaacagcaggccacatcacattcacataattctggtactaaaacaaagtatagatataatggtaacacatgttgtcactaataggcatatatcatggcctttgaaagaagtttaactttcacaagatatttttgcaagcaaagaccaccctgtaactcaccaaaagaaaatcagagcagaaagattctcagaggtgatagatccaactgacagaggctatgttctcataaaagcattcacataccatctatatcacgaattgcatcctgagcatccctcctgtcatcaaaatcaatgaatgcaaaacctggtggctttcttgcgacccatacactgcttgcacaaaacaaaaataagcaaactgcatcaggacaatcagcatcaaacataatttgaattgtgggtgcaaaatacaaatacatggcctcaggtaagaaacttattggcagcacatcaagaaaataagaaaaagttaggcaacagaaaaaccgtaaaagcatctccagcatacagtaaattagccaaataagtgttgtagatatctgaatgagttgaatttgtatcctgataaaatctaatccaaggtgcttgaagtctagtgtttggttggaggccattgatgtcaggtagatgggtacactgcaatctaaagcctggatgccatagctgggaagtaattgtgctctagaaagatcaatacatctcaaaataaataaataaataacgacttgtaataagataatcttgagtaaaatgaatccatcaaattccctctctacctcttctattacagtaaaatctactagggtcggaacaggatttcagaaaagcctacaacatttaaaatttcaccgtgcactgctggtatggccaatcgtcttccccaaaagttacataaatgtggctgcataggtcactcaggccctggccctagaacgagttttgctgttccgatggtgggctaaagctatgttcccccatatgattccacatgcgcacgcagctctagcagaaaaccgaaacaatcgcacacaatacataccacaggtggggcgagtcactaacctccgaagaactccaaagacgcggaactcgtcctcgagctcccgcgccgtcacgcggggatccaggtttccgacgtacacgcgggccatcgcaacctgcacctatcaaatcgccaaaagaaaacaaaaatacaatcggattaaacaacgaatcacaaaaacgacgtagagacctgccccccgagaccgatagatctaatcccgcaaggggccgtgcggcggatctagggtttgggaccggggaaatcacgaaggaggggaggtaagaggggggaggcgagaggcgggagcggatcacccacctgctccggtcgcgatctcgatggacctcacggcggcggcggcggcggcggcggcgaggaattctgcggcggcgcacggagaggagagggggtggagtggtgggtgggcgagatcccgagatggagagttcgagaagacgggggagagatgggatgagatgatatgtgtggggttgggcttgtgcagggaaacggcacgcggtttgggcctgggtctttgggcccgtggactcatagtgggcttattgttttcagtttttttggaataagttcactctcagtacctcaacttcagatcgagtctacatgacgtccccctaatcctcaatgttagaaatgttgacccctcaagtattcgaaaccatgttaaataagtcccttagcaatatggaccatattatcctcggtttttgttgacgtagcatatgtcgacgcacacttgtcaatgaccatttccctttcacccccccctccctcccccctctctctctcaatctctcctctgtgctcatatcatcgggcagcgcccagcaacagacggtgaggaagagcagccggtgaggaggatggcaccaccgacagcagcagctccggcaccctcgaccgctcgtgaactcattgccctccaccaccaccagctctgcacatcctaaccaaaccttgccgtgctaccgacacctcatgtcgcctcgccctctgtagcctcccactcgtgttccacgagctagagtgggatctcatcatggttgccggtgccggaggggtagacgttgggaccaccagcgacagcatttcggcttgacgagctcctccctcgcgtctgcctgccccctccctcgtatcctttcacgtcgtcgacctcgtcaacgggcggggactctacaatggcgaggtcggcatccacaaggagctcacctccaactcaccccaccgccgaggtagtccgatgtggtgcggtgcgacgaccgccgcaggggtgttcaccgctacctccaccaagaagatgtgggtgaggtcacctgcggcttcagtgggtgcttgaggtggtgacggcggagctcggccgggctggccagggctgccagcggctacatcagcggatcggcttgatgagctcctctgcaatagcgagatcggcatccgcaaggagctcgcctccgactccctcgctggcgaggtagtctagagtggtgcggtgcgacgcccgccacaggggcgttcgcctccgccgagaagacgcaggcgaggttagctatggctttgttgggcgctcgaggcggcgtcgatagcggcggagctcggccgggctcgccggccacctctcccccccctctgccagcggcgacctcccgggctcaccaaagaaaggagaagaaagaaaagaaaatagaatagagaagatatgaagaccacacattttctcttataacttacatgtgggcctttttatcgctgactaggataccacgttagcgaaaccggagatacatactgttgtggaactctaattgcatggttttgtattatttaggggtgaagatttctggtattggagataagggatgtgaaacaaactcaacataaagttgagtgacgatcggtgaacttattctctttttttttttttttgagaaagagtgagagatagttggcttgttcggttgggccatctgaacatctatcttgcagttatgctagttgctactagtagttgtgtgattgggcagcaattgagatcccctgcagtactgtatgtgcagtactgcaaacgacctgcatccgtggttgggagatgagaatttccaatgtgcatggaaacttaaaatttgtgaccacaaggtttatagagtatagtaacaaacttagggcctgtttagatcccctggcaaaattttttacactgtcacatcgaatgtttggacacatgtgtggagtattaaatataagaaaaataaactaattacacagattgcatgtaaattgcaagacggatcttttaagcctaattgctccatgatctgataatgtggtgctaaagtaaacatttgctaatgacggattaattaggcttaataaattcgtctcgcagtgtacatgcggaatctgtaatttgttttgttattagtctacgtttaatacttcaaatatgtgtccatatattcaatgtgacacgccaaaacttttggccgctagatctaaacactccattatttatttttaagacttgtgagaagattgatttgactaccactgccataataggttggactagttattattaatttgaagcgaaaatatacattatagccaatatgatactatacattttgatttttgtttttttagttcatttttatttaatttttcataaaaaaaacttctaataacttgttcacatttcatccctatgtgataagcacagcaaatgttattgcacaagcaatagtagcatggcaagtggcaacaatgatttatgtgacttttttagttgtccagcaacacctaccaaaaattaggctgtgtttagatccaaaatttggattcaaacttcagtccttttccatcacatcaacttgtcatacacacaacctttcagtcacatcatatccaatctcaaccaaaatccaaactttgcgctgaactaaacacagccttaatactatagcggaacaatttcggtacggtggaatagtacgaaacagtttttgtgtggtagatggtggcctcatgaataaagtcgtgggtgtatgactccatcaattaatagccctgtttagagaactagccaagagttattttgagagctattttttagcacaagtaaatagtcctccaataaaataactctgagttgtttggatccaatagctattttgagagctatttggcttttaacgtaacttctcatggagagagataaagagaaaagacattttttcagtggccccacctaaaatagccccaattagcatctattgggggaagaaaatttggtaagacttccgtcctacgctcatccgaaagactttgcttcctcacacgacacctgtccaaacgaatcttagagcagcaagtctcttctcccaacagttctctttcctctctctcttctccaatctcccatcttcgtactacccggccggccgccggcaaggcatcaagcccacagtttgactggcatctctggccacggcgaggtcacagctagcagcactggacgatgtgttgaagaaagggggcgccaaggaggcgcagcggcatcgacctcgtgctcaacccaaccgccgtcaataggttttaaggtcaggcctaatcatttttctcttttgacaaccaggcctaatcatttactaggatgcaacgtatacagaggcttcacacacacatcgacatggcgacatctatcaatttgatgttttcccaagttctagtgcattgcaagttcatccattacctttgaccaacaacaatgtcaggtgaatattttccatggaagaagcatgacgggtgcggtggcaaccggaaactctgctccagaccttgcccccggaccttgctacgtctgaagatgctggaccctcggtcctaagagcgagttggatttgtcgccaagtccctggccggaggaagaagaaagggtacaaaagagatattcgctactcttaagatttgtgcggacaggtgtcgtgcgggaagcagagtctttcggataagcgtaggacttaagtcttaccaaattttcttccctcttgggtgggatagtttttttgggtgggctatttccaaatagctctcaaatagctcacccttttgaatctttttgagctatttgggctatttaagagagggctaaaaaatatctcttaaatccaaacagagccatgtcagaaatctcgatgcttatacccttcggaagggaactacggctggcttttgccagcctaaacctttattcatttcaaaaggttgggaacattacataacttttagttagtgtactggtgggagagaagtctcgaaggttgataatg

SEQ ID NO: 9490 - DNA, 3971 bp, Oryza sativa
aaaaaaaagaaaaaaggcagaaaaaacataatataaaggaaaaaaatgataaatataggataaatgtgaggaaaatttaggaaatatatcataaaatatatggtacaaataggataaaatgtggaaaaaaataaaaaatatgagaaatatatgggaaaaattagaaaatcgtaggaaaaataaatgggccggtgggccgtgccatgcctgggccgtgccgtgccggtacgctacagtaaacgtgccgtgccgtgccagcccacgggctgaggcatcggcctaaacacggcacgggataacgggccgtgccggcatggcccacaggctggcgtgccgggccgggcctgggccggctacagtactaccgtgctcgggccggcccggcttggcacggcccatttggccaggtttagctacgttgaacaaggtacatttgttgagcattgctcctatccagcaggtaccacggtactagccaggtaccaaatctcagccatttattcagctcgatcggacggtggaaattatccggtacctcaggtacaaatttgccaatgaggtggtaccggaatagatagaggggtggatgggtaattttgtcttttcgtgtagggatgcatccgattccggtcagtggtagcggtggggtctgcatccggtgggcggcggcggcgggatccgtatccagtgggcggcggcggcggcggcagctccgcttcccgtcccggcggcggctcattgcagcggcatctcccctgcccgtcgtagcggcggctgctgctccggctctcgtcgtggcggcgtctcccctgcccattgcagcggcggctgctccgcttcccgtcgcggtggcggcccatcacagcggcggctcccctgcccatcgcagcggcggtggttccgcttcccgtcgtcgcggcggcccatcgcagcggcgtctcctcttcccgtcactgctacggagcaccttcatcccgttcccgtcgcgactgtggctccacatccactcagcaacaacgaactccccagtgaccgaattcccgagctctgccccaaacccattgccgaggagcatccatatatccttgaggaagtcacggtaccagcgagtggagcgccttctttcctgcctgaatcaattgatacaatgtcatcatctggtttgctagagcttaagcatgcatgaaggcaaagaaccaccatctgcttgtgctcctgacactgcatgcggggcgagcgcgccgtgaggttttctccagtaccgtggccgccgacggcagatggatggggatcaaatcggccggcggggcaactgctccgtttctgtgctcggagggaggaacagatgagaaagaagcgattcagggagggaaaaaagaaagagcgcaaggaggaaagcggcggcgcgactccggaatcgttccgctcctcttgctctttctatttccaatcgtatcccttcaagatggacagtcagatttgatcttgtatctcccggtactactggccggtacatgctgccggacaggagtaaatctcacatttgttggatttcctcgtttcgtatttgaaattagtggtcaactatgacgatgaggccccgttcggagttcggacacagaggcaaggctgagctaatcagctggtacacataaaacgaggtgatcattaacgagtaattaattaaatattatttattataaatttaaaattgaatttatttaatttttaaagaaaaattatattggaagtacgtaccatgaaaaacgtgctcttaaaatacaagctaataacctactcgctgagaagttaataattaagaatgatcctaaaaatgggacattttagtaatacaactagctgccttaagcaattctctctatcatagttattagcactggaccagaagtcgaaccggtgagccctcggtttacaatgagtatggtactccaaccagttcgaccaccgattcaacacggctcaaatatgtacgtgtctctaactaaatcgtcaacgtgggttcaaccggtttttctccgatctgattgcatggccgatcttttagctagaccgaatcggctgaggctttggttttgtcttttttccgattggaccactgattcggtccgatcttaataactactccattcgtcccaaaatgacggaggtactatctccatcccaaattataagaatctagtaataaatgtgacacattgtacattgtagtacttcgaatcttaatactatgaaatttcacatccagtactagtttcttatgttttgagatatagtgagtagtatgttgtccactgcagattatctactacaacacatcaaatgagttgaagatttatagttgtactcagcatactccctccctctgagaaaaagttcaactatagctatgaacctgacacacatatccagatttatagctatgatttattttctatggaacaaagggtgtagaaggtagtatcaagttaatttggaactcggagttcaaccttcatgttcgtttgtagttgtacttatatagagtactacgtccatctcataataattgtatttttagtattcaaatttgccccaaaacagttgtcatagtaaagtactaatggtctcatcaatgatttctcatccaaatttctctatattctaccctcaaccactccccaacttttacctatgcaccatttgacgaagggcaccatagtttttcttttgaaaccttaatactccctccatccacaaaagtttgacatatttcatatttaagttttttttcaaataagttgttcttatttgtagtctttatacattcaagacttaaatgatgagataaattaaatgtttgattaaaacttaaggagtcatctaaatactcactggttgcatgcttgcattcactccttgattttgtaacatcgaagatgatttaattttttcttggtttttgtgacaaaaataatatgtgcaacttttgtggatgaagtgagtatatgctaaataatctagaattataatatttggggacagaggtagtaataacgactaagagcaagtataataagaggctgtaagtcggctaaatgctgaggtggaggagagaagagaagagagagagtagaagcgggctgtaaacttacagccgacttggacacaataaccaaaaaattgtgagaaagacaagtgggtcatgtattaattataaatagctaactattatatgtgtgggttaagagaaggctgaaaaaaaactttatagccaataagtcggcatcgcaggcatatgagtgtacctttcttaattaatgcatgcttggaccagcaataaatccttggatttttttaagatactatttaaagcgtattcacatatttaattaatatttatagatatcacgattaatttaatcgagaaatcgagagatagagttatgctctcacgatttcagtgacctcatcaatattgtctttttaatatactaaattgacttattaggtgttgtcacagtttacttgacggagatattcattacagttgagcaacttaaagtttgtcaacactatcactatgcatattcatttgtgcgtatctaccattagaacaaccaaaatctaaactctagaaattattatgcaatgggataaagtgggtatattttaaagcttactaatatgcaagcatatcaaatcctcatctaccatgtcattttcacattatttcaaaatatttctatccatcgtttatagtataatattaacaaaaattcatatgaaatattgccatatagggcatcatctaagatggtgtttggaaagtagagactagacagcttttgcccctcccatagagactaaaatttttgtgagtttaatccctccttttcaaacaccgcataatatataaaattatagagaagtatagaaccataagcatgcaaacacaagttacacaatataaa

SEQ ID NO: 9491 - DNA, 3777 bp, Oryza sativa
caccatgcccgcctccgccgccgccgccacacgccctgccgcagagggcgtcggcggcaacgacggcgccaccctggccggccgcgaccacgtcgtcgtcttcccgctcatgtccaaaggccacatgatcccgctcctccacttcgccgcggcgctcgcggtgcaccacggcgaccacctccgcgtcacgctcgtcaccaccccggccaacctcgccttcgcgcgccgccgcctgccgccgtcgccgtcggtgcgcgtcgtcgccatcccgttcccggcgcacccgcagatcccgcccggcgtcgagtccaccgacgcgctcccgtcgcagtccctcttcccggcgttcctccgcgccacggcgctgctccgggagcccttcgccgagttcctcgcgtccctcccgtcgccgccgccgctcgtgctcgtctctgacttcttcctcgggttcacgcagcgagtcgcggacgacgccggcgtccgccgcctcacgttcaacggcatgtcgcccttctccctggcgctctgcttcaccctcgcctcgaggcgaccacacgtcggcgtcgagggcggcgcggagttccacgtgcccggcttcccggacgacgtgaggatcaccgccgacgaggtcccggacgccgtgatccaggggggcaaccccgacgacccggtgacgcagttcctccacgacgaggtccgcgactgggaccaccggagctggggcgtcctcgtcaatagcttcgccgcgctcgacggcgactacgcggccatcctcgagtcgttctaccaccccggatcccgcgcgtggctcgtcggcccactgttcctcgccgctggcgagtcgccggagacgaagcaggaggaagacgacgacgacgacgacgacccggaaggctgcgtcgcttggctcgacgagcgggcggcgaggccagggtcggtggtgtacgtgtcgttcggcacgcaggcgcacctccccgacgcgcagctcgacgagctcgcgcacgggctagtggactccggccacgccttcctctgggccatcggccggtccggcggcgagtggtcgccgccggtggacgccggcggcgacgggaagatcgtccgcggctgggtgccacagcgccgcgtgctgtcccacccggcggtgggcgcgttcgtcacccacgccggctggaactccgtgctggagagcctcgccgccggcctgccgatgctggcgtggccggtgatggcggagcaggcggcgaacgcgaagctcgtggcggacatcatcggggccggcgtccgcgcggtccgcggtggcggcgtcgtcgtcgggcgcgcggaggtggccggcaaggtcgggcggctgatggacggcggcgaggagggccgcgcgatccgcgccagggccgaggaggtccgggaggcggcgcgcgcggcggtgggagaaggcggcgcgtcgcgggaggcgctgcggcggctggtcgacgagctgcggtcaagctacgtcgtcgccggcgacggcacggcggcggcgagctcggcgaatggcggcagtggcaagtgttgagcgaactgtagaacacgtcgacacagtggtaactgtgagtgatcgacgtcatgtcattttaagtttgaataaaaattaactctcattaaattttaactcacggtgaatctgcgagttaatttttaactcatggtgacgtggacgaattttagacgtctatttctcaatccaacgatggaagatgaagattgcatgattgggctgaatggggagattgtactttatacttcccccatctcagcatctggcactggcagtgctgctgctgcacgcctgcaccggatcgctgcacgccaggcactgtttattaggctccatttagtttctaaaaacatcacatcgaatttttgatatatgcatggagtattaaatatagataaattaaaaaaataattgcacagttagggggaaaatcgcgagacgaatcttttgagcctaattagtctatgattagctataagtgctacagtaacccacatgtgctaatgatgaattaattaggctcaaaagattatctcgcagtttccaagcaagttatgaaattagttttttcattcgtatccgaaaacccgttccgacatctggtcaaacgtccgatgtgacgccaaaaattttcttttcgcgagcccttagttgtactgggataaaaaaattttggtgcgttacatcggatatacgtacatatatttgaagtattaaacatagtctaataataaaacaaattatatatttcgcctgtaaactgcgagacgaatttattaagtctaattaatctattattagtaaatgtttattgtagcaacacattgtcaaatcatggcgtaattaggtttaaaagattcgtctcgcaatttacatgcaatctatgtaatttgttttcttctatatttaatactccatgcatgtgtccaaacattcaatatgacagggtgaaaagtttttgcgtgggaaccaaacaggacctcaataaaaaaaaagtacagaattatcgtgtcaaaatactattattcgaaaagaacaagaaaactatagaaatcactcaataaaaaaaagtacagaattgtcgttcggcacgctcgcgcacggccggcacggggtagtggactccggccacgcctgcctctgggccatcggccggtccagtggcggcgacgggaagatcgtccgtggctgggtgccacagcgcgcgttcgtcacccacgccggctggaactccgtgctggagagcctcgccgccgttcgtccgatgctgacgtggccggtgatggcggagcaggcggcgaacgcgaagcatgtggcggacatcctctgcgctggcgttcgcgtggaccgcctcctccgggggccgaacgccgctgttgttgtcggacgcgtggaggtaggggtggtaatgggtcaagacccgtgggttctttcacaatccatcttaacccttaaatttttttagcacaaaaaactactaaatttcagccaaacctttttttacccaaccctcataatttctacgccaaaatgttgggcccattaccacccctacatggaggtggccagcaaggtccggcggctaatggacggcagcgaggagggccacgcgagtacgcgacccgtgccatgcgtggatgaggttttttattagtgcccgaacacttcatacgacaccctatataatacccgatgtgacacgccaaaactttacacccctggatctaaacaccccctaagtctaatgcaagcacttggacacgattgatttgactagcttagcctgtggtaactgtacatcagcgataacgaattgattcggttacgcacgtgtgcattcgggtgatttttacaataaactaaatagaaggtgtgtatttgcagcaaaatgacttatgaggtggaatgtcaaaattcaagtgacttatgaggtgaattttgtaattttcccttcttataatgttggataggaaaaaaaaatacagaattaaagtgtcttatcaccttaaatctttgggctcctttacaacaaaagaaaagtagagaaacttaaaaagatttgaatcatatagaaaaagtttttatgagactaattttaacaaagcattgagtctgtagaactcctttgaaatttctatgaaatgacatgtttcatgataattttgaaggattcctagcattaactccaaatttttagaaattttcctttctgtctacatctctaaatcctatgtgttttccta

SEQ ID NO: 9492 - DNA, 13884 bp, Oryza sativa
agcttgaaaatttaaattttggttgataagaataaacgtaagcaaaaaagatgaagcctttagttaatccaaaggaactttcaaggattttgatacaaaggaccacataagaaggtatttttatagaattgaattcctctaagaatctttgttccaaaggagccctaagatctttcgccgttgcctcagtttctctaagggcttcagaacgaagggaagggaaggtggtgtcaagtgtaagttgttccaaaggatcccaaagcagagcacaccttcctctggcctgatttcttcccaaaggtggtgtgtagtgtaaattagtgttgtctggatgatttcgtccctgttcttcaataattgatatcgatattattttagttttagcattaactaattttcatttctaataaatactttaaacatgttatattattgagcgttgtataatcataaatataacttctattcattacttaatataattattttaaaagaatgcggttaaaatgacatgatcataattaaccgtgtcaattattcgagaatggaagtatggaacatccggctttcctgcctgcaggagcagaacctgggcttatcccaggccgaagaggcccagataaaacaaggctggtctacactggaagtacgaaggaacatcctgcctgctgctactggttgcagctgttcatcgccaagccgtcttggattattttttcagcctcatcggatggcctaataaaccaaagaaaaagctaaattttaaattttcaagcttaattttaagattgattttgacatattttcaacgtagttttttttttcaaattggcttttaagtcaaaaaaaacacatttacaaaagttttacccacaatttcatttttatttcctaataagccgttttggcttattaggaaataagccaaacaatggggacctttctcttctcccgcggaatactaatattttattactatataattgcctcccaataagtgaaggccacagagtccaagtatgtgacgttgatttctgttcctttaaacatgtgcataacacattcgtgggtgtatgagtatggtgttacctatgtagtggtgtgtgtgcacgtgcgtctctcgtgtaatggaaaaacaattgttatcacaaagttagaataatctataatcttatcgtccaaacgggacccttatggctcatttgaagcaaaagattgaaaaaaagaaataggaagaacaggaaaaacgtaatatttttacatgaatgtaactgcaaaataaacgattgcaaaatacataaatggttatttgaataagctaaaagaaaaacttaggaatcagatgagaaaaatagactcaacatattgaagctcttgctaacttttctttaaaatctcttcatagtattatctattccatagggatttgaaaggaaataattcaatcatttgtttcaaagaccttaataggtactatttttcttatagaattaaaatcatctaatttttcaatatttttcgtacaaatcaaatggggccataatcttctctttcctggtgatgttgtcagttgtcaaagtgcaggggtgagtaagcgagtgactccatccacgccgacaaaaaaaaaaaggattagtgacgctttggggatttggtcgaaggatgatagtgatgtagcgcgtgcatcgatcgatcgcacagatgggatgagaatatgaggttcagattggggacggcagcatgggacaagggggttgttgcagcttgcaggctcaactgatgatgaacagtaccagtactctctctccgtttataagatatttcggctttggtcagagttaaactgttttaagtttatagagaaatatagtgatatttatattactaaattagttttattaaattgataattaagtatatttttaataaatttattttaggtcaaaaatattactattttttctaaaaacttgtcaaacttgaagcggtttgactttgatcaaagtcaaaacatcttataacctgaaacggaggagtagtagttatgggctatggcacattgagttgatgatcactttgatcagggattcttttggtttattttgatttcggaggatgcaggagtttacaagcacaccagatatgcttatctgaatagcctatttgattttgtaagtaaagggtaacaaaccgaaaataacttagttataaattttgttctttcaatcttgccatggcaaggcagaaaaacattgtcagtgattaaccactggtaaatctagtagcccacacttcaatccatgaattctttttcaaaagaaaatttaaaattgttgtacagaaatccagtgaagggcaagacaatggagcacatttttcgatagaaaaagataatatgcagaacctttttatttgcatcagttctgttctttatgcaagcatttatttgcaatattacctcaatagagaacctctgtcgagtctgtcagaatggtagaaatttttagggtcttcgtggagtagatattatgcattaactttgctggatttatacatgaatcaatttaattgcaggaattgtggaagaaaaccagaaaactcacgttcatcacttgcaacttgtctaacaaaaaaaaaactaaaactatgtttcagtactttaatatcaaactatattaaaaaaaaaacgatgcgcaggagtgaccacacttgtttattggatagcatttcaaacttaaaatctccaacctgtcatgggaattgctgacagttcctcaactactcatgtgcaactagcagtcttaaatctccaatcttttaagctacttcacttgataatctttcagccttctatatggtgtaatgtaaactggtccttatatttgattatttttttctgaagatggcccagacctgtttctccttttcttgacctcttctatctccaattctccatggtcttcacacctgctaatactgaactactcatgctttgcttgttgtgtccgaaccttgtcatctactcaagatgatgcatgcatgctagctttgctcctgttctcctaacatggtcaattccaaacatgcttttgtgccgattgaccggtcgcattcagctttagctcacccggatttgtgaactaatgatgcatccagcatgaacacaccgtgaacttgggttaaaacaagcgaaaagaattcaaaagttcgctttactgtagctgtatgtggtcctctgctctctaaaaaatttgactcgccagcttagcttagtgacctaggtggcacaaatgcacaatacaaactaccattctgcaattctatgttttactttcctttcaaattaaatatattctatgcacagatattacaagaaggttcttagattgaaaagggcaaaatatatcgattgtgacttgtcacaacgcaagctactacaaaagttcatgaaagttctactttatatcatccacattttcttgtcagcttaagcttttttagcaaacctattattagaattgtaactctgaagtctgaacctctatcttctgaaataaagtttcagggaaggtacagaggtagaggcattcagccaccattctttaatagggagatccaatttcattccatccatgctacaatgaaattgttgatctgccaaaaatattacctgacgactaaacagacaaaaatctgacggtgccgcagcatcatcaaggttggtatttaaactcttataaatttgtgcacctacatcacagtgaagtagtattgcacatctgtactgttgcaacagcctgcggacaaaaggagcgaagtgcttgtactgttgcaagttgcaacagcctgtaaatgcagtattactatcttgcacacgagtccactactcaaacagaaactcagctccaacagaagaacagctcatgaaatcaagcataacatggcaagaaaaatggatttgtatttgaaactccgataatcaagcttcctctcaccttctcaccacatgcacaccagaccctgatgaggcagttgcaagtcaaatgttgccagcactttcactaaatgcttagtagtagtagtagcaattatgcaaacagacactgggttcagcttctttaatgagggatttgactggctgatttgtttatgtcattaattagagagaatccacttctctcacttgcatagttgcattgccatgcctgtatacactttgtctgtattagccagttcttggttcagtttaaaccaagaatgcttagtaagttaggagtagatcagatgcagtggtgagacagctaagccaagtgttctgcacttgtttattcagataaaaatttcgtgccatcctaaaatgatgcataagacaaattatattgccacatatgatacaaatattaatcttcagtggttgttataaggtttgctaatttgatttaattccatcactgtcaacctgacaaatccaaacaaccaatgcttcttttgttcatgagtgtcttccaagttcctcctattctgctgaactttaaaagcaaatcaacctggcttatgttacactacaatctgatatttcaaaccaatgaagaccaagaatgccttttgtctctttaactaattaatatgaccatgactaacacacaaatgcagttgcttcaattgcttttttcttcacaaatttgttgctttgcaatcactataatcattttggaaaagaaaagaaaagtagggaaaaaatcaatgaaaagaaaaaaaataaggggacattttttctgtgttcaatgtgcaaaccaaatggttcaagaatggcttccaactcggctgctctgctgccgcccgccgccgccgccgccgacgatgtactgcagcgccgtcctcgccaacgacggccgctcgtcggcgagagacgagtcgccattgccgccggcctcgacgtcgcggcgctcgtcgttgatcccgccatgcttcttgctggcctcggccatcgccggccaccggaacgacgccgcacgcctccctccgccggccaattccgccgccgtccggacatcttccttcctagtggctgacgtcatccagatcttggacacggagaagctgtccctgttcagcctcgccgccgcggcgtccgccgacgcggcctctatcaccgccgcttcccacgcgcccttcttggaggcggagcccgcgaagtcgcactccgacagcgcgagccggcggcgagacctcgacctcgccggcggcctccgcttgggcgtcctgacggcgacgcggagcgcggcgtgctcgtccatgacgtactcgtaggatcccatggagaagcaccgtctctgtccaagatctcccctgccgccgccgccgatgtcgccatcgttgctggtggtggtgcctttgacgacggcgaggtcgccggcattgccattgccgtcgatgcacttgagcttgccaagcttcacctcgacgacctcctcctcctccgccgccgccgccttgggagaagacccctcgctgtccccacctccattgttggcgaacgtctcgccgaggctctccgagtcgagcacgcgccgcgctaccggggtggacgccgacgagtcgtcgtcgtcgtcggcggcggcggcggcggcgaggacgctgccgcggcagatggggcacgtggagtgcgacagcagccaggcgtcgatgcagggcacgtggaacgcgtggccgcacgtcgggaggaggcggagcttgtcgtcgccggcgaactcgcacaggcacacggcgcagtcgaacgggtcgtccttgcggagcccggcgccgacgacggcgcggtagacgaagacggggagcgcgtcgatgaaggtctggtcgacgccggcgtcgtggaggtggaacagctgctggagctggccctggaacgccgtcgggctgcccatgccgacgccgccgccgccgtcgcccacgcgccgccgccgccgccgcgcccggcgcatccggagcaggttctggatcagcaggttgagcaagccgaagaggaagaagacgacggcgaggatggcgatgatgaggaggacgcccgggctcatcttgtcctcgatggtgctgagcacagagcgcggcggcggcggcgaggtggacgccgacgtgtccattgttgtcacaaatggtaacacgagaagaagaagagcttgttgttatacgaggcgacgtcgtagagaagaagagatggtaggtgatgacgtcatgctgatgtacgcaatgcaatgaaactactgattgcggctatatattaattgcagccatatttttccgtgctcaattttaatcgtccttcttatttaattttttttttgaaaaaactttaaaacataagtcacacataaagtattattcatgttttattatctcataacaacaaaaatactaattataaaaaaaattaaataatacgtacaattaaagttggtcacgtaaacttatggttgcacagagtatcaaactacgatgtcagtaaaaaaaaattggagaactctgcaagagggagcatactgatactgcagattgcaggtgtattgttcatctcgacgacattccggatttccaaaagttcagaaacaaattttgcagattccctagcgacaaacctctgcaagggtgggcttgttgttgcatgggagcaacgaaaatctgaatcctgcgtaaaacaagcagagtcagaacacaccattcatcaatgtgtcaccccatcccctgacacgtccagataggccaaaagtttaggagaaaattgcatatctactggataaaaatacaattattcaaaatggacttcgctagaataccatccacaatcgatcattactaaaatactatctagaaatgaaatgcccctagctcatcttcttccctcccatgcttgaagaggttgctggcggccaccgccggcttcacaggtgctgcctcgccgacacataccaggatggaccgatggtagggagggcaacgccctaattgccggtggcagcaaggtgtcggggcgaggttgtcgtcagccggcgagtcagggtggggcggcgatgcgcaacggtgcccagcccagacgacgtgagcgatggcgcggcagtggagccggcggtggccactggcgacctattcagtcattggagggagggatgaagaagaagatccagggtatttctgtccgggatagtattttagcaaatacacattggttaattatggtattctagctaagcccatttaagtgatagtagttgagcgaatcctaacttatgcaatgatagatatgcaattttctcaaaatttagtgtggttcggtttgaagtctactcgaaatttggtaaaagcatgaataatttggctagggtccatgtcataggttttactggatactcagattgaagttcatgttctagatttggtacatgtggatctagacaagggcaaaaataaaaaatggagaacactaaaactctgcaagagggaggtgagattgcagatgtgttgttcatctcgacgacattccgaatttccaaaagttcagaaactagattcctagcgacaaagcttctgcaagggtgggcttgttggctgttgctgcagaggggcaactgaaagtctgaacccctgtgtgtaaaacaagcggagtctgagcgtcagagcacaccactcgatatgccgaaaatttagggccaatttggtttgaactctgaagtctgtctgaggagattctgcaccagcaggttgagaatgccgaagaggaagaagacgactcggtggactgcgactcggtggagcaatggtggaacgtagtggtagacactcctaacaccccccgctttcctttgtgagcactggtgatcttggtttcatgggaagtttggtgcgaacgaaacgcaataatcttccgaaacaccaccttaacgccggcttccatcatcgccaagatcaaggaggaggctcgagcctgggtcaaggctggagcctcaaagcttcaagagtttggaatttttggagatatcacttagtctcttggccaattcttgcgggtttagctcttttggcttgccctgtaaatatttccctttctaattttgttttgttttttctccatctctattaatatacgaggcaaagcttttaccctcatttaaaaaaaaaacgacgtccaggatggcgatgatgaggaggacgcccgggctcatcttgtccactcctcgatgctgctgagcacggagaggtgtacagtacagtttttctaccgttgcatttgggttgggttggatttccaccgtcatgtatggcctgatcgttcgatggcacggtccgacgtcgtctctgctccatacatgcaacatcgacttcttgtttaccatggagcacacccaaaaccccaatcggctagtcgccggtgaatcgaatcggctagtcgtcagaaggcaccaaaacgaaacaaggaggatacaagaaattcattttttaggccgagtttagttccaaactttttcttcaaactttcaacttttttatcacatcaaaactttcctacacacacaaacttccaacttttccatcacatcattccaatttcaaccaaattttcaatttttgcgtgaactaaacacacccttagtccaattcttaaagtgcaaatcgtataagagatttctcttccttcttctaccttggtctcccttatagcttcgtgcttgataatatagagagtagtacaacacggttgtataatttaagagcaaagtggagatacaaaatttagaggtgagattattttctcttattccaatcctttcatcaagtatacaaatgagtaattcctctcctctttggacagtagtgcaaatccatatatgaaaagtttggtgatggacccaataaatatatttggttcatgtcttcattggtcaagctctaagtttcttaacacatatatcaagtaaaaaaactaagttcaacggttttataaatttgttctagcctccatcacattttgatgtgctaaaagagaggcactcggatgctcggaaacggcagactacacttttcagcgcatgacatgataataggtactacctccgtcccaaaaaaagacaaaccctggtttccgtgtccaacgtttgaccgtccgtcttatttgaaaaaattatgaaaaaaattaaaaagacaagtcacgcataaaatattaatcatgttttatcatctaacaacaatgaaaatacgaattataaaaaaatttcatataagacggatagtcaaagttggacacggaaacccagagtttgcctttttttgggacggatggagtacatcattgcattggcaccaagtctaaatatagtgggttttgtttaggttatactacaaaactgaaaccaactaatggcatatggtattggcctaatggcataaggaaaggattaaaatgctagacaaacctcgatacatatgttccctatttcttcgcaaatctcatgcataagggcatgtacaacggtgtttattagtggtctctctctattgccatgcaagtaagtttgatgacatggaagaaagagaaaggagtatggttgttatgcatgacaacagctcagagtcgactcttagcatttattagagcaaattttgttgcatggtggtgaaagaaagaaaataaaagtaagaaaaagttgagaccatattgtctctaactgttgtaggatgctagtctccagataacgtagagctcatatctgactctacctttgtagatgccctaatgcattcaatggatgatggtcctgccattttcaaaacatcctcaaatgttataccatatggcctaaaaataaacagtgctaaattacagggacccccaccatcatcgccgagcctccgaacacaaaaccaccgctatttatgcaacatccttcgcacgctccactaatccctcccgcccatttcccacggccaaaaaaattaaagaaaacaaaaaaaaatcatttctcagaacaacaaaaccaccaaaattcagcaagaactcaaaattctaattctttttcgagcaacggaactcaaaaatatttgatctcgttcgagctgaatcgatggtgtgttgtttggttgcgtgaggagaggaggaggaggaggaggaggaggatgcgggtggtggtggaggaggaggaggccgaggtgatgtacccgtcgacgccggggaaggtgaaggtggagcagcggtcgtcggcggcgatgagccggcaggttcaccggtgcttcgcgtcgacggggaccatgttcctgtgggcgctgttcctggtggcgatgacggcgacgtacctgagcttccgctccctcgccggcgacgccgcggcgtcgtcgtcgcgctacttcccggcggcgtcgtggggcgggctgcactgggagcggcagatcagggcgtcggcgtcgccgcggcggccgcccgggtcggcggagggcgccgggctgtccatgctggtcaccggcgccgccgggttcgtcggcgcgcactgctccctcgccctccgcaagcgcggcgacggcgtcgtcggcatcgacaactacaactcctactacgacccgtcgctgaagaaggcgcggcgcgccctcctgggctcgcacggcgtgttcgtcgtcgacggcgacatcaacgacggccgcctcctcgccaagctgttcgacgtcgtccccttcacccacgtcctccacctcgccgcgcaggccggcgtccgctacgccatggagaacccctcgtcgtacgtccgctccaacgtcgccggcctcgtctccctcctcgagtcctgcaaggacgccgacccgcagccggccgtcgtctgggcctcctcctcctccgtctacggtctcaacgacgccgtccccttctccgaggcgcaccgcaccgacaagccggcgtcgctctacgccgccaccaagaaagccggcgaggccatcacccacacctacaaccacatctacggcctctccatcaccggcctccgcttcttcacggtgtacggtccctggggccgccccgacatggcctacttcttcttcacccgcaacatcctgcaggggaagccggtcaccgtctaccggggccgtgatcacgtcgacatcgccaggtattaagttgcatggaatagaagtgggctgcaattcagccagaattcgaactcaagacctctaacttttgataccatattgagtcagccagtcagggttgatcctatcggttaggccgatttgatcgggcctcaccgaaatgctgaaattttcggtcaatttcggtccgaaattttgaacaaaatttagttgaatttgagcaaatattaccaaaatttcacgtagaaatttaaaaatttcagctgaaataatatcgtatcggaggggtctgaaatgatcaaatttcgaaaatttcgttccgaaatttccaaccctgataccatattgagttgcatgcaccgactagttcaactcaaaagcttgagctggtgagaaaagatggacaattcactttatattccaacaccagggacttcacctacatcgacgacatcgtgcgggggtgcctggcggcgctggacacggctgggcggagcacgggcgggggcgggaggaagcgcggggcggcgccgtacaggatcttcaacctcgggaacacgtcgccggtgacggtgccggcgctggtggcgatgctggagaggtgcctgatggtgaaggcgaggaggcacgtcgtcgagatgcccggcaatggcgacgtgcccttcacccacgccaacatcagcctggcgagggagcagctcgggtacaagccgacgaccagcctcgagatggggctcaagaagttcgtccggtggtacctctcctactacggctacaacagaggaactcacgcattcaggagccgcttgtgatgacgattatataaattgttagtatagttagcattagtgaatatataaatatgtgttgaacatttttgttttttttgttgttggggggtttgtggggatggaaggaggaattgattcttttgttaattttttttcccttgttgtatttttgtcatgtaaattaggttgtttataggttttctaaagtttacattgacaaaagaatgggaaagtttatttatccctcgaggggccattcccttggggtttttttaggtcgcacaaaaaataataaaaatggtaccacaccataaacatacaggtttcaaatagaacacataattcacggtcaatttgactctgaaaacaaaaacaatagatttgactctgtataataataaactcatggtcaattcagaaacaaaaataataaatttgacttcaaatagaacacgtaattcacggtaattttattgtttttgtaaaattctaattgtacaagtcaaatttaaaagttctatcttaccaaatttttttaaagctcttttaatgactttttagacgacattggacattctctctagggacaaaaatccatctcccaaaagaactatttctttgttgctgaagggaatggaagcagtgatggtggttttccctctatgtatttttctccagtaaattggggttgcttatagattttctaaatttagcattgacgagataggactgcttcgctgcatgtggagttaggggcaatcttgacaatgatggtagcaatttgctaaaaggccagaatgccaaataatcgaagccaaatttgtggagcagcacaataccaaatctcccaccacgccaccgacacagttgagaccttgtagtgaaccaaaaatatgggatataccttccatatactgaatcaaataaaaacgttgggctaccatcaagccttagcttctcttgcgttgagacaccaactaaggggcatttgcaagatattagaccagaatttcaggggaagctagacattgaaaccttagaaagaaatttatccttgcttcagaacttcttgtgccaaacctccaaagtaggcggttatccctttgaatctatgttctatgtaattctcttcgctctataaaacaacaggaataccatgtcaattttttcacatattgaaagttttaaatgctcgatgaaaaaaaagaaaaaggttatgaaacagatcgtaccacaaaatccaaggggggagaagacaaccaagaaagttgctctacttggcttaagtccacattccgtggcaggaacatgatgatatttggagatatttcctgagcagcttggaaaattgtaaatctgcatgattaaacacattatttttcatattgtggatatgacaggaaatcggcaaaaaaaaaaaacaacatacccatctcttggcttcagcatatcaagggagtaaacttgagcttggctgtaggatggccctccccatggcggtgaaaggaacaccaaatctgcctgatcaatgcaacaagaacaatcagaatccattttttttaaaaaaaactttgatccagcttgaaattcagaaacgcacatccgaacgttattgcaagtttacaactagagtaaataaattagaggagaaaataaacgaactggagctctgctcaagtttcgtcatttatggcatgtttggcatagctctcagtcgaacagtttcagcttcacctaaaataggagccaagccgggtgaagctttctcacaaattaaactagggagatagagctgggtttaggccgcttcagaactccatttcaaacttaactcctgaaactaaatttaggagttgaacctaaatgcgaagcattgacgcttcatttttttttgtttctttttcagtatcattgagtaaagggatgagcataccttcaaggagggcgcgaggtggaagaaatcggcgacgacgaa

SEQ ID NO: 9493 - DNA, 1413 bp, Oryza sativa
cgcttcggcttcctccgcgtcccggcctcgcggcggctgaccggagggaggggagtcgtcaccggcgctgatggagttaaggccatggccaccgcggcgaaggcggtgagtggcgagcaagcggaggaggcggtggcaagtcctagccaggaacgtgacgcggcggcggcggcgaggggtcttgggcgttgcactcgcgttcgccattggtaatgggctcgccggcggcgagaggaaggcgatgggtccaagctataaaacgaagaagagagagcccgcgtgaattccaaacgagagattaatatcccacgggaattcacaagcgaaaaagagataatttgtcaatgttttaacagatatcatcaatccatcatacatttgtcaatgtttcacaacagataatttgatgatgatttgtaggtaaccagttacaaatgtgcagtagtacaatcagctcgcacgtactccctccgtaaaaaaaaaaagacaaaccctgagttttaccctgagttttcgtgtccaactttgactgtccgtcttatatgaaaatttttataattcgtattttcattgttgttagatggtaaaacatgattaatattttatgcgtgacttgtctttttaatttttttcataattttttcaaataagacggacggtcaaacgttggacacggaaaccagggtttgtctttttttggaacgaagggagtacgtaacagagggatgcaagagaaaacaacactgccagagcaaagtttcttgggtaacaacagattggcgaaaataaaatggcgacctacaatctccttcgaatcatacatatgttacagtcctggtgcgacactgcatttacattttgttgcagcggcatccttcgagtcgatatcttttggaagatgaacaattggacccacataaattccgagattctgcagaagatgcgctaggcttgttagtgttgcatgctccagtgtggagtatggttcatgacaagaaaatactagatggccttcaaacttctgcaaaggtacgaaaaaatgaacaagggaacatgttcaaacttactgctgatcaagggcaagtagttgcgatcgttgctctccaactccaggagtagatgaatgaaatgctgggaaagtacaaccgctgcaagtgtaaacttcacaggtacttggacaaccatggaatatctggggattccttcagggcaaaagttacatcgtcactgccagacaagaaaaataatcatcagtacagttttacatgataaaagaggtgcatattaagttttcatccagctagattaaccaaaagttctccgctcacgtcaaggctccaccaatgaccgaagtggatcactaataatggggtagctaagtgccaagtcttaaaactagaacctctaggcttt

SEQ ID NO: 9494 - DNA, 5063 bp, Oryza sativa
  unsure (1)..(5063): unsure at all n locations
gctttgatagaatatgatttggcttatgaaccattaaaatctatgaaaggccaaattgtatgtgattttatagtagaccatcatatagatattgcttatgagggagaggtttgcttagttgaagttataccttggaagatttattttgatggttctttttgcaaagaaggtcaaggcataggagtagttttgttttcacctaatggcatgtgttatgaagcatcggttcgcttggaatattattgtacaaataatcaagctgaatacaatgctctattgttcggcttatgtcacgcccagaaatttaacccaaatttccagactattttgcgtattaaatacctgtccaggaccagccagggtacacaaaacgacaagtaatatacagttctaaacgtaaataaagcgtaaaatacttacagaagaggcacttagtcctcagaccaaaacagaacgacagcagcggaaaaaggcgatccttgcggggcttcagctccactccacaggcaaaactcaactggggtctgagccttggtcctctaactccatcttcagctcagaagcactacacttctggaaaaagggggaataatagcaagactgagtacaaccaccgtactcagcaagccacaccaacgatgcagacgtgcaaggggatacaaggatggcttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaacatgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgctcacgtcaccatgtcgagtgattgtgacgagacccttcgcataaccctcccctaaccatccacaccacgctaaggtttcacccccactcctcaaaaggcagtgggcggtcccctcttgcgccgcggtgaatccggcagctagacaaccggacaccccggccgacccaactccatcacgcccaccctcgccaccggtgcctaggaaagggtcgagctatacttcagatcaagcggttacccactcccgcttgtggcaagcgctgtaagacttccagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgcaattatcccatcgactgagctagtggtaattaagcatggctaagcatatagttctagctaggtcatcaaagtaacacaagctaggcgatttattacccacggttgacaaaggacagatatcaagtaaacatggcacaagcgagcagataggtaaaaccctaaccccatgtaattagcaaaacatgcatgtttatttgcaaacagtaaaacatttataaattaggatcaacatgctcaaggggaatgtgtgacttgccttgcttcttcacttggatcttctgaactcttatcctcgcgaccgcgaacttccgaaacgacagattctacacgctggcacgcaaaacgaggaaaaactctaataaaaaccaaggaaacagtacataaaaactaaacaaacatgtagagctcaattttagatgaattttgcaagttgaatggctcaattcagagttcgaatgaattagatatgaattttagaagttttgagccatttaaatgagtttctagaattattaacgaattatgacgcaattattatttatttttccaaaggaaaagagggttgctgacgtcatcaaaggggaggggccgcgccggcaagcgggccccaccggtcagcgtcacaagggcgccggtccaccgtggccgggaccaccgaggcggtccaccgccggtccacgggaaccgacggcccggattggcccaagccgatcggacggccacggggcgcgcggctggggcacggtcacggctcaaagccggccagccgagtgatggcgcacggcagcgcggccaccggcgacgacggccgacgacggcgcggggagcgncagcgcatgcggcaggtggcggcgcacgctaggaaacggcggcgcggcgcggtaaggtaaggcggcagccggctgcccggcacagccgncaacggcgcggagcgcggcgncggcgacccggtcgaatggccaccggcgacggcggcgcgtcgcgagcaggcacaggaggtgcccgacgaaggggaggaagggaagagggaggggagtgctcaccgagcggcacgacggcaaacggccggccgacggcaaggaacggcgccggcggggctcctcgggaagacggcgcgacggagctccggcgacgggcgtcgctcaggaaggggcggacgggctcggcctcggtctgaggaaaatcaaggaggggctagggaggtgagacctggtgcgaggtaaatgaaaacgactgccgaccccgacaatacgaggaggagctctccggcgacgagggaggtggagctcgggcgtatttccggcaaagagggccagtggccgaggatctccccgtccctgcggagctgagggaggcgccgacgcgggtcggcgaggaccgaagcggtgttgcgacgcggctggaggtggccatggtgaggaaaacaggtggtgcgcgtggcggcggcgttccgcaggcaaaatgggaaaatggagtagggaccggggtggagctcggcgggacgatcccgacggtggcggcggcacggcgcggtggtggctggagcggcgaggagcggcggctggagctcgtcggtgagtggtggagagagggagcgcggtggggagggggttccgacgatggaatggggaaaacggagcggagccgaggtgcggcaaggcacggcgaagccgcaggtggcggcggaacagcacggcgacggctgtagcggtggtggcgagcggatggagagtcgccggtgagcggcggcgatgggagcaccgaggggagagcagtacagggcgcgagaagctcgggaaaattgggggaaatggaaaggggaggccggggatgctttttatgggcttggagtgacgggatcatgctcgagagaggtggcaaccggccggcgagatgggcggggcatcgtggggtggtggagaggttaaccggcggcgattttcatggggagagtggggaaaagggtggaggacgtggggcgacggggtcccacgaccggcgggcttgcgcgcggggtggatgaggtcggaaacggcggcgtcgtggggtggctcgggcggccctggcggttgcagccggccaaccagaggtaggaggaggagctgacaggtggggcctcgggtcccacctgtcggggagagagagaggggaaaacgggcgagggaggtaaagcagacttgagggagagagagagccgagcgggccgagggagaaggccggcccgagagggagagaaaaagggcgcgtgggccgcgggagggaaggaagacttgggccgaaaatggcccaaagagaggaagggggaattttatttgttttctttttattttaattgatgaaatgaaatttgtgctattaaaactatttctcgagctccgaaaattcacggaaaattccggagagtacattagggcacaaagaatattacaaaatattcccggccaatgatttttaaaggaaatttttaattccctcaataattcacttgattaagttgatttaacttttatttaatttctagaaaatgtattattaattgatttttattcccgaacgaaaatcggggcgttacagcttacaagttatggagatggtcggagctaaacatgtggaggcttttggtgattcggaattggtggtgcaacaagtcgccggagtctacaaatgcttggacggatcactaaataggtaccttgattaatgtttagatattattgccaattttgataattttgctattagacatattgctaggcatgataattctagagcaaatgacttggcacaacaagcatctggttataatatgaaaaagggataatttctggtattagtagagccggtgcttgattttaaatctttgtgcgatattggcaaaactggagaccaggggcggtctgaccggcgttgcacggccggtccgaccagtgaccaggggcggtctgaccggccgcatgtcgccggtctgaccggcgaccccgtgcggtctgaccggccctgtgtgaccggtctgaccggttctggacagagcgctggggggcaagtttcaatcattttggaagccgaattaattgtgaattcgtacatttgtgcctaggaaacagaagaagattggagaattcctttgattcaatatttgaaggatcccacacttaaggttaatcggaaaattcggcggcgagcgttcaaatacacattgcttgatggagacttatatcgccgaagtatagatggtgtcttgttgcagtgtttagatggagatcaatctaaagtggctatggaagaggtacatgaaagaatttgtggaactcatcaatcggcccacaagataaattggttgcttaggagggcaggattctattggccgaagatgattaatgattgcttcaaatattataggggatgtgaggcttgtcaacggttcggcaatgttcaattggtgcctgccaccgtgttgaatcccataatcaaaccatggccgttccgagggtgggctttagatttcgttggtcaaatttatccttcgtcacaagggggcataggttcgtgctagttgctacggattacttcaccaagtgggcccaaaccgtgcctttgaagaatatgactcaaacgaaggtaattgactttattttgaagtat

SEQ ID NO: 9495 - DNA, 661 bp, Oryza sativa
  unsure (1)..(661): unsure at all n locations
gattctattggccgaagatgattaatgattgcttcaaatattataggggatgtgaggcttgtcaacggttcggcaatgttcaattggtgcctgccaccgtgttgaatcccataatcaaaccatggccgttccgagggtgggctttagatttcgttggtcaaatttatccttcgtcatcaagggggcataggttcgtgctagttgctacggattacttcaccaagtgggccgaagccgtgcctttgaagaatatgactcatacgaaggtaattgactttattttgaagtatattattcatagattcggtattccgcaaacattaactacggaccaaggtgcttttttatgtctaaggaagtgaagagttttaccgaatcttatagtattaaattgttgagttcttctccttactacgctcaggctaatggacaaaccgagtcgagtaataagacattgttgaagctagtaaaaaagaagattgaggaacacccaaagaggtggtatgaggtgctttccgaagcattgtgggctcataggatatctaaacatggtgccactaaagtcactccttttgagttggtttatggtcaagaannnnnnnnnnnnnnnnnnnnnnnnnnnnnnnnnnnnnnnnnnnnnnnnnnnnnnnnnnnnnnnnnn

SEQ ID NO: 9496 - DNA, 723 bp, Oryza sativa
  unsure (1)..(723): unsure at all n locations
nnnnnnnnnnnnnnnnnnnnnnnnnnnnnnnnnnnnnnnnnnnnnnnnnnnnnnnnnnttgttttcactttttgttgtgaaaacagggtagtgcatgactggtttcaacttgccggaaaacttcaaagaaaatccagaagctttcttctggagcgtcaggccgcgagtcgttggtccgcagaaaactctaccgacaaagaaaccagccataccagcgccaccgaccttcaagactatggctaacaagactctccgcgagttcgctgctccctctgctgacaatgtggccattgggctgcagatcaacatggtaggtgtggatttcgacttgaagtccagcctcatcacgatggcgcaggcttagcccattctgtggcaagcctaatgaggatgccaatgctcatctgttacaattcttggagatctgtagcacgtacaccatcaagggcgtcagtcccgacaccgccaggctgcggctgtttccgttctcccttcttgggagagcgaagcagtggttctatgccaaccgtgttgctgtcaatacctgggacaaatgctctatggcattcctctcgaaattcttcccgatgggcaaaaccaatgcccttcgtggaaggatttcaagttttcagcagacaaggaatgagtctattttcggagcatgggaatgtatgtaggagtatgtggcccgctgttctcatcatgggatggacaactggctga

SEQ ID NO: 9497 - DNA, 2917 bp, Oryza sativa
ttgatgcggagaaagtctaacagtttggacaagtgggatggtgggggaccaaactgttggttctgttgcgcctgctgcaacatctgatggtaatgttgttgcatctgttgcatcatcattgtcatcatctgagtgaccattgggttctcgggcggtggagatggactgctgctagatgcaccactggtatgagctccatcggtctgctcttcgctgccactggcatcgttggagtcacggggatcgttccttgtcttcaccatctggacgaggataggtagaaataagagaaaggaattaaacagatggctcggcaactaatctttcttgtaaatttaagtgcaattatcttaatcttgattaaaaaactgaaaaggaagcaaacaactcctaattaaggcagccataccactggcacttgatatcgaccgccgactaacccacaagcaacaaacctaaacacagaaactagcaagcaatcaaaactaagaagatgataaggctaaaggcgacgactctgaagcttggagcgtcgcttgcgaacgaggaacaggtctaacatctaaagaggacagaaggataggaaccaacacatgctcaaaaccaaattaaataaagcaacaaatgactcaagtaactcgccgagcatgatgatttttatgcgtggaacatttttcatgaacccagacaaagatactaatgcaactgactaaacgataaattaatgcacaaaatagatgcatagctataatacacacataaaattgcccatcgaacctagacacgacttagtgcatatcacctaacaaattcccgactgactgccaaataaattccaaataatgtttttctaaaacaccatactattcctagtcgataaatccaattgaaatagcgatcaagatttttcccacgaatcaaaagagcaaaccccaaaattttcccaaaacaaatccaagtgcaaaaggcatgtgcagatgaaaaggtttcagagggctcttagggtttccagttggcttgtcctacggtcaaggtcggctctgataacaacttgtcacgcccaaaaattcacgaaccagaatttctaagctgaatgtgcattaaacccctgtccaggaccagccagggtacacaaacgacaattgttgacatacaaatctacgtcttacaaaaatataaaagattacaaatgcagtggaaaagaaaaaaacgagataagcctgaagacttgactcctgcagcgggcgactccattccacaggcaatccttgacggtagcgacgaaaccaacctcttcgagacatcaccaactgagaagaacttcaactctggtgtgggggaaaaagagagcaagactgagtactacccactgtactcagcaagtcataccagaagaggaggtatgatgcaggatatatccaagggaggctaaaggttcttttgcataaagctagcatttaaaagcagtagttgaaagcagtaaaacagttgcagtaattaatcaatattaaccaatcactgctcaacgctacaccacgttaagacaggcccaaaccaccacctgaactaaccagttccattagctaactaggggtgagactaattacggtaaatctggtcgaccgcccataaccgcgggcacgactattcgaatagttttactctgatcagaggtgtacaactgtacccacaagacacagccccacgacacgtttccgtgcgccgacatgccaccacgacatactgaaaagaggccgtgacaggacccttcgcataaccccctctaaccgatcgcaccacaccttagggttcgcccccgtccccagcgggcaacgggcagcccccctttcgtgccgcggtgaatccggaagccgatcaaccggacaccccggccgacccaacaccatcacacccaccctcgcctgggtacgtcggctagagggaagctatactacaagcccagtcgttgcccacgctggcttgtggtaagcacgataaattcttccagggtttcccgcgaaccggtccttaatcgccatgggcacaactagcaaaaccatgcacccacagcccaccatgtagtgtattttaattaactaacaccattgcggtggcactaatccaaagctatgccaataatcaaagtctatgcattaatgtgattcccctttgtgtactagttgaactaagcatggctaagcgttccctaaaccaacatctaatcattttgatacccaagttatcgatggcataaggtaaacaatatatggctgagtagtaggacccatcccacatgatattgtaaaacaatgcaacatttaatagaaatgcgggacatttgtaaattgggtacaatctgatcaattgtaatacatgacttgccttgctcttccactgatgagaccatagcaacgtcttcgaggagccacggatcgacgaaacgaccgaaatctacgcgaaaaacaaagcacacaagcaaaacatgctataagtctactgaaacaggagacaaaaccatttttaatggattctatacatttttacgaatttactgagacttgaatggactaaaacggagctcggatgaattagatatgaattttagaagattatctgtatttttactaataaagaaaagccttaatgtatttattgcgcaatatgtcccagggctgacgtcatccaaggggtggggcggcgccgacaggcggggcccacgggtcagcggcacaagagagagggtggtgacctggcgggtgggccccaccaggtggtggcttaaaggggggagaggaagaccgccctggtcggcttattttcaagccggccggccgttatggcgagggcggcggcggcaagcgaccaccgacggcggcagcggcaagcgtccaccgatggcggcgacaggcgaaaagac

SEQ ID NO: 9498 - DNA, 613 bp, Oryza sativa
  unsure (1)..(613): unsure at all n locations
nnnnnnnnnnnnnnnnnnnnnnnnnnnnnnnnnnnnnnnnnnnnnnnnnnnnnnnnnnnnnnnnnnaacccctatactaattttgagagttgagactaaaaaatcaggtccaacaaggcccctacagagcatctccagtagaggtcctaaacacagcccctatactaattttgagagttgagactaaaaaatcaggtccaacaaggtccctactaaagcccctaaagtaggaaagcctccaaattatccccttaggcccccagtccctggggctttctccgcagcccccatccgcggcagagacgcacgggcacttcttttttcgtgcgaaatatcctgctagcggcgcctccacggatctacgccgctcctcttggccggcgccctcctcccctgccggcgccctcatccttggtggcgccctcctccctgcccgtcacactcctccccggtaggcctcctccttcccaacgtcctcctccttgccggcgcggcggcaccctcctcccctgtaggcatcctccctggtgccctccttcctggccggccacctgcccacccagcaatatcctccctagatcctgacgcccttctccctggcgctagttgaagg

SEQ ID NO: 9499 - DNA, 656 bp, Oryza sativa
  unsure (1)..(656): unsure at all n locations
nnnnnnnnnnnnnnnnnnnnnnnnnnnnnnnnnnnnnnnnnnnnnnnnnnnnnnnnnnnnnnnnnnnnnnnnnnntggaaatatatcgatcaatcagtcaaaagtctgccaacgatctacaattacatgagaaggcccaaaagtccaatttaataatcacaaatgggcctagaatgtatgtcactgatttaggggcccacatggaagtctccaggaggaagctaagggccagaagagcccatagggggttggccgaccccttgttgagcccaatccagtcacattttggcctggagataagggaggccaaggaggaagcagcaggccaaaaactaggcctgttgggccactctagggttcggctgaacctagttcaccttgatctcagccgttggctctcccctttggcatggacgctccggatgaactcctgatggcggttgcggagcatttccgacaattcccatgctctacaaccgtcattgggtgctataaaaggacctcaccttcttcactttcaatacacactcaagcaaggatcaaagctctctacaaagttagtagtagtgttagtggagtagagttagaatagttccaagtccgcggaggcttcggggagttcggtaaaggttctatagcttttcctttcttctttg

SEQ ID NO: 9500 - DNA, 24718 bp, Oryza sativa
cgggaggagtgggccgacggcccaacaaaggaaaaagggaaaaagaaaagaagaaaaaggaaaaaagatttttcctaggatttaaatattacacatgctcatttttaattagttaaaattatttccaaggctctgaaaattccattaaaaatcctattagcatattttgacacgtagaatccaagaaaaattccacacgccgattccgattattaactgtatttattaatttagggtttctctcttgcctttaaacaaataatttcttaaaacaatttatcaattgaatttttgctaggaaggaaaacttcagggcgtgacacgcgcgctgtggggcaagtgtcattggggaaagccgcgacgacctagagagggatggaacctagaccacgtcctggtggggcttccttggggaaagtggcggcgccatacgtcgggaagtggcaccatctggataaacctggacgtcgtcgccatcttcggtccacatctccaccgacaagtccgagctctccgccggctctccaccttcaaacagcaacaaattgacccgcaccactgggacaatagcccatggccatgtccggtcgtgcacgaagccactccggagcttcatgtcggcgacgtcagacggctcatgggaggtgcgtgaggaggagaggaggcgatgcatcgacggaggagaagaggcgatgcgttcgtccccactcacgagaccgagtcaaagggcacggttttgagggtacccaggtcatttcgccttagctcgtatcgctttggctatgtgggcttggtcacgtccactgtgggctgtgtatccccatgtgtggctatagataggtttggatcttgtttgaggccatattgcattgtggatcctgagacttttaaaggacttaaatctatttggtcctccggggctgaataaatggatgacacattgcttttgcccttacaatcctcttgtcaaagaagcggtaagaggaggggtctcctaccttttcaaattaaccttttcagactggggtaagggtctgtttgggggaggtgtttgggggaggtttagattctgagaaacagctgtttggtagccagcttccgagaatctggaaaagctctaaaacccagcttctctagcttctggcttcttagttcattttttagaatctgtaactacatattctcagaagctatggactgcttgaggcagcttctagcagaagcggcttttggaaaaagctgcagcggggacaaactctcccaaacaggctctaaagtggggaatctggggattctgggatccaaccggtgcaaaaataagagaagaggaggatatacccaacgagggagaggttgaggagagatgccggagctgccggaggtggaggtggcgcgacgggcgctggaggagcactgcgtcgggaagaggatcgtgcggtgctcggctgcagatgacaccaaggtcatcgacggcgtcgccccgccgcggctggaggcagcgcttgtcgggaggaccatctccgctgctcgccgcaagggcaagaatctgtggcttgcgcttgattctccgcccttcccttccttccagttcggtccgtggatctccacaccctctctatagtcacatttcccttcctttccgcaatggaccatttattgcttttctttttattactattattttttaagatagaaccgttcttcaggaggtttagggtttttcttgagttgttttttatttgtgacattttggaatcttgtgtcatgctgttcttgtggatttttcatgtttcgttgacgctgctcttagcgagtcccttattttagttctggtagtagtgtaaatatatatctgtaggttttcttttgtacagaatgcctataaggtaattaattactattaaactaaatgcgcaactcttggagtgctaaatggagtgcctaagcacaatggttgttttggtaatccggcattatcataggcacctcattttttttgtgttatgtcaactttcttggagcatttgatcacaacatatttgtcaatcaacaactacacttctagtctttctccacgtgctacagctatctggatcttagtattcgtgtcttacctaaagaaacggaaacacaaaattaagtacgcaatagctaaaaaacaataaaaaagaaatgaaggtgaacaaatactgaaggagaggtgtgactagctaaagttcaggttaaggaactccggtgagtaaaatttgtactggaaccttcagtgcagtttttgactagtgaaaattccaccaaaatcttgattacagtttctctttgccccttttctttgtaaatacgttttcttccttattaatgaaatgaaacgcagctcaactgcgttttcgagagaaaaaaaaatcttgattttacagtttttgccgagttacaattcagtctttccgccatgtgtgattctgactcagcaaaagtgcaatggcactaactcagtgtgccagcattgacattaaaatgggccaaatttgatgtttagagggctgcttttggacattttaatagttgaaggaccaatttgaggccactgtcaatttcaggggtcatttagtgcattaacccttttaagttctaagtatacaaagttacaaacagtacctaattgttagtttctgttacaggaatggctggagctatttacatcaagggtgtggaactgagcaaatacaaaaggtcagtggcacataatttattaaacaagacaatgaaatggcttatcaatcatacaatattaagtattagctttatatttaactatttaggactattctgcatgcttttcttcattagcagatacaatcaatttgtactgaaacatttgcagccgcctaatgttcttgatgcctgttggtgattctgcaaaagaaaattttcatctattggtgtattccatgaaatcgtggaaccttaggaagccctatatttggcgaatagatgattttactccactttcaggaaagtgttatgattccaattgacataactggagagacacaatcaaatacatagtttggttacactgttaattacaccctgtgctgattctattctgttatggtttttgtcgtaatttttttagaaatgtcagaaaaatctgtgaaaagctatgacgacaaatagtttaagtagatagatggtcaacgttttcatatacttttttctatttttcattgatactagagaaaacataatgtgaatatgccttccttgggttgtatgggtggatgttatttcgtgataagagttatttgggatattattaaagcaatatgcttgcataaaccaaaaaaaaaaatcatttgagcggcaatctagttatgtccagtggaccagcctctgtgacaatacttcaacagtcttgtagaatttcaatatgtgatcatgtctatataatatatatccactagaattttgtgtctgctaagtgttaataagtgtccgttaggtctattaaattggttggaatagttgtagtttatctctactattataagaactgtaaatgtttttgccaaacgtttggtacgtcgtccgtgttgtatatgtgttcccatttggtgcatgcgttgtgcactcttgtcctctgccgtcggtgcgtatggcccgtgttgttgcctgggctaggcccatagctagctggcttccatttgaagtatttttgttgccgtccgtataggactcggtgaggtgctgctgcttgcaagccatgctgtgggctgcctctccaaggtaggcccgcagtgtgcaagaaacaatttccttttttccctggaggacccatcgcatggtcaattggtaaatgaaaaaaatacgagttgaattatctttttttagaaacgaattaaattatccgaatgacaaaaaaaggactcaaaccgtatattaaaataaaattaagttcttattgtttcacataaatataggggttgacatacatatttttagggttggtgcctgtgccggttatcaattttttggctagtcagtatttataatgaaaattccttgtataattttttgttaggaaggtgggcatgatttgaatagtgtactactcatggggcagactaattgatgtatgtaccgtataaaagaacataaaaagattgaaagttttgtttattagttcataatcggcttattatgctagaaattcagttcttttatctaaacaaaatcccatcccctcttgctctagcatatgtcgccttcattaccgtagaacaaccgctctatctctccttccacattgccatcttacttggttgtttgccgatcatgctctctctccatgtacacaatttgttccattttcttcccattgcaatgcacggacactttggctagttcaactaaaatatttagcatatttttcgtgtggcatttgatataggtctgcagtgagcccgactgaggaatggcctttgaagtattccaagctgcttgttgtagtatggattctaatcttctattccacacctatttttttaatgcatccgccagttcactgatgaatttgaaatactccttccatatccaaataaagattattttgtgtttttgtggtcttcaatccaagactttgactgcattgattttatagtaatgtactagtaaattgtaggagctaaatccacatgttttgaaaatactttcaaaggcaagtataacaatattgtttgtgtgaggtttatgtactttttgcatatattatctacttctagataaggtcaccgtgggaagtgtgctgtcaaactgaatttattccattaatagaagtgcagaaatgcattaggtgctagcaagccacccatctagtgcctagcacctaagttaacaccgagagtgttataggggttgttcatgtaggattatgtgatttgtgacctgtctctgggttctgcttcttggacatatttatcttgttcagtctttttaattttattaatgattgaaatatgtatgttatgcattgcacttaagtttattgaaggattctagtaaatatattatattggaattcatacttttggtggtgactttgcttgcatgtttaattgtttttccttctctccatattgtgaaaagaatattactttctgtttggaaatgctctaatccctcatgatactccatgcagttcagtcctgaggcagacgtcaactaatgatccgtttaacactttaacttacatcaggttcatttttatttctgtcaacatcacagatggatgatggtttggagttttccttcactgataagaggcgttttgcaaaaattcgctttcttgacaatgtaactctctagtgattatttgacttcaaagtttatagcttcagtatgctgcagtaattcactttggaattttgtctgcatgttataatagccagaagctgtcccaccaatttctgagcttggaccagatgccttatttgaacctcttcatcttgatgattttgtagagtcactaagtaggaaaaaagctccaataaaagcccttttgcttgatcaggtatcaatctttaatgctccgttctctgatcaaagatctgcagtgtaacaattggatatctgaaattatgcatgcttagtaacagaaggcgaaattttcccttatatatgtgggaatcagaaataactaaaaagttgtctttgtcaattgttgcccagatttggttagtgaacctgaaagtcagtaatttgtgtgtttgactagtaaattaagatattacaattttatacccaaatgtagtctaaataccacagtaaatactacacttttgattctgctagcttctaagactgtttttctgaatcatgtttttcagagctttatatcaggaattggcaattggattgcagatgaagtgctttatcaggtcagtttccctagagttggcttgaaactacagaaaactgtcactgtacaaacacattacatgtttatttgctgaccaaaaacttttcgctgcccaaacacacaaaattttgaatattgtatccagtgttgtaaaaaataatttaggccctgtttggttcatgggactaatccattagtccctccattttagtccctaagaatccaaacaggggtgactaaaagggactaaaaagtgcatatgggactaaaattccattagtccctcttggaggaacttatagggactaaagtggcagcctctcttctctctccctcggtccacgtgcctttagtcccttttagtccctgaatccaaacagtaggggcctaaagtttttagtctacggactaatttagtaattttagtccagagactaaatgatccaaacagggccttagcttcataggttgtttggaggccacggcagcaggcccaattggcacatgtcacaagcagctcggctgtgctggaaatggtgcagtacctgtgcatgaattacatgtttagtagtagtactccaatttgttaactaaagattagttatttgcttagttatctggttggctagatattcttatttgggcttgtctcgtcatataaaatgggcagctttatttgagtttaagtgtttgaccatagaataatatatttacccatatatcgttctctcttctccatcccatgacctaagcccgtaacacattctcttctccgggccatcaatcctgagccatttgtttcttccatgtacccaatcctcatgatataggccatagatgagatatgatgttgaacctaacatgtgggatttagctttggtttaagtgattgtgtcaaataaagtgctacttctatgggaatatcatgtatccccatttaggcatttttttctacagaacacccaaaaaattgtgtaatttgctggtagacatcgcaaaaacatgtcacggctgaaagacaccctagaaaatcggtagcttgccggaggacattctcaactcaattggagtgagaaattcttcaaataggggataatacccctggagccataggcttcaaacatggtgttggagtgaatatttgaaaactatgcaactgtaaatctgtcgttaccccaactacattgctagcatacatcatattccatcttcacgacatcctcaggtcagaagttttttggcctaggggcattctcacctttttgaaagtgtcctccggcaaattcctagtttttttagtgtctttcagccatgacatgtttttacgatgtctgccagcaaattacacaaattttgagcatcctgtagtaaaatttgtcttccatttaaccaacaaagatgtggccttgttttagacataaccttctttgggcatctaaattgtataatactaggttattttttgtgttattcttttcataaaaaaacataggcatgtttcatcctttgcttgcttgatgcgtaggcaaggattcatccaatgcaaacagcatcgatgatttctaaggagaaatgcaaggcactccatcagtgcattatagaggttagtgtgatgtgtgtcacatggttgttctttaggaatggatagcatgtggcatcctatatatttataaagttcatccccactaagtttagttaatgctaattctctcttctctcatgaagctacatcaccttaattgtttttggcctttagatgatttcatcaagggtgcaaattgcatctcctccccaaaagccacaccatacaactcaatcatttataacctttggataattgattaatgtacaaaatatataagcaaatgaaagaaaatggtataataagtaaaaaagaaaattttataactcatatcgactattttatcacaattctcccacggcaacacgaagggtacccatctagttgatttgtgaacttgggtgcattttctatttatttatcaattcaaccatatataaaaaaatgattgcattttatatacgaattagatactgatatctgagtaatgtatcatgttagcatatactgatatctgaatactagatatgcacagttgttttttgtgtcttgcctgaactcaagaaaaacacctcttatataatgtatcatgttagcatatacattgaaaatataactgaatattagaaatgtttcaacatattggcatattaagcccaataggaatctggtttacctgttgagtattttcatcgcaatgtctttactggcccaataatatcgcaatgtcattattggcataaggagtccatttctgtgtatgataatcttatttttgtgtctatgactctaggtgattgaaaagtccttagaagttggttgcaacagcagtcagtatccagaaaactggatatttcactccagggagaagaaacccggcaaggcctttgtggagggtctgatcatcttttctttggtaaaacatgtgttcgtgatgcttagcattattgaagattgagttttgttgcttgcagggaagaaaattgacttcattacagttggtggcagggtaagtcctttacccatttggatcaagctcaatatatctttcatgcgttgcgctgatcgctgatcccattctcacttgtttgttcagacttcagcatatgtgccagagttgcagaagctggacgggattgatgcaacagcaagcagagcgaaaataagcaaagaacagagcaaatcaaataaagctgctcgtgaagtggacgatgatgaggaagaggctaaacctgccaagaggggaaggaagcaattagtgaaggcaacccatgagatccaagaggatgaggaagatacaaaagaatcaaagagaggaaggaagcaaccagcaaagacatcgaagggctcgtggaagaaagctcatcattcttctgagggtagtggtgacgacgacagtgatgatgaagcagttgataaggtggtcgcggaacaagggaagaggagggatccaaagcaaccagcagaggcgaaaagctcgtcagacaaaggaggaagtgctgccccagcaaagaggccacagaggaagaagcggcaattatagacccttacggcgggtggtgaactgtctgaagtaccttagggtggtgtttggttcggaagtggtaacgtaaactctcatggtattgccaccggccgtaacagctaccattgtatccgattacacggttagtttggttgcagacggtaacatcatttgtttacattacggcgtttggttgagggttgcagccaaggaacgggaggccgatccacaggacacgattcgaaatttggaacagaaacttttgggaagatcatttgcttggagaactgcttgcttccagacaactattgatcaaataactgattaaatgaagctggtatacaagtatgcaattaagcgcatggcatatgctatgaaacattcgcggaagatacactccagtactatatcaatagcagctgacatcaaaagctacataaagaagctcaacaaatttcggcatgcaaatatttgaaagcagctagttagaagtcatgaaattgtatctaatatcagcctagcatcatatcctggaagatctctgaacaagatcttgtagatctacttcagactcgagtaaatattggacaccatgcatcacaaagcagagaattggacgcatcattatattaacatctcatcttcatgtaataaagaaaaaaacaaacgtgagtaaaccacgcgatttacatagctaattgcacaagaatataggcataaaaacaagtaaaatgtctccaactcatcaaaggtatatgaaaagttctcaactttaaaatttgcacatgcttgaaagcacctaacacaaattaaatcctctatttctctgttttagaagtcattttgtgacaaccaagctgttgaacgcaatttatacaacagtaccagattttgtgacattcatgtttatgatagtagctagcagtcttatcgtcttttaaccaactgcacaatattacaaactgtcatagtgcaagcttataaaatttcaaagtactgaaaatgaacatgctcatgaaaaataaaggcaggcctctaatcccgaagtcaaatgacctacgaattcaaaatctcgtaatgagcatctgatagattaaatgacatatagccatcacatgaatttttcttcattgcttcatctggtaataaaaaatttcagaagttagtaaaagcaagatattgcgaggttacataatactcatgcatttagtcatctactgacaatgtagatgtgcagtacaataaagtgagtaaaagaaagtgagatttcgtgcgatactaaaaaaatcttaacataagaaaataaagtgagttaattgttaaatacttaatagaatggcatgaaatctaatgtcactgggatcaattcatgaaataaaaatagccagaataatgatgcaaccataatcatcaataattagttcaatgacttactctgccatgatcatcatattgttgtttctcgcactgcaccatcttgactcaattgcaccaaacttggtcctaaagtgcatcactcatgactcaatgtgcagaacagcagtaaggcaagaatttggcaacctcttaccaagtacgctctctagaacttgacggtatccatttttgaaacccccttttgatttcgaccttggatccaaagaaagctcaaacaataccttcaaatccttttgttcttgcctcttccacgcataatgcctagactttaaggaagctccgtaacactgcaatattagaaattcaacagaaaactaacagaaattcaacagaaaactaacattaataaacaaacttctttttttagttcttatttgcaaataattagaaattccatacaattaattcagacaaatataaaaaatgtttgttacatttgagaaataaattgaagtgtctacttacagcctcgccacttcaggaaaaaacataaatttaagagtaaaatgcaccagcggtccttaaacttgtcaggaggtttcacttaggtccacgaacttgcaaagtgcacatcgaggtctctaaacttagtttattgtatcatcccggtccaaagccgcgtttgaccgtggtcttgcctacgtggcacgccacgtggacgatgacatggaatttttctcttctccctttttttttggacccgctgtggcctcaaaacctcctctcctctgccgctcgtctcctcctcgctgactcggccgccgccaccgccgcctttccgcgccgcgccgtgccaccgtagctgctgacgataagctggccatagcggcgacggcggatccgcgggcgaagccgcccgccgcgacgtcgacgcaccacctcgagccgtgggggcagccgccgccgccaactcccttcgatggtgggatcgaggagctttgggtgaagctcatgggtcacctacgagacgccgccaaccgtctccgcgtgccccagcctagccccccaccccccgctgccgctgacgacgacaaagcccgagagcctacctgcagagatggactccgagcccgagttcaaggccctgcctccgcctccacttctcgccctgccacagccgcaagcggacggtgcagcgaggccgtggaacctgctacagtggacacggcggcgcccagccgcctccatgttgtgggcggcggcggtgcccgtgccgtcctcgtcccgacgctagaaagcgcgccgttcttggtggcactcaccccggaggagatcgaggaggacatctatgcgccgccgtccccctccctcccgtcagcgccgccatcctcctccccgagtcgccgccgtcccctccctcccgtcagcgccactgtcctccctcctgtcgcgtgcttgcctccggcacggtggctcggcgagtggagtagaggctgatggaaaaggagatgaaggcccggctgtggagctcgtggtgcagcggccgccggagagaaaagaaaatgaagaagggagaaaaaaaaggagaagaagggagagaaaaagaagaagggagaaaaaaaattccatgtcatcgtccacgtggcgtgccacgttggtaagaccacggtcaaacgagactttggaccgggatgatacaataaaccaagtttagggatctcgacgtacgttttacaagttcgtggacctaagtgaaacctcacgacaagtttaaggaccgctgctgtattttactctaaatttaatatcaatcatcatatttctaagtcctacatttcttctccagattttagtacttaagggaagggatgatgagccatagtaatttataaaaaaatacaaatcaaaacaattattaaacctatatccagaatatatcccggtagcacacataatacatcaagctgccactcaaatgaacaagagtacatattaacttttgctaaaaataaaccatcccttaattcttacttcaagatcaatcacaagaaaattgcatcaaattaaagcatatcatcataaatcttgagcactactgattaaaagaatggattggcccaagatgttattagaaaatttcagaggttgcagagttggacaaaaaaagatggtttcagcaggggttctcaccaacaaggagtagtgattgaccgtgaaaacgacgaaaacatagtgattgatggtaagagaacctcctgggcaccttctctgtgtacctcaggatcttcggctaggggctaggggagcggggcctccttgaagagatgtcgatgaacgatgaggtcagtctccttgaagatggcgaagtcaagccgcttgttagggtcgaatccatgaatggactagagacgaaactctggaggtggtggaggtcaccggccttgccgaggtggccaagctccggtgtcgacagcggcgcgcacgggactcggggagcggcggtggtggcgagcgcgtggagggggagcaacaccggtgaggctgggggcgccggcgacccgcgtggggaaggcgaagcggcggcggcgcttaggctaggtcacgagactcgcgacaacacaagcgttgcttccgctccgtatcgttaagctttaccactcgttttggagcggtaacggatttgtactaggcccggatctgattgcagtgtattcgattgcaggccacccaaaacaaacaaacaaatgtaatggggttcaattaaggaaaaagtacaccgaaagtccctcaacttatcatcgagttacaaaatcatcccccaaccgcaaaaaccagatataggacatccatccacttagaatcgttcactttaggtccttcggtggttttgaccccggttttgtctgacgtggtggctatcagcgacccacgtgggccccacatgtcaggatgtcacttcatcacctcttttatttcccttcctctcccttcatcctctttctctcaatgttctcactgggcaagcggcagggcggccgacgggtggggaggaggccggagggcgaaagaggttcggcgacgcgtcgacggaggcaatgccgccgtccacatcctcgttgtcaccgccatggtggccttcttcgcctctttccgctgagcggagtcgtcagcggcggctttctccaccacgtgccgccgagcttgacgcgggggatgccgctggcggcggggccgtgtctcgccatgtaggagccgtcgacgatccttgcgtcaccgtcaacaatacagcaaaagcaacaggggatagggttcggcaggagctggagcgacaggaggcagggacaggcacgatgacggtggctctccgggaccaagcgtcgtcgccaggagcacaggaggctagcatccatggaggcgagctcggcagcatgccggcgtcgatttgtaggacacccatcatctggccaccatgacaaaaagagaatatttacccaccaacaagcagatctgagaatgcgactataaatacccccattccccttccaagccaaggttgctggtgctattgaacattattgtctttggcttgatttacattgagatccacttttgagccttgctctcttatttctcctctgcatcgatcttcaaactcggactttgtgtgcgtttgtgtgaaagttgtggatttaagttcgtgtgagtgtttcgtgttgacttcgtgaagatttattgaggacgtattttatcccattgagattcttgctccatcctttacttttggaggttaagaagtgctagaagactagttgttacttttgagctatcaatctacgtatggttagctagcataagtttgtcaaggccgaatcttacctccgaaaagaaagagatatcactagggaaaaaaatagtgaagtttatgaaggtcgaatctcacctccgaaagagaagagataccactaatggaagaaataatgctttgtataagctctcgaggaaaaggtcagtgaagaccaggtttttgtgagctcctcaaagaaaattataaccccctcatggattcaaacttccaaggaacaaatttcagtgatatccttttccctagctttgctattgtttgtgcttgatattttttattgtgactagctagatccaattttctattgcgtttgtcgctgttctgccattttcagaaatatccgaacctccttcagatatattcgaaaatttcagcttccgcacctaattgagtttttaaattagcctattcacaacaacccccttctaaacctaaatgaccctttcaattatttgtttaagcaactaaccaaagagattaaaacaagcacgacattcggtattaaaacaagcaagacgttctgtacaacatattacaagtcaatacgttttaaaagatcagctcatcaagctgataatacatttggttcacacacaaataccaacacgaaacgttgctaccatagcacatcatatgatagcaactgcataatgatttatccttaagtgtatttaatgactttgcagtaacaatgtaccacatgaacaatatagctggaaagaacatccacaagcatgaagcagtcatcaccaactttattcatagctctgatcgacaagagtaccaccaaaaacagaatttcatccattcgttcgtgaaggcttcagtttccacggcagcaaccaatccacggacttacctgacgcatctcagtaactgcccgtatgcagaattgcagattactcattaggtcaaaaccctgggtctgagaagttaaagaactctccgtacatattctcatcagacaatggaagggatcatctaaaatccccttcatagcctggaagacctgccataccctgtaaatcagtaagtcaacaggtaaacatctgtaattgacataatctgattgtttagcatacattagttgtttagatgatacgtttggttattagttgaagaatcttctctggataattacatcatctgagcacgtggttggtagttgaattatttggggactgacgttcaattaaaagattagacaaattttcaagttaaaatttgataataacttcagattctagcgtatcatgaggcagaaattaataggaaaaaacaaaatatcaaaactaaaaagtaattaaactgcactattaatttagctggtataaatcaattaaagaattgtgacagagacaatcgtctccaggggattacaaatgaactcctaatattagcaaggaaataaatgattgaatcaaggagatgtaattcaattattcatttatcaagaaacacataatcttagataaacagtctaatggggcaaaggtagggctagataaagtttatgcgtcttctcattcataagagtatgaaacaaagcgaaaaaggagtaaaatgaccatgctacccatactatacttaaatttcttggtaataggagagatgatggtgttagtgaggtgtattaggtgagatattagtgtaagagagagactgataaatgaggacaaaacaaggaatagaagcattacaaaatgaaatggagtaccacaattaagtgcattcaaaacttaccagttccaagggtagcacttgttatgcttccaagacaagcatcttccaaaagaaacattacatgacagggctgtacttatcaaggccgaattcaagtgtcaatcttcgccacttactcccaacagattctcagcaaatcctgaaaccaaaagagaatataatacatttgaaccagagaatttcagtgtatttgtacaacaaaaggaggtgagttctgcatccaaaaactctatcaaaattgaggcacccaagaaaaaaaattaaccttcatggtacaagctagtcacacaaggtaattgccagaccatgcagattgtgctggtaattgttccgccagtggaccattttgctggttcccttgctgaaaattaagttctggaagttgctttgtgggcccaaaaaggtggaaatcctgccactgtttttcatcgctacctctaggatgcatgctgaaagcttgttttccaggaaaaggaaagggagtggtgaaagtactgctggcagtggtaacatttgaatgtgcaaaacgctgattattgacataatccagtgatgacctgtagccatccaaccagatgccgtcattggtctgaacatgctggccattgccagctaaaatggaatcatcctgtcgctttggaggggcattgttaaatcctggaggagggccaacatgtcttccaggacggctgacaggatttttctttgatacaccatcagaagatactactgacggcagaactgaatagaaggcagaagggatggtaacttcagtatgtttatactgaccaatcattggatttgtactattcatagtagcttgagcagatacctgaggcacatttcccacagactgtaatccactgagtccaccattcactctttgatccagaaatccacttgcacctatgttaacattgtttaatgcactcaataagaatgaatcttgcccagggagtatggctgtattatctgggttactgaaacaaccgagtgacgatggaggtgtacgctgatccgaaattatattggaaaagctcgccatagggactgtatccagtgagccaacaagtggtgcaccagtgcttacccagttatgatcaggtgctttcagagactcaaaaatatcagatgttgaccttgcaccaacatcaagaatcacatgttgcccagcattggctgcccaaccaagagaagagattgggagagattgaacataaacattgggagtcagaaccggtccattgctctgaaatgtcattggtggtggtgcaccatcatttgaccaattgacatcagacaccaccactggctgtaataactcattactagtctgttctgaagtaactctcggaagcttttcagaaactggaggcttgaaaactatttcttcatcatcatctccatcaagaaagagttgtgcctttgactgaagcacacctagatcttctgcgacagaaccaattttactggagacttcaggttcctgttgtatgtgatttgttgtctgcgcattggaagatacaacaagaggaacagaagaagcaggaggaggaggttctgaagccataaggaacttttttgaggatgcatcaaaatatattcgcagctgatcaatttgaacgaaatttaacagcgccttccctgcagcaagaatcctttctacacgtgcttttttctccttggtacctccatcacttccaaaaccttgcttggtggagaagtccaagataccttgagcaggtaccaaaggcgaaaaccctcttaactcaacatcctcccacaacgcaagcctgttcccagtttcaccctcctcatatgtgcccatgtcaaaaaagcaagtttcatcattatcaccatcgacatgtgcgagaccagtcaaaatgagcttattcataaatggcacgcattgactccagaagaaagatcttgcatcggcttgcttttcatccatctcagaactagccacaaaatctggatggcacgccagccattcaatgaagaccaaaatagctggcaagtagatacttgatgcaacatcatgaagctctgcgcatcttttgagaaggtatccaacaaattcaaaggctgcagcaaatgcattttgaagaagaactctgcgttgcacaatttcagcatatgattgattatctgcgtctttgtttgcattgtgcactgtgaatataaggatagcaataagcttaacaacagaaagcgcgttttcagcagcctcaacaccaaaattaagctcctcgtaaggaccagatgaaagaagaatttgcaaatcgctgataactgtagcagacaactccccaaatgtttccaagctattagaggaaaaaagcaagacattttaggagacaaagaaagagagaataagatgagtcacagaagtgttttacgaagtaccttgtccttgtgaaaagaattccattgaggcgaacaaatcgaatatagaaagccttcagtatttcttgaatactgtgctctcgctcctttgaattttcttctgtactagaacctttgggctgaaatcttgtctcaccccttcctctggccctaccaactgatctggatggcaagctcttagcgttgggaaccttgctattacctgatagctgagcatagatatcatgattctgcatatgaaactataagcgtttgagatccaccgcacagcaaaattcggattctgaatttgctcatcaaatataataagaagctgacaggagaaaccccctaggcacttgtacacactggtccaaatctactgcaaggctaaacggtgcatttctccattcttgtgttatgtgcatcagatactataaagaactccctcaaaaaattatagggtgtatattatttgaagaagtcttttgagaaaattatatgatgtgttttattataaaatatatttacaatacttataaaactaataatgttttataaaagctcttagaaggatgaatctattggtataacttctatgcactaaatatacttataatttgacaaccgttggtcaaaataaaaaaaaaagtgaccttttcaaaatattatacttcctccaccccacggagggagtacactctatagttttctagggaggaagtatgaaagacacgctgcaatcaatgaaagaacagctgtacaataataatataagtaagaacgtttttattgacccagttggtaaactgcagaacatttcttatcttatggaatctaaataagattataaaaattgaagatgtttttatcagtattttggtaggtcattcgtatttgagtcggtttttaagttcgttcacttttagaaatacagatctgtgtttgagtcggtttttaagttcgttcgcttttggatacaaaagacatcttataagaaatctctttaaaaaatctcgcatgctaacttgggacgcttttggaaatacaaaaggagtcgtataagaaatcattttaaaaaaactcgcatgctaacttgagacgagagtcagactcctaattacaactcatgattttctaaaaatatatatatacaagcgaattcccacaatgattttcacccaagataaaccgtataacaataaaaataagactaaaatagccttcacccgttgcaacacacgggcattttttctagtctaaataagaattccacaagtggataataataggctaaacaccagtaaagatacgaattttctgtgtacaaactgttgaacaacggaatccaacaagatcgactatctcctagctagataaaatcatgcagtatcatttcaaggttcaccaaggaaaaatagcttcaacacccaatcacaatactggaaaacaaggatcatactaaagtagtatcatgaaggtagcataataccttgtcaaatgcgagaatcaagttttccctcgctgcagaaaaaggattatccacagctaagctacggaagtacctatagatagctgttacctcatctccagcatatgatgccagtattgcaagctgagcaagaacacaaaaaccttttcatcagtaccatcgccattcaagcacacaaaacaagttttgtactaatggtgcagaaaattactacagcgacatgctgcatacctgatgatgtgggttgccattcgaagggcacagcgaagctgcttccttgtagtagatagaggctgcagcatattcacgacttgcataatccacatccccatacagacctttgtatcgggtaagatctcctaaatatatcaaacagcgatagcatgacaacaagccttttttcaccccaaccactttcttcccatctttatcaggaacaacagaactatcaggaccctcagagaagtagcccaacggaagcccataagtagaccgaattttcagcatcaagtcatgatagaaaccagttgcttctgagaggaaacttctaacagaagatctgatcctcttgatccgatcaggattggcattgttcttcccagcagagacaatatgagctcggaattcctcaattcttttgtagtgcaactgccacagaagatattctatctcacgtttttcagagaagtcatgatcagcaaggattatcttttcatagttctcacgcatctgaaaccatatgttaggatctgatggcactttggactgtgctgaccttcgcagacgactttcatgttcagcgttctgcagaagtaacatcattatcattactcactcgtatacactatctatttcaacataaggtttcatgtcttgaaataaactatagaagtggaagaaacaccatgtgaaagcaccaggagagaattttagtgaaggaattaaaaggaacagacataagcattcaataaatagtaaaaggaaataggccatatgcatccaataaatagtaaaaggaaataggcactccaaagctagatcaaggacatcaaaattctaaaagctttaacatctcaactcagaagccaaaaaaggtgacctatctatatacatattatgaacaatgagcagtcaactgttccacaaaaccatggacagctttttcatttggtggagatcacatacatttcaaatctgcatctagtttaaagttaactcagttccatgaacaacgtgattatggtcataaacttctctcggacatcgtcagatagcattaacccacagagaggaaaacgaatacacattccagtatgccaactagtagtagattatacagaggtttttcacttcttggcgctttttccacaaggcttcaacaaatatgaattaaaaatacagcattgtttgaaacacagtttaccccatcaacacaggaacccatatatataccacaaaatacatatgttacaaacatgaaatataaaatatatagctaccaccccatttgctctatatctatttaccaatatgactaaataattgccccataattaatccacttcacagctagctgtagctagcaaatgccacatcacaaagcacaggaacataaaactgttagctttaatacaagtgaatgttttaaattcatcacctggaacatttccatttttcaatcaagcaaattgtaatgctgaccatgctaatgtggttcatttggtcaagtgaaactgtttaaaggggatggaaatttgtgggcacaaaagttcagttacaactcaagcacgtgtgtgcaactatcgattaatgtgcaagctaactagcaccgtgggacgaatgcggtataaatgggaagaagccagaaccaagggcatatcacaaaggggacaagacataatgtgcacagttctgctgcattttccctaatggtaaaagtacatacagaaaaatgtcctacacacatgcatgaacaggtgacaaaggcaggtaacaaaagatgtttttaggagaaagaaaataaccaaagatgtaactattgcattgtttacaagaaaatataacagccctggacaaaccgacaaacacaattagacaattgcagttacagatagatgaaatagtgagcattagataggatcgtatgatctggtgcgaggaagacaaagcaatgcgatgtatacagcgatagcacacacagatagggaaagtcaacgctcagtaagcaatgtctgggacgaaggacagaaggaacagtcacatagagatgactgtaaacatggaatgagatggatggtgacaggagatcatctgcgcaactcagctcacaggaccacagtatgccaaaaacagttgcatgttagctgtttgaagagggttcatgacaacttcacacatataccattaatcttttccttgcatgctactacagaaactcacaggcaatgcagattgcagaaacattgaaaagagcaaaccttctttaagagccgctgtgcaagctcccttgatgatggggaagcagtagctttatccatcggaacggtcatcatccatcaatcacatatggggtcaactacgctgcggaggggaattaacaagaagtcaacaccaaatctcaagaggtaaaaacatgcagcttagtagtacaaagtaaagcctaccagacaccacactcaactaccgcgctaaaggggggaaatagcctaaacagaaccgaggaactacgctgcatccacgacgggatgaagcttccgcgaccgtaacaacccaaaaagctgctcgacccatcgccggcgcacaacatcatcccaaaacctaaacgcaatttcactagaaaccctaggtgaagaatccacctaccgacccagacgatcgcccaagaaaccctaggaacaactaacgctagcggatcgaaacccccaagaggcgaatcgagcagccagcatgaaagaacaatcccccgaaaaaaggaaccaccaaagatcccgcggggagcccgaccaagtcgaggcgctgaatcggtggtctcccgagccgaggccgaccaattgggcggacgccggcgccgaatccccgcgggacacaggggattcgataaggcaaggcgcgggggagggagggagggagaaagagcggggggtgtccgtacctcgtcgagcaggaggatgcagaggggaattaggaagcggagaggagaggagaggggagggaagagaggggggctatcgttataggcgtgagtcgcgtcgtggcggtgttggaattggctttggcacgtccagtccaggtcaaacccaaggtggggaggcgagacaggaggcggtgtgagaggctgccagcggggaccaccgtcggttattgtgttcttttttccgacgtcatttctcttcttttctttttatttaggctatctattttcaacttttttttcttcttccttatgtacgaagatttacaagactacaaaattcataataaactagccatagctcaagtttgttataaaactaaaaattcaaaatttagaaccacaaaacaagaggttttagagcatctccagcaataaaccttattttaaagccgggagcgtatcctatgcacacatgccctcacgtgtacacacgtgcacaccaactaaaaaatgtcaccaaaaaatctagaaaaaatcatacacatactttcaattgtattacacctagggttaaaatcttaacgtcaaattcattatattttagccgtaacaaaaaaaacaaaaaatctgacagttttaaggttgcaattttgtcagaattttatcttttttgttattctctatgtagaatgaatttgaatatgcgactttgcacgtagatgtcatagaatttttctagaattttttgtgataatttttagttggtgtacacggtgtgtacacgcgagggcctgtgtgcataggatacgctccctttaaagcccctaaaagttaaatgagggctgctcccatcttccaatgatcaaaaaaaatacctccaactctagcaatagcccatattttttagcccctactcatgtttctcttttattttaacatgcaatccttgtttacactatgtttaacaccacaataattaaacataaatatttctaacgcgtataattgaaacatagttaaatttacaatttcaaacgccacaattcagaaccaaaatcaaaattttcaaacatgtaaatatggtgtgggcagaatgccatatacaacaacatgcaaccaaaatttatagttcaccaatgaaaacaaaaatttctcaccaacatgtcattggctgtctccatatcaccacaataggctatgtgaacccagtgatgcattattttttttgcggagatgcattatataatttaaaaataacacaccctacaagaatgaatggttcgttcataaaaatagcaaatctaaaagtagtatatatcctactagcaaatgacacttagataattgcagaaattaacacaaaaggactccaagaaccaatcgtggaaatgacatatcctactagcaaaggacacatggatcatccaaaacgatccaacttattccattgaagtgctcaaacttctccattactgccaccaaactcacctccaaagccactactaccatcaaatccaccattgagggcagccacctttgaagctgcaatttgtgtcctcatagccaacacatatgttctcacatctagttccaagatggaaacatcacaaaacatgatcttctattcttgatcccacactaacttacgctcagcaaataagagcttgcgctcttgaatctccttagtttccttccatctctc

SEQ ID NO: 9501 - DNA, 1012 bp, Oryza sativa
  unsure (1)..(1012): unsure at all n locations
cgtcaagcaaatctttcatcgcctccttgtatggtccatcttctccattcttcatcttctcctttgcttgcttcctacccattggtctttttttagcacttggctgtaataaatcaggagttgtactcttcctagcatcatctccttcttcatcttcttcaccagcactctcaattagggtcgaagacttcctagaccttggcctcttgtgggattctagagtttgaaactttggagaattcctcaacttgagccaacaatgattaaactgaaatgccctattcttcggtgcattggatgaatacaatgcctcggcttcaagaacttgaagcaaaattcaagtgttagttcacatacatacaagattgttattaataataatgaataacaatttaacttacaagctcttgatgtggtatgccacttggatgtcgacgctcaatttgctcgtagcagccctgaaacttgcttacttccttttgaatgttaccccaatgatgctcaagagagtttgcattcctatcagactcaaaatcacggttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttcctttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttctaatcattagaatttagaacaggttatgctagagnnnnnnnnnnnnnnnnnnnnnnnnnnnnnnnnnnnnnnnnnnnnnnnnnnnnnnng

SEQ ID NO: 9502 - DNA, 597 bp, Oryza sativa
  unsure (1)..(597): unsure at all n locations
nnnnnnnnnnnnnnnnnnnnnnnnnnnnnnnnnnnnnnnnnnnnnnnnnnnnnnnnnnnnnnaaaatacttacagaagaggcacttagtcctcagaccaaaacagaacgacagcagcggaaaaaggcgatccttgcggggcttcagctccactccacaggcaaaactcaactggggtctgagccttggtcctctaactccatcttcagctcagaagcactacacttctgaaaaagggggaataatagcaagactgagtacaaccaccgtactcagcaagccacaccaacgatgcagacgtgcaaggggatacaaggatggcttgtggctatttgcataaaggcggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaacatgggactaatcacggtgaatctggtcgatcgcccataaccgcgggcacggctattcgaatagttttactctnnnnnnnnnnnnnnnnnnnnnnnnnnnnnnnnnnnnnn

SEQ ID NO: 9503 - DNA, 612 bp, Oryza sativa
  unsure (1)..(612): unsure at all n locations
agggcgaattcgagctcggtacccctacttacagcctcgccacttcaggaaaaaacataaatttaagagtaaaatgcaccagcggtccttaaacttgtcaggaggtttcacttaggtccacgaacttgcaaagtgcacatcgaggtctctaaacttagtttattgtatcatcccggccaaagccgcgtttgaccgtggtcttgcctacgtggcacgccacgtggacgatgacatggaatttttctcttctccctttttttttggacccgctgtggcctcaaaacctcctctcctctgccgctcgtctcctcctcgctgactcggccgccgccaccgccgcctctccgcgccgcgccgtgccaccgtagctgctgacgataagctggccatagcggcgacggcggatccgcgggcgaagccgcccgccgcgacgtcgacgcaccacctcgagccgtgggggcagccgccgccgccaactcccttcgatggtgggatcgaggagctttgggtgaagctcatgggtcacctacgagacgccgccannnnnnnnnnnnnnnnnnnnnnnnnnnnnnnnnnnnnnnnnnnnnnnnnnnnnnnnnnnnnnnnnnnnnn

SEQ ID NO: 9504 - DNA, 509 bp, Oryza sativa
  unsure (1)..(509): unsure at all n locations
nnnnnnnnnnnnnnnnnnnnnnnnnnnnnnnnnnnnnnnnatttttaattagttaaaattatttccaaggctctgaaaattccattaaaaatcctattagcatattttgacacgtagaatccaagaaaaattccacacgccgattccgattattaactgtatttattaatttagggtttctctcttgcctttaaacaaataatttcttaaaacaatttatcaattgaatttttgctaggaaggaaaacttcagggcgtgacacgcgcgctgtggggcaagtgtcattggggaaagccgcgacgacctagagagggatggaacctagaccacgtcctggtggggcttccttggggaaagtggcggcgccatacgtcgggaagtggcaccatctggataaacctggacgtcgtcgccatcttcggtccacatctccaccgacaagtnnnnnnnnnnnnnnnnnnnnnnnnnnnnnnnnnnnnnnnnnnnnnnnnnnnnnnnnnnnnnnnnn

SEQ ID NO: 9505 - DNA, 454 bp, Oryza sativa
  unsure (1)..(454): unsure at all n locations
nnnnnnnnnnnnnnnnnnnnnnnnnnnnnnnnnntttattttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaagtagaactgttctcctccctttctcttttaattaaaccaaactaatggcacatgcatttcataatctcttttaatagttctnnnnnnnnnnnnnnnnnnnnnnnnnnnnnnnnnnnnnnnnnnnnnnnnnnnnnnnnnnnnn

SEQ ID NO: 9506 - DNA, 2036 bp, Oryza sativa
  unsure (1)..(2036): unsure at all n locations
nnnnnnnnnnnnnnnnnnnnnnnnnnnnnnnnnnnnnnnnnnnnnnnnnnnnnnncgggattagtgcttccatctttatgatactctaatcttgtttatgtgataaatcgaattatcatatatcttatataatctccggcaatatcgctatctaacctacaatcggctaacatcgatctgtcagtagaagacagccgactaggttaaataccgatgttgacttagattatataggatatccaccactctatgacacatccaacggcttaattgtctagatattgacttttttttcatacttatagctgcatcagttggatttgatcttatgagtcgtgattagaatctcaatctctagcctgcctttggttgccaattagggtagcatcggggtttcagccgatcttacctgatttgaatatatttatcttatgtgcttgattgacatgttaaatccgccctttatgttaagatctcgtcgtatttaagtatattaagctttctgtttggtatattcgacttgctttaatatctcaatatagaacggtatcggagtattagccgatacatgctagatctatctgatcggctatgttatgaacatatataatcttgttgttaatatatatttcggtctaagtgatttatactgtctcggcatggcgaccaatttatcccaatcacttgatttaagtatatatcgacataaggattatatattgttaatatcaacagctgatcaagtagatttagttctttcttacttattaatgtctgccgatcgatgcatatatgacatcggctcaaagatcaatgatatgtcatcggcatctagccgatcggctatcgtttatagatttaaccgcggtttctttgtctttgtctcttgttgattgcaggatcaaatcaactggcatgctcacacacccaaaggcaagttttggacctgcactggagttaagcagatctcccaggcctcatgtttttacatcaacaattctatactagaataggaagagagtagagtagaagaagttggaagaattccggagttgtcggtaatcttctcctatttcttttattctgtttattactctgaattcaatataatattcttcttgagtaatttagatttatcttgtgagaattatctcttggttagtttctaaatagcatacaggattattgttcactataatcaactaaaacatagtgattgctttggtgagttataaacactaaagtagatattaattgcttagacgtggtgtttaggtaattattatccagtaattgatgcgtgtcccacagtacgttgaggtaggtgtagaggtggtgacagccctcgagatcacttaagtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtatnnnnnnnnnnnnnnnnnnnnnnnnnnnnnnnnnnnnnnnnnnnnnnnnnnnnnnnnnnnnnnn

SEQ ID NO: 9507 - DNA, 6283 bp, Oryza sativa
agtccttcctgtccgggtacgtagtagagcgacatctgggaacagcgggttgccagtgcctgaagtattgtgttaggattaaagttaagctttccctagacactaattctcactagtaaatcctctctatccaagcctatcctttgcttggtgtccatggatgaaccggaggaagatctgaccatacacgttcccttggattcgatacccttgtaatactccataggggaagtgctacattggtatatccgtgcgcttgcgcattttatctgtaatcgtattaaataccaacagtggtcgaagtggagccacccaagacagacagcctggtgaaattcatgcaaattttcctggagaaggaaacatcgatgcccaggaaccgttattggaagacgccggtaaaaccacccatatcgccaagaagttagagcagccggctcagaagaagccgccgtccgcaccaaagccaaggaaggtgtggagggaaaagccaaagacgcccgctccatcacctccagagacgggtggaaaatctacgaactgaatcagaaggaggtacggtcttgcacgtcggactttaaatgacgcgaccttcgccaacaggtaaattggtatgtatctacatttttgctttcaacaatttggatttttgcatcagcacatggttgaatttcaaagttgcatttaggatttttgaattttgaggaaattcttccaatgaatttttcagagcaaaccaaaataaaacttccaacaaaaattcgcagtgccacgactacactgaccgttggaatccaacggtcgaaagtggggccgattgggcccaccaggggttcggccgaacacctggttcggccgaaccggccaggcaacggtcggctgcctccctctttgaggcaatggctagtgggccccacaggtcggttttgaccgttgtgggtgcactacttaagccaaccggccgggagagggaactccaccccatttcaacaaattttcattccctctccaaagtttgctctcaagttcattcaagctttgatagtttccctcaaattcaaatacttagttgcatatatacaagctgctttggtgaaactaatcggcgggtgaaattttttttattcctaacccccgccgagttagtccgttcttgctccattgtgcagaatgaggaggcgattgtctcgtctgttcaaggggtccagctcttcatcaagtcatcatgatgagtctagtactcgttcattagctaatgtctcgatggaagacgccgaagctccgcgatgactcctaaacgacaccgaccttgaccttgtcagtgatcgggaaagacaagcctactacatgttgagcgaccgggagtatgctcacacacgagaatactctccggagctgctaaaaaagataggtatggatgttgaatttcgttctatttggaaagtggttggttggcaaagatttgctgtggtagatgagcctggttctcgtttgcttactttgcaatttctgtgcactttgaaagaaatagaagatggaatttcctttcgctttttccataaggagtacacacttacatagaaaggcttaagtacacttcttggttttcacgattcctgtaaaatatatcttcagaaaggaatttctgggttcgagaaaaataggttttgggaagatatttctggtgctccaatttgcaagaaacctatgacgaatgatatccataatcctacacttaggctcatgcataaatggattgctatgactttgtttcctagaggtgatcttagacccattaggagggatgaattgattatcatgtttgccatggttagaaagatcaaaattgctcctgtgaaatgtatgataaggcaatggttagaaagtataaagttctctgctcctgttgagttcacttctcttattactcgaatagcaaaagggctaagggtcgttagcgactaaattgcttttatctcagccgctcgtccgtgtattgatgagacctatctagtgcaagggcatattctgaagcatggagtagatggatctttgatttactttttccccggttgtacaaatgaaatcccgttgccaaatgcggggtatcatttgtacaactgccatgaactaaccatttccctgcaaaccatagaagaatttcgtgtaggtggagcatacagggagacgcgcaacatgacaaggaatgaacgagagagttcatcatcctcaacacccgtacagatgtatgaagcaggttgggcaccagctggggatgcacccggatggacccaagctctacgccacagcatcggagtcttaacctgggcgagtgccagtgaggaccggtggcgtgcgcctcatgacatccaatggggggacacccaaccttccagatcaagtggtgtgcctccattccttgatatgcagatgggggagatccagtacaacctcatggaacacatagctcaaacgcaagaatggcaacaatctgctgatgctcagttcgccaacttcaacaacatgatgctgcaacagcacgatgaccttcaagcgtacttccgttttcaggggttcaatccttatcaaggatcctgagcgaaagcaagcttggggggagacacctctccccctccctccccccccccccactgaggtaacttgtatcacattgcatatttccctttccaattgcatatttgctttccaattgcatcttataaaacttgaaaacaacataaaaatttgcaaaatagaaaatatcaaaaaaaaaggataggtttgagtcatgctaggtaagacaagctagttctctttgttgaaatgatgaatagttgctctgttttatatctcttatatatgggttcataggtaagtattctatcaaaggttaaatatgagtagccaacaattatccgggaacctaaggtaaatgggctgcacttgctgatctaagtctaagttattgcgagatatgagatagtaaataagaattgctatgatcctgatactagtttgacttgaattccggatgtttgtttttcaaaatgataaattgagagttcctcatttgatataaattcctaccaaagccaaaaatgtgctatcatgattaaaccatataaattttggttgcttgtcattccattgaactttgtcaaactcttgtaacttgtgtagatacttctcatgctctatgatcaagatcatacacccacatatatgcacatgctaaactcctacactgggagctaagcaatattccatattaccaccaaaaataaattctccatactttcatgtgctttcttctcctaaaaatgaaaatccttttgaaaaaaaaagagaaggagggaaaggcatggttgtgaaaaaataataataataaagttatgctccatcaagcatgagcatgatgttgaaaaaaaactgtagccatgccctctcctaatcaataaaagaaggatttttgggagaagaaagtaagcacaaaggagaagcatttttctttatttttcctcatgtaccactttcatcatacaccacacacacattttgcacgatcttgatcttgagtatgtttagttatctgctttagtctaagtttttgctttagtaataaatgtgaatgcaagtatgccatgtttgatccctaccaagctccacatatcaaaccttagagtaggaataaaaaaggaaaaactggtgaggaattcaaattgatacacttggagagaccgagtgaatcatttgaggaacttggttttctttttcaaaatcatttgaaaacttctggaataagagttgaatgaagattggatgattggtgctctaattgttgttctgtctttcaactgcccaaggcaaggagaagcagtgtctcgtggtaatcaggagtaagggtaagtcaccgtgtcaaagattatttaatctgagagagattacatataccctgcacctgtatctttgagatatgcagcatagtagcaactcctgatcaacaaccaagtctttgtttccttctgtccttcacttggaacgagcaaaggttcaagctttgggggttttgttgacggtcgttatcgatcagtttcgaccgtcaatattactaaaatagagaagaactagtgatacttgcaatgcatatatctgttagaataataatattccactagtattaggtatactaaccttttgcagagaatgacaataaagtggaggagaattgtcacgtcctgataaattcatcccgaaataaaaatcattccctaaaaggaataatagaattaattaaaattcaaaaagaaattggcaaacactaaaatacgtacaagaaaaattcgaatatggcccggagaatttttgttaaattctccttggtctaaaaggagccctcaaattttacttgaattttcagagcaccggaaataattattaagcaacaacaacatttatcaaagtttactaaaaagaaaaagctaaaaataaaccctccttcctcctttgggctgagcccagcccaaagtccttccctcctccctctctttttccatccctctctctctcttgggcctccccttccccttccggcccactccatactctcctcctccttctgggccgaccctcccctcccttcttcccctcagcccagctccctcctcctccctctccctcccgggctgcctctccctcctctcctcctgggccgcctccgggcccaagccaagcggcgccctcctgcccgtgccacgcacgtgcgtgcgctgacggcgcgcccgcatgggtcccacgcgccgggtcgttgtcctcctcccgcccgaccttctctttctctcccggaaacctagcgccattcctccccaaaatccacgcgattcaaaccgggaattccaaaattgattagggggaattaatcccctttccttcctattcaattccccccaatttcccccttgattcgtgccctctaacgcccggaacagccgcgccattcccggccgccttccatggccaccggccacgaattccgccgccgttccccgcctctcccgtggccggctccctcccctcacctataaactggaaccccctcgctccgttctctcgttttagccttctcccgcacccccccgtgtgatatgaccatggctactacggatacatccgttgctcacatcatggatgaacaacaagatatcaagttcgagtcctccaagtgccggaatccgattcggccacctgctacactgctgacttcaaacggccgccgaatctgcatacgacctccgtttttggcccgtgaatacttgatggaaagctctcggagcgctctttccaacggatccagcctcatctccgaattccatctcgtgtggccggaatcacacacacaagttgctgcatcacctataatgggcctatgggcttgtaacttcatttgggatcccggcccaagtggggcccatgtggggtgcgccccagctaggtggagcacgaccttaggcacccctaggtcatcctcccacccctatttatatagctaggtacccattcagggtttcttgggttttgatagattgaagtttagccattgctacttgcttgcagcgcgcgtgtcggctagaccgtccgttgtcacgaccggaaataacccaacgggcgttccttacgtgcatgtattattccttgtcccaggaggcaaggtacaccaaaagttgatacatttcagagtttatcaagcggaagcgtaaataattaatttattacatgggcggcgaaggcccagcacacacaaagacaaacgggaaacagcggaagactagggcgacgaccacaggcgcttgacggcaggcacgagctagacaccaaagccttcatcttccaggaactcctcttctgggtttgggaaaaattgagcaagactgagtacaaccaccgcactcaacaagacacacccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcc

SEQ ID NO: 9508 - DNA, 6974 bp, Oryza sativa
cccacaagtgcagaataaatgcaagggagtacaagggagccataatatagggggttagggtttgcagtaaacagcattaaaagtcacttagttgctcaaagctactttgtaaacacggtcctagagatatacaatattattaattaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatctttctcacgtgtaaccacgtgccacataccaccacggtatacggacggaagacgtgacatagtttccaacccatcctagccatagacaagagtaccgacccaaccccaactacggccggaacctccgggataggtaggcaggactgagcccctagcagtaggacaccggccctgtgccatgacatctcgactaccgggccgtagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgaatccaattccacaataatccatccattccatattgtccaggtgatgagaatattcccaaagtctagagttgtaaaaccacctaatgttgcctaattaaccagcgaagcatctacctaaaatcatactagtggtaccatgagtagagtgtctactagttggggttttgtttattctagggtgaacaaggaaatattatcaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacctccacgaagagcagatcttctgaagctgcagcgtctacacgaccaatggaaaataaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacagtccacggtggaccaggtgcacccgggctcacaccggccggcgccgtgggccccacacgtcagccgcacccgagggcggccacgccggcgcggtcggcgggagacggcgcgcctgtgccccgatgatcgccgccggcgaccaccggcgcggcggagcggcggccgagagaggggagggaagggggaaaggaggcgacggtccacggctcaccccggggcgacggcggcgacggaggaggcggccggagcggagggaggcggtggcgcggctcaggtcgacggggacagcggcgctccggcggtcggcaaccgaaacagagaggtggacgaggtcggcgaggatgcggtgaagccgaaggaggcggcgccgaggtgggaggcggtccggggcgacgacggcggtgaaccggagctcggcggcgacggcggagagagaggcgatggcgcgagctcgattccggcgaggagaaggcacggcaaagggtggaaacgggcgaaggaagtgcggggagggtttaaatagggttggaagggggagagagcggccggaggggaaggaaaccggcgcgggaggtcggccgccatcaatggcgccggcgagatttgcgggggcaaatccgcccgtttgaacgcgagagagagagggaaaaatggggggaaagggagagggaatcacgggaagtaattcgccccactttattgcacgcggggacggcaggaggcggcgggatccgcggcgccgccggcgctagggcgcgggcgaggcggcgggagcggcgggaggtcggggatgacgggtgggccccacccgtcagcgagggtggcgggcaggcccgcccgtaagcggcgcgcgcgcggggagagcccgagtgggccgcggggagaggagagagagagtggggggaggaagatgggccgggccggcccaagggagggaagggggacttttagggtttttctttttataaaactttttcaactttgtttatttcttaataattattatttgtgctctgaaaattccactaaaatttatttacacattttaggcttttaggaaatatacaaaaatcctctaagccttatttgacttttaactttgcacattttaattgttggaggctttcacatggattttaattattataggcataatttaaaggatatattttagagtcgttttggcacgtgacatctgtctgcttgttcttcggaaccccaacttatcattcgtatttaactcctatttgcaattcagattgcttttatcttgttcttgcttgtatcttcgatttgcttgtaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcagctcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgcacctgtgcatgcgcgtgtgagaaagatggaaggagaagattagattagattgactggtttggtttctatttagtgccgagtctgtttctatttatcacctggtacctttccaaaccgaagccgagtaggattccttcccttgcgtcatcttgtggccgagacttgtgagtcgactcacactccctcacgtttgtttctgtccggattggttaaacacttcggtgaaattttatttttggtgtcggattcaagatccgtttgcaaaaacggaaccgacataactttagcattccattgttgtataatttttaattttggtttggacttttacagttgagtccctgtaatttttatatttacgtttgagtccctgtaaccttacattgaggtccttgaatctgtttttgtaaaataaaatcaaaaaaaaagaaagaaaaaaaaaggcagaaaggtgcataaaaaaaagaaaagaaaagccgcacccaaaaaaaaagaaaagaaaaggaaaggaaagaaaagaagaaagaagaaagaaagaaaagagaaaatactgttatgtttgagctgaacttcatatatcagagttgtgcatgagttattcctagtgctatcttgtggcatcgtttgtgtctaggctcgcgtctctagtacgttctagcctaggaccagcacggtgcttgactttgaacaattattcaactttgcattctctgatttgagcatttgctattcctttgctacatatttaagcctacccagagctccacagatttgattgcagccgtacagcaagtattcaccaaggcatcgatacatccaacctccattggggtgcttggttgagtcggtgtatgtcaccattccgcttgcattggtaagatcttgtaagagcttggttaaaagcttgagtgtgtgtgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcattgccttatttcgagggaaactatgatcctcgtgcttacattaattgggagctagcggttgatagtgaatttcaaaagcatgtcttgtctgagaaacaaaaggttatgtgtgcctctagtgttttaattaaacatgcttctaatgattggaaacatctttgtaggcataacaaaataccacaatcttggaaatacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatgtgggctaaacaaagaaattcaggacatgcttgattgtcaaagatatacatctctttctcatttgttacaacttgcttgcaatgctgaaagtaaaatagaggagagagacatgaaagagccgccaatcccattgttcacactcaaagtcaaggcacctccatcatctgaagaggacatcaaaggtaaagtaaatggtattgaaattaatcatggtgagtgcattgttaacgaagtaaatttgtccacctttcatactaaagtagagcaaccgttagtggaatcaaatgctggaattcctttgtcacaagttgatttactcgctgttccttgtgataaagaagagttgtgtgataatgcttcacttatatccatgccacaactagtgaatgaacatgatatttctagagtttctttgtgtgctgattttaagcatgctgttcacattgctaatgaagttgaggaacgtaaattgctatcttctttaaatactttgggctatgttcagtttgatgatttttgtgagctcgataatttgaaggagaaattatttgctaagtctgatttgccatgtccaactaatgctatttttcatatcattggcaaatataatgatagaggaatatatttggtgcatagagttttcatttgttcggatgtagagaaacatgttattgctaatcacactacttcgagtttctcttgttttgattgaatgaaacaggttattttgaatggactatgtgaagaacaccatatggaaaaaccgaggacggttttccgtgaagaaggggaggatgatgtgaccatggctactacggatacatccgttgctcacatcatggatgaacaacaagatatcaagttcaagtcctccaagtgccggaatccgattcggccacctgctacactgctgacttcaaatggccgccgaatctgcatacgacctccgtttttggcccgtgaatacttgatggacagctctcggagcgctctttccaacggatccagcctcatctccgaattccatctcgtgtggccggaatcacacgcacaagttgctgcatcacctataatgggcctatgggcttgtaacttcatttgggatcccggcccaggtggggcccatgtggggtgcaccccagccaggtggagcacgaccctaggcacccctaggtcgtcctcccacccctatttatatagctaggtaccccttcaaggtttcttgggttttgatagattgaagtttagccattgctacttgcttgcagcgcgcgtgtcggctagaccgtccgtctgcttgttcttcggaaccacaacttatcattcgtatttaactcctatttgcaattcagattgcttttatcttgttcttgcttgtttcttcgatttgcttgcaggaataaggttgatctgcaccggcaagatcaacaacccatggagaggtgtatcgatcgctaaggcgcaacacaacgtcttgtacggttgtagtcggatcgtcaacgtcttttccacaaatcgtagttatctcaactcaccgaaagatcgggccaacaatagccttgagtgtctcgagtggaactcagggttcatcaggtgatatcagagctttcgttgctcggtgagtttttttttatctacctataaccagaaaatagccaaccaaaaaaaaaattgtatcttttacctagccatattgtgccattgcattgttcttttcagtttttgctttgttgaattttgtgttgcatcgtcatgtcgtgttgctggtcttagcgtctagttcgtttagagtttcgagttctggtcacattttgtaccacagtcgtcaccgcccccgtgtctctgttgtcgtcgggacctacgaaaacggaattggctcgctgccacggttctattttcgtagttttcagaagtttatgtcggttagtttttgagttcttgagttgcatagcttctgtttggtggctgtgccgtgatggtgcatgccgtgatggtgca

SEQ ID NO: 9509 - DNA, 1551 bp, Oryza sativa
tttaactttgtttatttcttaataattattatttgtgctctgaaaattccactaaaatttatttacgcattttaggcttttaggaaatttacaaaaatcctctaagccttatttgacttttaactttgcacattttaattgttggaggctttcacatggattttaattattctaggcatcatttaagggatatattttagagtcgttttgggacgtgacaggggttttgttggcggttgttaaatgccattctcatacctccaacatctgcataaagtcgagacaataaaacatccaacatagtaataggtgcttaatctcacatattccacaagtgttggtgtatatttgtatgcagatgataaaccttgaagttgggaggaaaatcagactaaagtgaggagaattatgtatccatacaaggaggggttgtgaacttcattgaaacatcagtaaatgaacccaaaactccgagaaatggaaacaggaaggcccaggaagtccaccaaccgaaggccagaccaggagggcccaacccaggttcggccgaaccctagtgatcaggggcggagcccaataagctgagggggattcccaggaacccggcccaaacttggaaatcacttgttacccctatagtttcaccatgtaggaaccccctcagcccaaaccaaggaacccccttcttgtccagcccagaatggaaaaggcccaagtaggcaagcagcagacacaaacacaggcaggcccattcgatggagtcctttgcgctgctcgaggcttgccctggaagcctcacaatcatgggagtcacgacgcggtcaagcgggcattagcacaacacatcgtttcgtcttcaggataatcaagttcgctgtacgcgcctcctcgctctcgcaatctcgccggctgcctccgttccggcggcagcctgattcaaatcgccgacgccaattgacactgtgccccaagccccaaggtcaccgtgctcctgctgctcggcactcctgattttgccgctctgcccgtgatgactggttttagctagggcgagccgagcagcccgagcttctgccctttgaagtttaatcgttgcattgtgtgatcttgtctagttgtctaacagggatgatacattgttgcttgagttggagcctctgagctgttggacggcaacttggtgccgacgtttcatccaagattagctctccttggctctgggcctctggtctctcccaatccaccgacaacctccaattgagagcaagtgagatttcccctcacttctcaaccttatttcttcaatcttgaaaattttcatcttgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttcc

SEQ ID NO: 9510 - DNA, 3754 bp, Oryza sativa
tgtcttgaataggttttatacgatctactgatatgttttgtgaatagtgactttgtgtctgtgcttgacactttagtaacttcgtgtatatttattagttggtttctttgttaaggtacacaatttctaaatatttatgtattttcttgttgtatattgctatcaattagataatgatgtttacagttattagacacacgagtatttagtactccataatagtgttccaactagatatgcggctatatacaaaagaaagctgtaggaaccccccttgattttgctctggctccgcccctgctggtgatcgccgttgatcccaggttttggcatggacgtcccagatcacgccctgatggcggttgcggggcacttcggacatttccccttcgccaaccgtcatacctacccctatataaagacatcatctcactcacttcaacacacacttccaagcttgagctaaattataagaggctctattgtactatattgttgttaacgaccaaatttggtaatctaagtattggagatggagttgagaccgaggtggaaattaagatggaatcgctcgaggaatagagcagaatcggctgatgtccgaatcggctgcgactaggatcggcagagttcgagttggacagggttagccgattgagccgaatccgataatatgacacggcatacgttgtcgggttaggttgacgtgcttcatgatgatttccacgcatggatggagtcctgagaaggcaattgtatagtgcttcatgatgattgccacgcatggatggagtcctgagaaggcaattgtatttattaattaggatattttatgtaatttctttagagatatgtttgggcaaatgtctgccgcaaagacttatagtatcttagagtttgttagagataagagtcatgcccgatatggacatattttgtaatctcgggtataaatagaccccgagccccatgtaataaaactaacacacgttcaaatcaatctcggtgcatagccacccttttacttttgttttgtttcgacgagttcttgctttggggttgagctgcatcggtttcaatcttcaacaagaggtaaaacttattgtggcggcttgcattctcgggattagtgcttccatctttatgatactctaatcttgtttatgtgataaattgaattatcatatatcttatataatctccggcaatatcgctatctaacctacaatcggctaacatcaatctgtcagtagaagacagccgattaggttaaataccgatgttgacttagattatataggaaatccaccactctatgacacatccaacggcttgattgtctagatattgtcttttttttcatacttatagctgcatcagttgagtttgatcgtatgagtcgtgattagaatctcaatctctagcctgcctttggttgccaattagggtagcatcggggtttcagccgatcttatctgatttgactatatttatcttatgtgcttgattgacatgttaaatccaccctttatgttaagatctcgtcgtatttaagtatattaagctttctgtttggtatattctacttgctttaatatctcaatatagaacggtatcggagtattagccgatacatgctagatctatctgatcggctatgttatgaacatatataatcttgttgttaatatatatttcggtctaagtgatttatactgtctcgacatggcgaccaatctatcccaatcacttgatttaagtatatatcgacataaggattatatattgttaatatcaacagccgatcaagtagatttagttctttcttacttattaatgtctgccgatcgatgcatatatgacatcggctcaaagataaatgatatgtcatcggcatctagccgatcggctatcgtttatagatttaaccgcggtttctttgtctttgtctcttgttgatcgcaggatcaaatcaactggcacgctcacatacccaaaggcaagttttggacctgcactggagttaagcagatctcccagacctcgtgtttttacatcaacacgcttttggcacgcctggtgggaccattagaagtcagaaccgcaacagtattctctcatggctgagaaaccaccagcatcgccgtctttggccggcaaagaagtttcttccaaaactaggatcccgaagtttggtgggtctgaagttcatgagagcaacatcatgctcatcattttggacaaattgacacctgaacaaaagaaggatcttgaggcgatgatgtagcaaacacagaaccaattcttgaactcattcatggagactcgccaaggaacaattgttcagaggtacaagatgaaattagatgctgatgttgctgcgacaagttcttccaaggatggggaggtacaacaggtctcagatggtacggctcaatcaggtgataaaagtgctgcagatggctcaggtgataagggtgatggttctcagggagtgcaaggtgaggatcttagcccagatggcaacctggcgcagctacagtttaacaacttccaagatcggattgactatactgtgcgacatgctttgattaatcaatctgggagtgtagtcaatactttgtcaaacatcgtgaagtcgatggttgatggctcaatagctgagtatcaggctacaggaccagtttatttaccaggaggtgttttcccaaattatcggcccttgatcacaaataatcagccgactgctcagccaattgctcccaatgcgccatcagttcaaccgacagcaccagtgtcggctcctgcacctgctgcaccatgatcagcaccagggcaattaattaatcctcggttgttggtgagagagcagccacagcatagtggacaaaatgtgaatcggctaactcaagagcaagttgcagctatgttcttaccaactcggcctactgctgacccagttcaacagcagtcgattcagcagacaccaccgaggcagcaagttgctcagccgattcaacagcaaggtttgctaaatgcatcggttgggtttaggacgcccgataatcagccaaggcagcacattgcaaatcaagttgttccagagcatttggttcataatgtgcaaccagatcgatcggtgataccacaagttattcccaaacatttggtgcacaatatacagccaaactttcagaattatcaagggggcaatttgaattatcagtatcagcctccatcgccgcaagttcagtatcagcaaggagggtcggctcagcctcggttcgctcctcagtacaaccagttcgagcctgtgccacagcaagtgcagggggtgcctcaacagagaccgtgggccaatatgattgcagatgtgatgagagagcaatttgggctcaagccaaaggacgctagaaacttgtatcggcatccaaaccctgagtggttcgagagggttccattgcctaaccggttcaaagttccagatttcacaaaattctcagggcaagatagtgtttcgacctatgagcacgttagccgattcttagctcagtgtggtgaagcatcggctgttgaggccttgagggttagggtgtttcctttgtctttgtctggatgtgcttttacttggttttcttctttgccatatggatcaatcaacagctgggccgatttggagaagcaattccatagttacttttatagcggggttcacgagatgaaattgtctgatttaacaacgattaggcagagg

SEQ ID NO: 9511 - DNA, 2898 bp, Oryza sativa
  unsure (1)..(2898): unsure at all n locations
ttaggcagaggcatgatgagcctgtgcaggcctacattcagaggagatgaggaataagtgttacagcttgagcttgactgatgcccagttaaccaatttggctttttagggtatgatagctccgatcaggagaaattctcatcccaggactttgatattttgtcacgtcttgcacagaaggtaaccttgcatgaacaaaggtttgcagaagcccggaagaactttanaaaggttaatcatgtctgtccctacatggatccgatgatgatgatgatgatgattctgaggtagcagcagccgagtgggttaggagtaagaaggttataccatgccaatgggtgaagagttctagaaaagaagagaggtatgacttcgacatcaccaaggctgataagatctttgatttgttactttgggaaaaacagattcaacttcctgctggtcatacaattccatcggctgaggagctagcaaagaggaggtattgcaagtggcataattctgggtctcattctaccaatgatggcaaagtcttcagacagcagatccaggcggctattgaaggaggcaaaatcaagtttgatgattccaagaagccgatgaaggttgatggccatccttttcctgtcaatacggtacatacagctggtcgaacagccgatggggggaaaactcggggttttcaagtgaacttggctaagattatcaacaagtatcagagaaaatatgataagcagcaggaaaggtgttatgacgaagatgacggcggttttgacgaaggtatgaggctgtcgtctattgaagactgtcctaggtgcagcaatgttacagaaatttcaaaccgatcgcataatagaggcaatccgctaaggcaagcaagggttcctgttcatcaaagattgggcccaatgaaccaagattgtgaccaagaggacaatgaaggcagaaagactcaatggtgtccttctggtatttttacaaagaatcagaagagaagggttcagaggttgaggaacagggagcgctttcaggaggttgagcaagaaatcaaccatcggctgaagaaaacgaagccgaagcaggagtggcgcgttaagaatcaagttcctacagctgatgaagccatggccgatgaggcaaaaatattggctaaagggaaaactgttgtgattgcatcggttaacatggttttcacactacctgcagaatttggggccaagcaagccgatgttgatgaagttgaggaagcatcagctaggttggttttatcaccagaacaagcagtctttgagaagccagaagggacagagaatcggcatcttaagccattgtatgtaaacggttaaatcaatgggaagccgatgtctaagatgatggtcgatggtggggccgcagtgaatttgatgccttatgccacatttaggaagctaggcaggaatgctgagaacctcatcaagacaaacatggttctcaaagatttcggtggcaattcgtcacaaactaaaggggttttaaatgtggagctgacagtcggcagtaaaaccatccctacaatatttttttgtcatcgatggaaagggttcctacagcttgttgcttggaagggattggattcatgctaattgttgtattccttcaaccatgcatcaatgcttgattcaatggcaaggcaacaagattgaaattgtaccagccgacaggtcagttaacgttgccagtgttgattttgctctttgggagatggatggccttgattgctagtctggaaaggtttgggaaggagattttctaaaggtgttcgattatgatatacagccgattgaatacggagagcccaagttattatattgagggcatcgtggagggttcaaacgtctacaccaaggacacagtagatgatctcgatgacaagcaaggaccgggtttcatgtcggccgatgatttggaggaaattgatataggtccaggtgatcgaccaaggccgacatttatcagtaagaacttatctccagaatttagaaccaagttgatagagcttttaaaggaatacagagattgctttgcttgggagtattatgggatgctaggactcagccgatcgattgtcgaacatcggttacctatcaaaccaagggttagaccgcaccagcagcctccgagaagatgcaaagccgatatgctcgaacctgttaaggctgagattaaacgtttatatgatgctggttttattcgtccttgccgatatgctgagtgggtttctagcatagttcctgttatcaagataaacggcaaagtaagggtgtgcattgatttcaatgatttaaacaaggctaccccaaaagatgagtatctgttgatggtcgttattgaccaatttcaaccgtcaatattatccaatatatgaagactagctatgcttgcaatgcataattctcaaataaaatagttacttccactatatgctttgctactaacatgtatgcaggagaagcactcgtaaatgaagagaacgaggtggaaatatatcgatcaatcagtcaaaagtctgccaacgatctacaattacatgagaaggcccaaaagtccaatttaataatcacaaatgggcctagaatgtatgtcactgatttaggggcccacatggaagtctccttgaggaagctaagggccagaagagcccatagggggttggccgaccccttgttgagcccaatccagtcacattttggcctggagataagggaggccaaggaggaagcagcaggccaaaaactaggcctattgggccactctagggttcggctgaacctagtaccttgatcttcagccgttggctctcccctttggcatggacgctccggatgaactctgatggcggttgcggagcatttccgacaa

SEQ ID NO: 9512 - DNA, 14843 bp, Oryza sativa
  unsure (1)..(14843): unsure at all n locations
atttgcattgatgctggtataatgtctgattacctggtcataagtctgctctggctaggctgagagctatggcccggggactcagctgctctgcaccgattgaatggttgtagagtaataagtagtaatttaagcatggagcttaggttacctcttatcattatttgggggtatattctctgggtgatttgcaggccgctgatggtgacagctcagtacgggtgtctcccctgcagtttatattcctacatacaatttcctagggttggatacacctccgaatcctacatcggttggagggttatgacaggttgtcgtaagaaactcggcaacccggggtaactttgcttttcatcgggagggcatagctatgctgcattgttaaaggggttatattacatagtgtacaggaatagaacatatctaacctactgccacttagctataattaggagatgtaggagttagctaaatccttagctgtgtgtcattctacccttaagctaaacatacccctgcatagacccttgatgtatacaagtaatatataaactattagcatagtactctcttaccatatcttcccttgggattaaacaaatacgatacctaggaatactcccgggtgaaatggtacaatggtatatctgtgcgattccggatcacatctgtaaccataatataccatgagtatttctagtgctattgctgggaattatatttccagtagtgtcgctaagaaataccaacaagcatttctggcgccgttgccggggaagataaatgattaagagtttactacttgctaatagttttatatttacctctgtataagtcattgtccttcgtaggcaaaccttgtttgttttctcttttatgtgaaaacaaggtagtacaggactagttctgatctgccgaccaatttcaaatctggagtcactagtgaagtgaagccgaccccgtgtcgtttatccttaaggttactctatcggcaaccagaccagccaattccgcgccaccagaattacacgatacggctgagaagtccctttgcaagttcgctgctcgctctgctggtaacatactagttggaacccaagtcagcaggggagatggtgactttgatttaaagaccagctaaattaacgatggcgcaggcttgcccgttctgtggcaagcctaaggaggatgcaagtgctcatttgcagcaatttgtggaaagccatagcacgtataccgtcagaagaatcagactccaactgttgccgttctccctcctcgagagagcagaacagtggttctacatcaaccgtgcaacggtgaataccgaaacaattgctcaacagcattcctctcaagattcttcctgatgggcaagaccaacgctcttcgcggaagaatatctagctttcagcagacgagggatgaaaccattcttgaagattgggaaaggctgcaggaatacgtcaccacccgtcctcatcatgggatggccgagtggctcatcctgcagaatttcttcaaatgattaaccccctcgtcctaggatcacctggatgctgctgctggagggacattcttctcaagaatagtcagatgccaaccaattgagaagatggtctcaaatatgggttggagcgaggaacgactccaaacccgtcaatgcggcatgtacaccgtcaagaggacggagatgctcgccgcccagttggatctccttatgaagagactagacaacaatgagaaggataacaagcagggtaccgttaaagccctggacttccacacgacatgtgaggtctatggcaacaccggtcactctgggatggattgcccgaaaacccatgagaacgttatgctcatgaacaataacaatgggtatcgtccacgaggagaccaaggatggagcatttctccatggggtagatcaagaatggaccaaacacaaggaggtcaaagtaaaaccccgaaggacggatagcctcaatactttcatgatgaacttcctggagcaggaagaaacgagtaaccgtcaataccttaagccggcatccaagaagccgggaatacaggccggtcaacctgtgttcccagttacgaagaggccgctgcccgcacctaaggcaaagaaggtgtggcgggttaaggagaagacactcgttcctgtacctccggaactgggtgcctcattgagctaaatacgtcggaggtatggtcgtgctcgtcggacctaaaacgacatcccccttgccaacaggtaaattggtagttatctcatatttattttccattgcatcaaagcatgtttggattttcaaacacacattgagatctgaatttgaggcaaattcttcaaataaatttttgtgagcaaaataaaataaagtttttagaaaacttttgcacagccaccaccacattggtcgttggaatccaatagctaaaggtggggctggttgggtccaccaagggttcggccgaatccctggttcggccgaaccggcctggcaccggctggctggaaatttttgcagggtagcggctagtggggcccacatgccattcctagccgttatccatgcactatatatgtagctcggctgggagaaggaagtcacaccaccttaactcattttcactccctctcaaaaccttgctctaaaaatttattcaaagttttgcaagctcgcctcaaattcacacaatttgctgcatttagtttagacacttgcatatacaagtttgctttagtttggtgcaaggttatcggcgggtatttgcttaacccccgtccgagtagtcttgtattcttgctctttgctgtagccataaagaaacgacttttgggcatattcaagagacgatcaagctcacggacaagccgacacgataagccgagtacaccttcttccgcggatgcatccatgaaggaggcgtacattccaccgaggctgtacaacaactcctttcacgacctcgtgggcgaccgggaaatgcaagcctatcatatgctgaaagaccgaacctgtgctcggacctgagcatacgactcgaccttctgaaaaggataggtatagatgctgagcttcattactttttggcgtgctataggttgggataaatttcatgtgtagacgagccgggttcctggcgggcgccgaaaaggaagcagtgacgccttttcgacgaaagcttagcttggtaggcgctgcttactcaccctattcccttagacaatgcaatgctgtgaacacgaaagtttgcagttcagccctcttctcccatgcagagtcgcaggcagcgcctcggataaaagcatggacgagccacatgcagggaaacttgcacgtgtggttctggccggggaccccggtatactgtactaatatgtgtaggtccctgtaattcgagtgagattgtcatggcgcaaaagcagatatggtccggtattcccttgttccccgtattggttatgttctttattccttgtctagcagaaactaatcgagctccgtctgatctcccagaagcggaagctgaatcagttgctggctataatgtggaatatgcacgggatgcgatccttaatagttcaagtcccatagagttattttttatctttgattcccaaacgctgcgtgcaagtcaagcttacagaattcctgccggggcgccttctttcttatgccagccaagtagtaatcagaaaaccaatcaatcttccttacactacgacaattcacttgaactaccaacatcatgagtgacccaggccggccgtatatgcgtcatttctcttcatcattgtctctatttgttaattgctcgctacccgtagtgggccttgagtaggatttaagcacgggtttcgaaccgtgcagtttttatgtgccatgctagaggtaggcgatggtgttactttccggttattccgcaaggaatatcaccttttttggaaggaccttagcttgcatctaggctttgacaaaacatgcaaaattaatttcaggaacgcatttcctgattttaacaagcgtatgttttggcaaagtatttcgggtctctcatcctatagaaagcctagaactaatgacatccataatcctaccttgaggctgttgcataagttgcttggtttcacatcgtttcttagagctgatatccagatagcgcgaactagtcctcttgtatgccatggttagaaaaaaaatcaacgtttcacccattcaacccatgatcaagcaatggttagaaaatgtgaagttgtctggtcctgttgagtgtatttctttggtgactcgtttagcatgaagagttgggactatgcttaatatgcaagtatctagtattcttgttaccggctcttatgttgatgaggcctatctggttcaagggcacgcactcaaacatggtccaaatgattttgtttcccggctatacaaatgaaattccgttacctaacccggagtttcatttgtataactgccgagaactaaccatttctctccaagcggagttgcctcgtgatgtcccacgcaggataacacggcgtatggggagaaaagcaccccaagaggcgtcttcctcttcaccaccagtgcagatgtatggagacagttgggacccgaccgcgcatgcccttggttggacccaattccggcaacatgacggcggaggttcgtcctggcagagtgccagcgacagccggtggcatgagccgtaggagctgcactggggatactcgcgctccttcagttcaagtggtctacctccatcctcttggatgcattgctcagtctcctctcgaagggatttgggagaactcatccgggggacggatacacttgaactgcaggcaaggaacatgcaacataccttggaggatgatgtggtacagtcatgggaatggcagcagtctgttggtgcacagctcgcaaatttcaacactatgatgcaacaatagcaagctgactggcaagcgtttcaccgctaccagggatttgatccccgccatgagccatagcaagaagcaagcttgggggggatgtctctcccccccccccactaaggtaacttctatcacattgcatatttccttttcaacttgcatgtttaaattgttttattgcatttataaatctgaaaacaacataaaaattgcaaaactaaaaataccaaaaagataggttagatttcatatgctaggtaagacatgcttagttcttcatgtcgaaatgatgaatagttactctgttttatatctctcatatatgggttcatggttaagtactctctcaagaattgaataagagtagccaacaattatccgggaacctgaggtaagtgagttgcactttgctgatctgagtctaggttgttgtgagatatgagatagtaaataagagttgctatgaacctattctaagtttgacttgaattccggatgttttattttccaaaatgataaatttgaaagttcctcatttgatataaattcctaccagagccaaaaatatccatattgattaagccatatacattttggttacttgtaattctattgaactttgtcaaatctttgtgacttgtgtagatactattcatgctctatgaacgagatcatacacccacatatgcacacatatgctaagcttctacactagaagatagcatccatatcatccaccatatccatgttatcattatccacaaataagctctccatccatgcttcctttccaaagaaaaatcctttgcaaaaaaaataaaatttaaaaaaaaagagggaaaggtatggctatgagaaaaataataaattcttgctctcccaaaattggagcatgaaagaaaaaaaaagagagaaaaaaaaagagaaaaagtagccataccctctctatgaaaattaaaggatattttggaggaaaagcataagcacaaagaagaagcattttctgtatccacattttattttctatcatgttttccaccatattattcgcacacactttgcacgatcttgatcttgagtatgattagtcatctattttagtccaagtttttgatttagtaataaatgtgaatacaagtgtgccatgttttatccctaccaagctccacatatcaaaccttagagtaggaatcaaaaggcaaatctggtgaggaatccatattcatacactttgagtgatctagagaattatttgaggaacttggctttcttttgcaaaaatcattttaaaacttccggaatgaaagttaaataaagattgggtaactagcgctctaattactgttctgtctctcaaccgctcaagacaaggagatgcagtgtttcgtgggaatcaggggtaagggtaagccaccatgccaaacatatttaatttgagatagagtacccataccttgcatctatatctttgagatatacaacattgcagcaactcctgatcaacaaccaagtctttgttcctttcgtcctttactcgggacgagcaaaggttcaagcttggggggttttgttgacggctgttatcgaccaatttcaaccgtcaatattatccaatatatgaagactagctatgcttgaaatgcataattctcaaataaaatagttacttcaactatatgctttgctactaacatgtatgcaggagaagcactcttaaatgaagagaaggaggtggaaatatatcgatcaatcaatcgaaagtctgccagcgatctacaattacatgagaaggcccaaaagtccaatttaataatcacaaatgggcctagaatgtatgtcactgatttaggggcccacatggaagtctccaagaggaagctgagggccagaagagcccatagggggtccgccgaccctttgttaagcccaatccagtcacattttggccaagagataaggaagaccgagaaggtacagcaggccaaaatccaggcctattgggccactctagggttcggccgaaccactaggttcgcccgaaccttgatctcagccgttggctctcccctttggtgtagacgctccggatgaactccggatggcggttgcagggcatttccgacaattcccatgctctacaaccgtcattgggtgctataaaaggacctcacctccttcactttcaatacacactcaagcaaggatcaaagctctctacaaagttagtagtagtgttagtggagtagagttagaatagttccaagtccgcggaggcttcggggagttcggtaaaggttctataccttttcctttcttctttgtaagacttccatttatcaatataatattcttctttatacaagttcggtactttattccaatcatagagtatgagtaccagtcttagtttattcataagtagtataatctgtgtagttaaaccttctgggatttgcattgatgttggtataatgtctgattacctggtcataagtctactctggctaggccgagagctatggcccgaggactatggtgctctgcaccgattgcaaggttgtagagtaataagtagtaatttaagcatggagcttaggttaccgcttatcattatttgggggtatattctctgggtgatttgcaggccgctgatggtgacagctcagtacgggtgtctcccctgcagtttatattcctacataaaatttcctagggttggatacacctccgtatcctacatcggttggagggttatgacaggttgtcgtaagaaactcggcaacccggggtaactttgctatgcatcgggagggcatagctatgcctaagcatagctatgctgcattgttaaaggggttatattacatagtgtatactagttagaatatactaagatgttgtatacttgaagtacaggaatagaacatatctaacctactgccacttagctataattaggagatgtaggagttagctaaatccttagctgtgtgtcattctacccttaagctaaacttacccctgcatagaccttgatgtatacaagtaatatataaactattagcgtagtactctcttaccatatcttcccttgggattaaacaaatacgataccttggaatactcccgggtgaaatactacaatggtatatccatgcgcttgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccattattgagattgaaagccgatcaaatgtttacttggggggcagagcagtagaaggctttagatagtattaaggaatatcttagctcttctccaattttgattcctccacagaaggggataccttttaggttatatctatcagccggtgagaagtcaatcggctcggttttgattcaggagcttgaaggaaaagaaagggttgtgttctatttaagtcgtcggctcttggatgcagaaacaagatattctcctgtggagaagttgtgcttgtgcttgtatttttcctgtacaaggttaaggcattatctactgtccaatgaatgtactgtaatatgcaaagccgatgtggttaagtacatgttatcggctccgattttaaaagggagggttggaaagtggatattttccttaacggaatttgatcttcggtacgagtcgccgaaggcgattaaggggcaggctatagccgattttattgttgatcatcgtgataattcaatcggctcggttgagattatgccctggactttgtttttcgatggatcggtgtgcactcatggttgtggtatcggcttggttataatttcccctcggggggcaagttttgagtttgcttatactattaaactatgcaactaacaatcaggctgagtatgaagcggttctcaaagggttgcaattactcaaggaagttgaagccgatgctgtggagattatgggtgattctttgctggtgatcagtcaattggcaggagagtatgagtgcaaaaatgatacattgattgtttataatgaaaaatgtcgagaattgatgaaagaattttggctggtgactttgaagcatgtatctcgaaaacagaatgttgaagctaatgatttggcccaaggggcatcgggttacaagccgatgatgaaggatgtcaaaatagaaattgccactataacaaccgatgattggaggtatgatgtgcatcattatctgcaagatccatcccaatcggcttctcagaaattgcgatataaggctttgaagtataccttgttggatgatgagctatattatcagacgattgatggggtgttgctctgaagtttgagtgccgatcaagctaaggtcgcaattggtgaggtacatgaaggaatttgtggcactcatcaatcggctcataagatgaagtggttgcttcggcgagcgggatatttttggccgacaatgctagaggattgtttcaagtattacaaaggatgtcaggattgtcaaaaatttggagcaattcaaagagcgccagcatcggctatgaatcctatcatcaaaccatggccatttagaggttggggaattgatatgatccgtatgattaatcctccatcgagcaagggacacaagtttatattggtggcaaccgattattttaccaagtgggtagatgcgattcctttgaagaaagttgattttggagatgctgtacaatttgttcaagagcgtataatctatcgatttggtattcctcaaaccattacaaccgatcaaggatcaatcttcgtgtccaatgagtttgttcagtttgccgataacatgggtatcaaattgttgaattcttcaccatattatgcacaagctaatgggcaagccgaggcatctaacaagagtttgatcaaattgattaagagaatgatgatctcacatgtgccttgtgcaacacacatcaaagagagactaggcttcatctcttttttacatgtcccttcagtgtggcttgttggcagcagatgggcatttcctggaattgtaatctggagtttttccaaatgcttgtcttggcgagaattagatttgctcgaaagggtttccttgaagtttttttcatggcagcatggcatatttggaagcaaaggaatggattaatctttcaatctgtccagccatcaattcagtcatggaaagctatgtttgttaaagaagttcatctgcatatgtgtagaatgaaagatcctctcaagcaatccatttctgattggatacaaactttgtagcatttttgttttgcttttccctctgtaactttgtacatatctttattttataatatttaaactgctgggcaaagccctggcatactcgattaagagaaagatgattaagagaaagatttctgattatcctcggcagtggcatactcgattggccgaagcattgtggtcctatcggatggcttgtcatggttcgatccaagtctctccttataagtttgttcatggacatgaggctgttttaccatgggaagttagaatcggcataagaagaacggagttgcaaaatgatttgacagccaatgagtattataatctcatggctgatgaaagggaagacttggttcaatcaagattgagagccctttcaaaggttaccaaggataaggaacgtgttgctcggcattataacaagaaagtggtgcctaaatctttttctgaaggtgaacttgtttggaaattgattttgccgatagggactcaagataacaaattcggcaagtggtcgctgaattgggaaggaccgtttcaaatctataaagttgtgtctaagggagcttacatgttgcaaagacttgatggagaagtttatggaggagcactcaatggaaaatattttaagaaatattaccccaagtgtttgggttaatgcatgatcggctggtgttgccgatacatgatagctgatgtatttacatcgccttgagatggccgatattgttgtatcgcgcttagttattttttctattgtaatcggttgtgttttgccgatgtacaatggccaatattgttatatcgcccttagttcaatttataattttatcaatgcctttgacattgtaaaattatggggggcacatatatgcaaagttgaaaaatttttgagcaaaaacgaggagttatattaatcggcacaaaggattattaagacaagttaaataatgtaccagaatgtcttagccgattacaaaatctactatatcctattacagaatgtcactgagacaagtggcgctggatagccgatatagctctctgcctaatttgttctacttcttcaatggcctgggcgtcttgagcatcggttccagagatgacttttaaggacttggtcatgtcagcgacatttttgatggccgatttcaaccttgccttctgttcttcgacagcttgcgggagatcgggtagcttattgtgttccaaatccagttcggcgttgcactcttgaagttgtgccaagagctcaatcttacgagcttcaagccgatcaatattggatttgatcaggccctcggatagttgatcaagcttagccttttcttcatgaacaagctgccgattggcctggattgtagcttcaatatccctacgctcccagcgttcggttaatctcagtttggatttctccagtttgaattgatgttgttcaagataagcagctggagtgaggatgtcggctagttcttccgggatcagagcctgaacttcgtgtagccgagtcctaattgatccacaatctaccaccaagctgtctagagatgatgcctctaacgaatgagagatatcttcaagagtcttcctcacatcattggataagggagctaaagctttgcttgtggtgtcatcttctgtctcatcaaagtaatccttgatatcaaaagagaacagatcggctaagacctgcaaaaataattcaaagagacttagatgccaaatagacatggccgatctaagtccttgtgtcaaagggaaacttactgggatggcagaagcggctggttgtacttcttccttgacatggtgactccctgcagccgatggaatttggtcacttgatgattgctgtacaggggaagaaggaggaggaggaggctgcaaaaagagataagtgctagataagatcggctatgattgactagtgaaagaattgagaatatcttactggtggagccaatttgagagttgttgctgctgatttcttcttcacagcagttttcttcttctgcaattataaaatctataagcaatcggctataaatgaaatggttgcaaaaagaaatcaaggagagttgtttaccctggaaaaatgagctggagcggaaggagccggagtagtttgtttaggtgaagccaatggttttctttcagtatcgcttactctagctgcagcttgatcaacatcttctccaatctcttcttcatccagagcttgttcaatggatggatctagggcaggcaagtcatcggttggcttggtcttcttcgacttagctttcttctttggggctggagccgatgggtctatagtcgatgctctggtttttctctttttgccggcatcggttggttctctaatgagcccttggagaagacttgaagtcttgggggcatgatagccgatgacagggggagatggtccaccttcattgggaatgagacttggagcatattcgatgtatttgccactattgctcttgtgagggggagaggattctgttgtctgcaaaatagaagagaagattagtcaagttatgaatcggctgacaattgttcaaatagaattaatgaagtcaaggtgtacctaggggataacattggaaaagagatctgtcatgtacatagaagccgattgatggaacagatgcatcttccattcaccccaccatctgtcaaatgccccgctcctgaaggttgccagctctatattttcaatgctgcccaaaggaggtccttgaagattgagcaaccgatccatcattagggttgatgaaatttctcctcggcattggattttatcggcaaagaacaggccgattggtaattgacccatatcaaactgtctggcagaactcatcggatgataaaattcataacaaacttggatatttcttccttgatgaatgccgataggaaggatgcatgggctgattgcagccgagaagacttctctggacttttggtatctctcgtggttgatgtcttcaaatctaaagtctgatgggagctctagaagtgctgagtcctcataggggaaccaaattttagcatctttttgaaagccctcataaaagctgcagaaccaatctttgagcagctcagccgataactttgctccaacatcggctggtgtggatgcatattccccataagacatacatctgcgatgggtgcgttcttctccatcgtcttctataattggctctagtcttgggaattcggcttctgtcacagatggccgattgacaaatttcataaccatcagatttagccaagtctgcaatagccaccatggtccacctgttccaactactaagccgacagctattttggccgatgctttatttaacacttggtataggtagccgagaagaattttgcctaagggaaattgtttctttgattctagggcttcggctacaaattgccagttggttgtaggaccacaactggatccacagaaaaggaacttttctagccacatcagcaagaaagccacatgttcccgaggagtgacaggccctttgcccatgtatgccgctacatagccctacatagccagaccaaccacctatgcttttggtcctgaaatcaaattggttcttggtgttcatactcatagggttagctgatgaagttacgtctaatccggtaatcatggtgatgtcaatcaaagttggagtcatcggcccttggttgaacaggaaagcgttgatggtattggactagaaataggtggcggcggccattaaaggttcatctttagctgaattggctatggtaagggcaagcacttggccgattccgatttcgtcccagtgaactttcttgctagccgacatgcgcttgtaccatatagtccagctcttctcgggtgaagttttctcgagagatggccaagatttgaaggtattcttccagtgtcctagatctgggttggctaatctgaaaggaatcgtattggtttcaccgatgnnnnnnnnnnnnnnnnnnnnnnnnnnnnnnnnnnnnnnnnnnnnnnnnnnnnnnnnnnnnnn

SEQ ID NO: 9513 - DNA, 729 bp, Oryza sativa
aaatacgatacctaggaatacctcccggtgaaatactacaatggtatatccatgcgattgcggatcacatctgtaaccataatataccatgagtatttctagtgctattgctaggaattatatttccagtagtgtcgttaagaaataccaacaatatccaatgctagtagcctatcagctgattgatgctgcttcggggcagaagatattgagttttatggatggaaatgcaggatacaatcaaatctctatggccgaagaagatatccataagaccgcttttaggtgtcctggtgcaatcggcttatttgagtgggttgtaatgacttttggcttaaagagtgctggagctacatatcaaagagccatgaattatatataccatgatcttatcggctggttggttgaggtctatattgatgatgtggttgttaagtctaaggaaatagaggaccacatagctgatttaaggaaggtttttgagagaactaggaagtatggtttgaagatgaatccgacaaaatgtgctttcggtgtatcagctggccagtttttgggatttcttgttcatgagagggggattgagataactcagaggagtgttaatgcgatcaagaagattcaacctccagagaataagacggaattgcaggagatgatcggcaagataaattttgttagaagatttatctctaatttgtctgggagattagagccttttacgccatt

SEQ ID NO: 9514 - DNA, 786 bp, Oryza sativa
ttccgaaggcttctggactcctgatttctactctattcctattccaccatctagatattactaaactaagggcccctttgaatcaaaggatttatgtaggaatttcataggattcaaatcctatagaaaattttcctatttggccctttgattcaaatgattgaagctttccaaatcctataaaattcctatagaatggcacattgcatgtggattttggaggaaatttttagcaagagcttcaacctcttggaaaatttcctttgagtctatctctctcatccgattcttgtgttttttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactag

SEQ ID NO: 9515 - DNA, 2966 bp, Oryza sativa
  unsure (1)..(2966): unsure at all n locations
nnnnnnnnnnnnnnnnnnnnnnnnnnnnnnnnnnnnnnnnnnnnnnnnnnnnnnnnnnnnnnnnnnntttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgagaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaactattttgggggttttgaatagagggggaggtgtgtgtccaattccaacataagccaaccattccatagtgtccaaatgatatgagaattcccaaagtctaaagttataaaaccatctaatgttgcctaattaatcagcgaagcatctacctaaattcatactagtggaaccatgaatagagtacccactagttggggttttgtttatcctagggtgaacaaggtaataataacaataacaacaatgataaggtcataacaaagataaataggcatggctaaataaaacagtgataacgcgggaattttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacatggttctttaggttataacaaacattaggagacttgaacggttcgattcggagctcgtatgaccaagacatggtcatccgaagtttaatgctgttatatggagatttgcggattattgtaattaggttttacaactataaaacatgtgtaagcgctagcctggaaaagacaggaagactgcgctgttgacatgcggaccccacatgtcaacctaagggaccatggt

SEQ ID NO: 9516 - DNA, 904 bp, Oryza sativa
ccgaccggaggagtcgtcgatgaggatgaacggagacgatgataacgaacaccggcggggttcggatggaggggaggcgaggccgaaggcgaccttgccgctgcgatgccggaggaggagatggcgacgtcggccgatgcacgggcacggcggaaggggttgccgaaggaactccggcgaggtggagggcgagaccggcgtgggcgacggcgttccggcgaaaccgagggcaggccggggtggaggtcgacgcggcgacgccgagggaggagacggcgcggccggcccgcacctgaacggcgcggcaggggcggctggagggtgggtagcggcaatgccaccggttgccggcggggatgcgcctccggtggtttccccgcgaaacggagggctgaccgggggagagaaggtggctgcgaggccgctggtggcgacggcgcgaccggacggcgctcgggcgaggaaggaaagccggctggaggccggccggcgccggaaagagaaaaagagaaggcggggagaggtggtgcggccacggtgatgaaccctgagttccactcgagacactaaaggctattgttggcccgatctttcggtgagttgagataactacgatttgtgaaaaagacgttgacgatccgactacaaccgtacaagacgttgtgttgcgccttagcgatcgatacacctctccatgggttgttgatcttgccggtgcagatcaaccttattcctgcaagcaaatcgaagaaacaagcaagaacaagataaaagcaatctgaattgcaaataggagttaaatacgaatgataagttgtggttccgaagaacaagcagacggacggtctagccgacacgcgcgctgcaagcaagtagcaatggctaaacttcaatctatcaaaac

SEQ ID NO: 9517 - DNA, 729 bp, Oryza sativa
  unsure (1)..(729): unsure at all n locations
nnnnnnnnnnnnnnnnnnnnnnnnnnnnnnnnnnnnnnnnnnnnnnnnnnnnnnnnnnnnnnnnnnnntgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagcccttttgttcttgattactttattccttgataccttgggttataataatttgactagttgagctttatttatattggttcaactagatattagatataattgcttagccctgcttagaaaccttagcacacttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaagggtaccggttcacgagtttcgggtgtgaaacatttatcgtgccaaccacaagccaacatgggcaacggctttatcttttggatagcatgggtcattgcggggcaccagactgagaagtggccgagataagcccacggggtcgcttgggagtccatg

SEQ ID NO: 9518 - DNA, 3958 bp, Oryza sativa
cactaccgtacttccacatgtctagtgggtaaggcttagtttgtgcctcagtctggttataaacaaaagtacacgaatgaagatggatgaagtcgggggtcgatggacatctctagggcaaatgaaggctacatgagctacggcccggtagtcgagatgtcatggcacagggccggtgtcctgctactaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcatgcctagcaatgtacccaagttagtgttttaattcttaaaacctgcttaacaactaaaatgtggaatagttggcctgggttggcttgggacgagctgggacccagggtcgggttgccagttcggtctgaatcatcgtaggccttgggttaaggcaggttcgtgtgggttcacggccttgtttaataatattgtatagctctagaatcgtgtttacaaaatagcgttgagcaactaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaaacgcctatggtcgtcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccccccacacttagccctttgctcgtccctgagtaaaggttagtgtagaataaatttcttcaagatatgaatcaagcatataaatcattcacaaccatacctgcacctgtgaactttatcagtggctatcttaccatcttgagtaattgataaatggaacgatcttgattctagtccttcttgcttctctgttacactcatgggatttttttataaattttcgcaaataagctcttctcctattgacttcctctcttgtctctcaagaatgtatattttctttttggatccttaccaaagcaaaatgtgccataattcattcctattctaaggttaatatgtggagcttggtagggataaactgtgacatacctgcatcatatatattgcaaagccaaaaatatggactcaagaagatcatcatactcctagatcaagggtctttatttatggtggaaaatgaaaaagtaaaatatgtagtggaatggtggaataaagaaatgattatccctttttcctatactttctctccaaattggttctcttggcatgattgtggaaggggcatggctacatttttctttccaactttgctcaatgttttgagagcaagctttatttccttctcttttttttagccatgcctttccctccttttatcattttctttttgccaagaacttttcaaggagaagaaagtataattcaatgtaggagtttatttgaatggatatttttgtggaaagccaactttcagtgtagaagcttggcttaattttatatgtggaaatgaaagtggaattgaccacttgatcatgagagtatgaaggatatctaacatgagtcacacgaatttgacaaagctcaatataatgtcaagcagtcatatgcatgataaggttcatcaatgatatacttgcatatggtcttggtaggcataagatgaagtcaattagaggattgagcttttaaaacaattttattttgaaaacaaattcccaagagtcataacaagagttgcaagaattcctttcatctcgaatcatctctcatatagcaattacttagatgcataaggttccctaaacatggatggttgttcacaaacacaagttcagctgggaataatgaatatacaagatcaatcacatgaagaatttcatgagttggaagttttatctttcatttatgcttgaaccaattgttttctgaattttcagctctagtactataccatggtggagatatacagataaaagacgtgctcacctgcttacctgtaaaaattgggagaggttggggccagtcttggttcggccgaaccactctggtgcccaatccctttgcaattttctgcagagttgagtgctttcaggtgttcagagatttcatcaattttcagagcatatgcacgtcagaagctgggatatctccccacacttattcaaaacctgaatctttattaaacataaaacaaaaacaaaccttggcaaacattggggttaacaccaatgtgccacattattcatagcaagtgcttacatgattggaaaataaaaaccaagcacctactaccattttattcatgggaaaggactaattagcataatacttattttcctttcccagctctacgaatgcacgcttgatttaagcgcacaaaccgagactaagggtgtcgaaattgtttctaatttcagcaagctctacccctagctccgcgttgcaatccctaagctctatgttctccttgcggagtttcttcacatgtgcggcgagcttatggatcgagggctccagcgacttcacctcatcttcttgatattggctgggagccctcacaattggagggggcatcaaatgacgcttcaccttcataggtggagggctacgggattccgctgccccctcctccgacgccgtcaatggccggagtaaacccttaccatacccaccgccgggagttcgcactccctgaatacggaatcgctcctccttcggagtggatggagtagtggtgggtgtggtatacttgtggagcacctcatcccctgctttggtgaacaaggtgcccacataacgctcggcgggacgtggcgcggccttcccgtcatcttcggaaaggcgtcgtgcctttaacaagccgaactctcccgtcgtcggccatcgcgcaggcgaatccccccgaatttttgtccttgtgacatggcgaggggagagggatcgctctgctgaacgaggggccgaacccctggttcggccgaaccagggagctcgctaatcggctccaaaattgctggggagcctggcacagctaaaggggttgagcccatacagcattcgccccttccatcgtgtattcttccaccggaatcaattgatttgccagtgtcggctctccggtgaggttgtatgtggaattggatgaagagccgatgaatggaatcaaggatttgctagccattagaggttcaaagaatttggatcgaaggtcttgggggtgaatggcagattgaatagagaagcttttgcaagggaggaagaaagagaggaactagcttcaggggtgtgatccgatcgttctacctccaaactggcatcaaaatagactcaggactagcgggggagactatcattcaaaaatggggccgaacgggtgctgccctggttcggccgccctggtgggcccggctggccgccacctttcttcctattgccactaatttctaagctaagcacaaaaataacaactatacatggttttaagcatgcattagatgagatcaccatggttcataaacaattaattcaataacatccacttcttcctctaaagtttcatttggctcaaggaaaatctttaagtgttgactgtttaccttaaatatgttac

SEQ ID NO: 9519 - DNA, 2703 bp, Oryza sativa
  unsure (1)..(2703): unsure at all n locations
nnnnnnnnnnnnnnnnnnnnnnnnnnnnnnnnnnnnnnnnnnnnnnnnnnnnnnnaaataacaactatacatggttttaagcatgcattagatgagatcaccatggttcataaacaattaattcaataacatccacttcttcctctaaagtttcatttggctcaaggaaaatctttaagtgttgactgtttaccttaaatatgttacctgaatcgtcacggagtgtgattgccccttgcaaagaggtgtcgatgacattgaacggtccttcccatttgctgcgcaattttccgtggccaaaaagctttaccctggagttgaacattagcactttgtctcctggctagaatttcttgatttcaattcttttgtcatgccagcacttcgtccgttctttatatatcttcgcattgtggtaagccttctctctccattcctcaagttcagggatatacatttttctccattctcctgctccctcaaaatccatgttccaattcctgatggcccagtatgctctatgctcaagttctacgggtagtcaacatgacttcccgtagactatctgatatggggacattccaatgggtgtcttgtatgctgtccggtaagcccacagtgcgtccggcaatctatccttccatcctgttcccattttgttgactgtcttttgcagaatattcttgatttgtttgttcgatgtttctgcttgaccactggtctgtggatggtaaggagtggccacgttgtgtttggctcccatttctcgtagaaggtctctgaaggttttgtcaatgaagtgagaacctccgtcacttatgaccattccggggtaccaaatcttgggaagataatttctgtgaacatcttcttggcatgcttcgcatccgtggcggtgcacggtatagcctcaacccacttggagacatagtcgactgccaccagaatgtactcgcagttgcgagacttagggaaaggtcccatgaagtctatacctcacacatcaaatatctcgatttgcaaattgtatgtgaggggcattgcatcgcgagcagtgattcctccttgcctctggtagcttgtgcatcttctgacgaattcttttgagtcttcgtacattgttggtcagaagaaaccactttgccaaatcttggcctgggtgcggaatgcaccgtattggccaccgtagggtgaggcgtggcatcgttctatgatcttaagtccttcatcagttggcacacatcttcgtagtaagccatcagagcagacccgatataggtatggctcatctcatatatgacggcgactttcatatttcagttttcgtttattttcccctggtggtatgtacttggataccatgtagtttactatgttagcataccacgggttagagtcacgaaccgtcatcagcatgtcgtctctcatgaaatcatttatcggttgttcctgcatgttagtgatctgcagtctagacaaatgatctgctacagaattttctactccctttttatctttagtttctaagtcaaattcttggagcagcaaaatccatcttaagaggcgtggtttagcatctttcttagtgagcaggtatttcaaagcggcatgatcagtataaattatcaccttggctcccactaagtaagatctaaacttaccgatagcaaaaacaaccgcgagcagctctttttcagtagttgcataattcaactgagctccggttagagttttgctagcctaacagattgcatgatgctttttatccttggtttggcccaagactgcaccaacggcgaaatcacttgcatcacacataatctcgaagggcagagtccaatcaggaggttgaatgattggagcaaaaacgagtacctttttgagaatttcgaaagattttaggcacgcatcatcgaactcaaagggcgcatccttggctagtaaattgctcagcagcctagcgattgtagagaagtctttgatgaaccttctataaaagccggcatgtcccaagaagctgcagattcctttgatgttcacaggaggaggaaactgatctataacatctattttagcacgatcaacttcaattcctcgttcggacactcgatgcccaagaactatcccttcacggactatgaagtggcacttttcccaattaagcaccaggtccttttcttggcatcgttgtaagactttgtctaaattttgcagacaatgaccgaaagtctttccatagaccgagaagtcatccatgaagacttccatgatgtcttcgatcatgtccaagaaaatatacatcatacatctttggaaagatgcaggagcgttacatagtccgaaggacatcctacggtatgcataggtgccatacgaacatgtgaacatagtcttgctttggtcctccggatggataggaatttgatgatacccggaatacccatcaatgaaatagaagaaggaatgatttgccagccgttccaacatttcatcaatgaagggtagcgggaaatgatccttttttgtagccttgttaagtttcctgtaatcgatacacatcctccatccggttacggttcgttacggaattagtttattttgagcatttgcaacgaccgtcattcctctcttctttagtaccacctggactgggctaacccactcactgnnnnnnnnnnnnnnnnnnnnnnnnnnnnnnnnnnn

SEQ ID NO: 9520 - DNA, 12892 bp, Oryza sativa
ccttttttgtagccttgttaagtttcctgtaatcgatacacatcctccatccggttacggttcgttacggaattagtttattttgagcatttgcaacgaccgtcattcctctcttctttagtaccacctggactgggctaacccactcactgtatggtacgggataaataatcccggcatgcaggagtttcaagacttctttctttacaacttctcgcattgcattattgagccatcgttgaggttccccctaagatcttgaagcgagtagccaagaatagaacgatacttttccaatacggcgagaagacgttgagtctcgtcttcagagagcttgtcactgattatgacaggggcctctctgccattatgtaggaaagcatatcgtaggcttggaggtagaggtttaagctcaagcggaggtcgaggtggcggttccatgattggcaggtcgagagtctcaccgggatctgcttcttctttgataaaattggggaactcatcttccaaaagggcttcgggagactcatgaaggggaactgcggtaacctcttccgctgactcaatttctgggagagggtcggtcaaggtgatccttgcccgtgagaatggaattgagaatacattttctcccagtgttattttgaggctacctaatcggggtgtgttgattaggagttgctcaatgggcaatatgattaggatgtcaaagccttggatttcaaagatgtggaaatccaagattgcctccctgtcttcaaagcagacaggtacatcttgtacaatcccaaatcctccaatgatatttccgttcggatgtttgaaaaatttgtttgttggggtcactgccttatcgcttaaataagcgaatgcaaaagactcagagacgaggttggccccgacaattggactgtagagaataccgacgtcgttcccttccatatagcaaggaatgattcggggagcggtatttatccgaattacttcggatgaaagctctgcctcccttagccattcatcgctcattatggatgttaacacccagacagtttctcgtaggaacccgagttccataggatcgggaggtggcaaaggaacgagtggtttcctcttgctaaaatagttcagggtattgccgtagtcttcgtcgaagccgtccatgaacagaattgcggcacaatccggagtctgaatctcttcatcctcgacggacggttgctcaagaactttctcatcaatcgagctagctgaagtggatggttcagtgcgtggctcgatcattagaggttcctctatcttggacacgaatgcctcctgctggggttcattggattgtgtcatgaaggaagtattttctagaatacgattcaaaattgttcttccttctgacgacgttttgtgcatgaacgatcctccagcggttatgtccagatagaatgcagactccttatccaaacccgtatggaaatgttggagaagcacatactcgggtaagggcagggttggtccggattgcactaaattagtgaatctggaccaagctgcaccgattgattcgttttcgatctgcttgaaactgagaatttctactcgaagggcagtaatacgagtaactggaaagaaggcaagacagaatccgtctcgcaacttttccaggttagcaggggtagaggtagaataaaaaagtaaaaaggatatgaggatgaactgggttcggaaatgatcagcaaccgtcccccggcaacagcgccagaaatgcttgttggtatttaatacgattacagacaaaatccgcaagcgcacggatataccgatgtagcacttcccctatgtagtattccaagggtatcgaatccaagggaacgtgtgtggtcagatcttcctccggttcatccaaggacaccaagcaaaggataggccaggatagagaggatttactagtgagaaacagtgtctagggaaagcttaactttaatcctaacgcaattcttcaggcattggcaacccgctgttcctagatgtcgctctactatgtacctggacaggaaggacttcagtgatctcgagggctatcaccacctctacacctacctcaacatactgtatgatacgcagcaattactggataataattacctaaacaccacgtctaagcaattaatatctactttagtgtttataactcaccaaagcaatcactatattttagttgattataatgaacaataatcccgtatgctatttaggaactaacaaagagataattctcacaagataaatctaaattacttaagaagaatattatattgaattcagagtaataaatataataaaagaaataggagaatattaccgacaactccggaattcttccaacttcttctactctactctcttcctcttctagtatacaatatagtacaatagagcctcttataattcagctcaagcttggaagtgtgtgttgaagtgagtgagatgatgtctttatataggggtaggtatgacggttggcgaaggggaaatgtttgaagtgccccgcaaccgccatcagggagtgatctgggacgtccatgccaaaacctgggatcaacggcgatcataagggtttggccgaaccagggggttcggccgaacctgggctgggccctcctagtctggccttcggttggtggacttcctaggccttcctctatccatttctcggagttttgggttgatttactgatgtttcaatgaagttcacaacccctccttgtatggatacataattctcctcactttagtctgattttcctcccaacttcagggtttatcatctgcatacaaatatacacgaacacttgtggaatatgtgagattaagcacctattactatgttggatgttttattgtctcgactttatgcagatgttggcggtatgagaatggcatttaacaaccgccaacaacaacttgaatattctgtgggttcggcccgtactttatcctgaccatggagcattgttctgtccttggttgaaactcaaacttctcttccttcccgttgatgtggaaacggatacttgttgacggtccttaaatcataatatctgaccgtcaatacctacatataatgaaataaaacatggtatccaacttagtggtaggtattattactaatcatttccactagttttggtgaaatatgtgtatgcaggtattttgaggagaaaacacatccgtcatgcgacaaaatgcacctctgcgcattcaggacacgtttacacgaattggaggccccataagtcaataaaaaccatttaaaattgggccaaaacatggtgcaggttattgggggcccattaagcaacttaccggccaaaggagaggccgggatgacacatttttgggttcggcagaacccaccaattcggccgaacccgttctgcggccgttcgccatctgcttccacgtggacggcttggattccttcccagaggcggttgcagggtgttttggacaattcccatgcccctaaccgtcatttggagcctatgtaaggaggtcttcatctcattccaacacacacaactttgagctgaattacaagaggctctattgtatcttttatacattagaataaggtagagagtgagaggaagctctggaggagtgcccagaagtttggcgctcatccgacttctgcctcgacgagtgtagcttcctaggaggaattcgggaggagtaccggagctatcggtatactctgctccgggttcggagaacttcttctataaagtaagcattcatgttcctttcttatgttatttaattatttagtctgagtaagatatatttccatctttgcaggttcattgtttagcatttatactaagtgctctagtactaggactccggatagagaaggaagttcctacgcgagtagtagtaattaatctttatgaagattatggaaacaccctgaattattccagcaatacaaaggctcatcccaagcatgagccgttcgaggaggtgatgtttgtatcttcgttcgtttcttctgaacctattgaccatcttcatgaaacggaacgaccctcatcaccctcgatcaagcctaagccttgtccctctggtcctcaaagcgttgttattgtttatcatcaagaaacaaccaggttcttgcacgatgtatctcttgagaaggaggccacggacaagcttgagacatcgactctggaggatgagagaaaacattccacatatgagcatgaaagtttctatttcaaaatcccccaggattcatgctcacataaggaatccctagagtcctgttcgattagtgtcgcgtctctgtgcgaggaccacaaccaccttccggtccacatttctagcatgtttagaaggatggttgtagatgcttacatttatcataaatactgcaaatctcctatttgtttgtggcactaatcttgcatagcgatgtcccgttggtcaagcttgtgaccataaacaaagcactgccgggagataccctggattatcatggtaagttttctttctaataaaagcaagaaccagtttttaggatagtatgcaccatcaggtattcttggtcactaaccattttaggttgagattaagaacgagggtcatacgatgcctaagaacactgtagctacatcaattgtacactttggtgaccctgggtattggaacacactcgataggagaatccgacatcacacacttggtttttgatgtcttgcgacacaaaagtccaagtgtgggggaaaggtcgacgagcttttcatgacgagttccatcaaccaaggccatcttggtttgaagttggtgttagtcctagcttgctagaaaaaaaagaaaaaaaaaagaagataaaaaaaaagaggagaaaagaaagacaaaagaaaagaaaaaaaatgggagaagaagaaaagagcaagagagctgacgagctacatttggatcaaagaccgcattatgtgcgtgtctttgaaatatggctatacacctcgctagtagcaatcatgctgcctggctacacctagtccctctctcgagctcatgtgccaccttggtttagactttatccactcctagctgtgcgtaacttcttgctcccgcaacacctacacgcatacaagcaagaggagatgccctcttcttttctaggtgtttcctgctccactccagttggcacttgcacatttgcccagaaagaaatgtatcctacgtctctacagcattgtgccaatggatcacgccttcaaggcacaaggttcttgcacctgatgtgtgtgcatgaccaacttgcttgcctgagttggcatggttaaagcgtcttcctccggtacaatctgcatggaggtggaggagaaatcgacaatcatttgtgaccatgccactgccccagagatttcaaaatatacatcatgctggcggtaagtacactcaggtatgcgaaaaataaaacagggttcaccattccttttactcatacttatcttcatttgaatgagacttgatcttacatggttatgtttcttgtgtctatttgcatatgctctattttgggtgttcgcgcaagacatctataggctttttaaattaagcatggcgcttaggttaaaatagtctgctttaatcaaattggacatggagtttagtttgactaatgaatctcagagttaatatgttcatagacattggatatatatcttttgtggattaaccccctacaggaaagtgttcaaattcatgggtgagtcctcaagttcaattcataatggaggtaggtcagggccgggaacaaatcaattggtaacatgcaaaggagaaacatatcacctatcaaggtgcacggtgcgtatattaccgatcactcctttagcatgttcatgcaaatttacctcagccctgtatgaattgtgcttaaacaaaaatttggtgaataataaaaatttgaaaaaaaaatgtttcagaataaaaggactgtctctcgaaaaataaaataaaatgttggcaaacttgtgggatccacgcttcttaagttttgaatccaattcctttttagcgtggatgtgaacaattaatcttgaggctacaataaaatcattcaaatctttgtagtgcttcgagtatttgttgtccactaaccttttgcaggaaataaaaagacaaatcaatgagcaatgtacaataacttcaaacacttatatcatgctccttggtccatgggaaagagatgcacaaggaaccaagcagaacaaatgcaaaactttgttacatttgatccagttctaagcctggtaagatctatctggtaagaatatcatacaccatgtgcatcctcatctcatgtctccatccttccaggatatccaccatttccattgttgcctaaaataaaaagggaaaaagattaaataaaataaaataaaataaagttggctccttggtcttccaaccaagtgagtccttttcgcttcacttttgtctttgtttttctttttgtgttcaataaagcctcccagatacaaagacaagtgtgggggtgatcttgcacatcaacgccataaccaaagcaagatcacccagtagtgatgagccatgacgaaccacacaaggaaaactgatgcagtcagaaccaatgaggagtcagccaaacctccagttcggctgaaccacctctaccatgaatcgtcctctgttttatacaaagcgcaggtttgcacaatttttcctttggacatccattctatcttgagtttaatttgattatcaattctaaaatattaaagataattgaacccaagctagggatggtacaattagagtctatggtctccctgaaaatgacatccatgcctattattctttgctcattacttgttgcttgtggtgatatatccaatagggaccccatgctatctaggtaattgatgaatgagatatgttctgatgatagaaatcctgctcttcatgttgcacacttgggaattttataaaaagaaaaaaaacatttaatgatgctaaactcctcattgatatttttattcccactagagccatggtttgatcattcatgattagctcgctacatacgctgcttgtcatttcaatgaacgttgtcaagttttgtgacactagtgaaacgcttttcatactttcatggtcaagaacacacattccacattgatggaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccttattcctgcaagcaaatcgaagaaacaagcaagaacaagataaaagcaatttgatattgcaaataggaatttaatacaaatgataagttggggttccgaagaacaagcagacggacggtctagccgacacgcgcgctgcaagcaagtagcaatggctaaactttaatctatcaaaacccgagaaaccctgaaggggtaactagctatatataggggtgagaggacgacttaggggtgcctagggtcgtgctccaccagcttggggcgcaccccacatgggccccacctgggccggggtcccaaatgaagttataagcccataggcccattacagacaatgcagcccattggttcttcaattgcggctcactgagatggaatatcacaatgaggctagatccgttggaaagaggactccgagagctttccatcaagtactcacgggccaaaaacggagctcgaatggagatttgacggccgtttgaagtcagcaatgtagcaggtggccgaatcggattccagcacttggaggacttgatcttgatatcttcttgttcatccatgatgtgagcaatggttgcatccgtggtagccatggtcacatcatcgtccccttctgcatggaaaaccgtcctcggtttttccatatggtgctctttgcgtagtccatttacaacaatctgtttcttccaatcaaaacaaggcaaactcgagacaatttggttagcaataacatttttctctagcttgcatgttttatccacatgtacaggaagttttaaatctgagcagatgtaaactctatgcacaaaatatattccaagatcattatattcgccaaagatgtgaaatataacattacgagaacatggcaaatcagaatgagcaaatattttgtccttcaaacaattgagctcacaagaatcatcaaacataatatagcccaatgtatttaaagaagattgcaattgaagttcatcattctcgctggacatgtgaataacatacttaaattcagtacatggagaatcaagattaaaagtagcatgttcattcactagttgtggaatggatataaatgaagtactatcgcacaactcttctttatcacaaggaacataatgcaaatcaacttgtgacaaaggcaattcagaagtaggttccactaaagtttgctctaggtcagcatggaaagtggaaaaatgtaattcatcagaagcatactcaccttgagtaatttctgcaacatttaatttaccttttatgccctcttcagataaggtaggtgcatcagccttctcctcattcatgagtgatggaagtgacatctcaaacatatcgttcttctcattttggggactgttctgaacttcctgcaaaacatcaatgataggaggcacaagcatagcttgttgctccgttgggttctccaaaattttgcgctcaacattgcaagcaagcatgaacaattggcctatatgattatatgtcacattaacaagcccagcttgaatattggaattaagccctctgaaaaatctagtcattgtgttctcattagattcttgtaaatcactataagtgatacaaattttaaaatcatgaaagtactccctaacatgtgtagtcctgttcagaccatcctttttctctctactcttcatagtcttttgtaccttttgctgtttttgtttattcacctacagatggacaagttttgttacatcctatgattttgctagataaaaactatattgttttttgtagaatcaaatatataggttagaaaatctttaattttggcatcacttttagtttctaacttcgaacacagattcactaagagcaattgaatagtcaataaaatacaaagttggagcaacaaagcggcagaaaacatgagaaaaatggacataccttgctttactaaaatgtacaatattctttactaaaagtcagtcaggattaaatgatatatcaatggtctaaaatcagatttcagcattacatgaaagcatgacatccatactaaaactattactagcactagattttcagtggtgacaaatgttagcatcatctttcttagcatgtgtacattacacatatctcacacattgatatagacataacacattgattatccaggaaatttattagtgggtaagaattacctcctgtcgaaaatcctgagcatagagagtgatgatgagtcgtagtggcttggtatttccttatggttatgatccacctagtgcaatttccatgatacattcatataaaccatgttaaaaaatgagttgtcttgctgaaatgaaaaataacaaagtctcacctcatagcctaaatgctccatatcagtgttctcatgcatgttcagttgttccctgtgcctttttttgttctatggttgaatatatttatttttatttttttcatatattgtgttactgtaggtgttggtaacacatagataacattactgtatgtaacacaactgtaacacactgaatatatgttacaatgtacttgtaacacaaagcaaagtgttcctacagagtgttcttgtaacacatgtctttttgtgttacaaaattgtgttacaaaatgtaggttctgacgtagtgacattttgtcaccttgttttagatgttcaaatttctcaaggagagcacgtctatagtatgaaaacacaaatctttttctcatcagtattttgcattcatcccaagtttcaagcttatttcccacagtatgccaccaaaaagatgcagaaccggtacacttattactagcagccttaatcatttgagcattagaaaaatcatactcatcaaattgtttttctactgctagctcccaattaacataagcggcggaatcatacttaccatcaaaaccaggcaatttagattctacccttgcaagatcattatcatgtacctcatatgtgatgcgtgaagaagtcgctatatctcgttgatggtgaagatgttgacgttgagcatgaccatctcgtttccccgtgcgcaatcctgccatggttagtagcaaacaagaaacatacacaaaaatatgtgcgttcctattaactactaggtagtggcagctcaaaaatcacacacactcaagcttttaaccaagctcttacaagatcttaccaatgcaagcagaatggtgatgtacactgacttaaccaagcacccaaatggaggttggatgtatcgatgtcttggcaaacacttgctgtatggctgcaatcagacctgtggagctctgggtaggcttaaatatgtagcaaagggatagcaaatgctcaaatcagagaatagaaagttgaataatggttcaaagtcaagtaccgtgctggtcctaggctagaacgtactagagacgcgagcctagacacaaatgataccacaagatagcactaggaacaactcatgcacaactctgatatatgaagttcagctcaaacataacagtattttctcttttctttctttttcttctttctttttttttctttcctttccttttcttttctttttttttggtgcggcttttcttttctctttttttttttgcacctttctgcctttttttttattttattttacaaaaatagattcaaggacctcaatgtaagattacagggactcaaacgtaaatacaaaaattacagggactcaaatgtaaaagttcaaacccaaaattagaactatacaaaaatggaatcctctcgtcctgtaggttctgtttttgcaaatggattttcaatccgatactcgaaaaattttcaccaagcagtatgcaagatcacggtatagattgaaaccgtgaccgagaggagacactcggactcggcctggtcgcggacccggggtggtggtgggtgaggaaaggaaggatgcggcactacctaggagtccggatatggtgagagaaaaaaggaaactgatttcaatcaatctgatctactatttctttccagattaaactcacatacttccaaaaacagatttggaaattcttcttcctcctctctacaccggcaacaagcaaaggccgatctattcacgggcaaaccagaaactcaagcaaatcctaaatgcaactccaaaactgaccgataaaaatttctgaaaactacaaaaatagaaccgtggcagcaagccgattccgtttttgtaggtcccgacgacaacagagacacggaggcgacgacgactgtggtacaaaacgtgaccagaactcgaaactcaaaacgaactagacgctaacaccagcaactcgactcgacgatgtaacacaaaactcaacaaagcaaaaactgataaaaacaatgcaatggcacaatatggctaggtacaggacaatttttttatggcaattttctggttatgggtagataaaactcaccgagcaacgaaagctctgatactacctaatggaccctgagttcctctcgacactcaaggctgttgttggcccgatcttccggtgagttgtgataactatgatttgagagaaacgttgacgatccgactacaaccgtatgagacgttgtgttgcgccttagcgatcgatacacctctccgtgggttgttgatcttgccggtgcagatcaaccttattcctgcaagcaaatcgaagaaccaagcaagaccaagataaaagcaatctgatattgcaaataggaatttaatacaaatgataagttagggttccaaagaacaagcagcggacggtctagccgacacgcgcgctgcaagcaagtagcaatggctaaactttaatctatcaaaacccgagaaaccctgaaggggtaactagctatatataggggtgagaggacgacctaggggtgcctagggtcgtgctccaccagcttggggcgcaccccacatgggccccacctgggccggggtcccaaatgaagttataagcccataggcccattacagacaatgcagcccattggttcttcaattgcggctcactgagatggaatatcacaatgaggctagatccgttggaaagaggactccgagagctttccatcaagtactcacgggccaaaaacggagctcgaatggagatttgacggccgtttgaagtcagcaatgtagcaggtggccgaatcggattccagcacttggaggacttgatcttgatatcttcttgttcatccatgatgtgagcaatggttgcatccgtggtagccatggtcacatcatcgtccccttctgcatggaaaaccgtctcggtttttccatatggtgctctttgcgtagtccatttacaacaatctgtttcttccaatcaaaacaaggcaaactcgagacaatttgaatagcaataacatttttctctagcttgcatgttttatccacatgtacaggaagttttaaatctgagcagatgtaaactctatgcacaaatatattccaagatcattatattcggccaagatgtgaaatataacattaccagaacatg

SEQ ID NO: 9521 - DNA, 9913 bp, Oryza sativa
atacataggggtgggaggacgacctaggggtgcctagggtcgtgctccaccagcttggtgcgcaccccacatgggccccacctgggccggggtcccaaatgaagttacaagcccacaggcccactacagacaatgcagcccattgtttcttcaattgcggctcactgagatggaatatcacaatgaggctagatccgttggaaagaggactccgagagctttccatcaaatactcacgggccgaaacggagctcgaatggagatttgacggccgtttgaagtcaacagtgtagcaggttgccgaatcggagtccagcacttggaggacttgatcttgatatcttcttgttcatctatgatgtgagcaatggttgcatccgtggtagccatggtcacatcacacatacacgcacatatgcttgacttctacactagaagttagcatctcccatttgtcattcatttcatccatcaaataaatactccatgtcatttatgcctcttcctccaaagttctttcaaaaaaaaagggagagaagcatggctatgcaaaaacaaaagaaaaaaaatgctaatacaagtatggagcatgatgatgaaaaaaaaagaaaagaaaaaaaaagatagccatgcactctctcaaatttcaaaaaaaaataaatgaaggaggaggtatacaaaaggagttatttttatttttccgttttccacccacgaaattaaccatacacatacacatgcacattcttgaccagaaagtatgtcttgtatttccgtggatccattatttgactttgcaatatatatgatgcaagcaatgctctactcttttccataccctaaactccacataagccttattagatggtaggaaaagaaaaggcacaatcatatgcctttgttaggaatcatacactttgagtgatcgagagaatcaatggagggagtaaagcaaagttataattttgtgttacatgaaaaaccccaagttgttcttcatgaaaagttagggtgacttgagtcgagattgttccattcctcaattgtccaagattgtatggtagacactacaaagatccacaagtacaggtatggctttgaataatttgtttgcatgattattagtaaggaagtcataactctgttgtagagttcatagccttcactcgggacgagaaaaggttaagtgtgggggtgttgttgacggtccttaaatcataatatctgaccgtcaatacctgcatataatgaaataaaacatggtatccaacttagtggtaggtattattactaatcatttccactagtgttggtgaaatatgtgtatgcaggtattttgaggagaaaacacatccgtcatgcgacaaaatgcacctctgcacattcaggacacgtttacacgaattggaggccccataagtcaataaaaaccatttagaattgggccaaaacatggtgcaggttattgggggcccattaagcaacttaccggccaaaggagaggccgggatgacacatttttgggttcggcagaacccaccaattcggccgaacccgttctgcggccgttcgccatctgcttccacgtggatggcttggattccttcccagaggcggttgcagggtgttttggacaattcccatgcccctaaccatcatttggagcctatataaggaggtcttcatctcattccaacacacacaactttgagctgaattacaagaggctctagtgtatcttttatacattagaataaggtagagagtgagatgaagctctggaggagtgcccggaagtatggtgctcatccgacttctacctcgacgagtgtagtttcctaggtggaattcgggaggagtaccggagctatcggtacactctactccgggttcggagaacttcttctataaagtaagcatttgtattccttttttatgttatttaattatttaatctgagtaagatatatttccatctttgcaggttcattgtttagtatttatactaagtgctctagtactaggactccagatagagaaggaagttcctgcgcgagtattagagtagtaattaataacttagacgtggtgtctaggttagacgttacctttgtttgttgtgtatcccacggatttatcagaggtaggcggcaggtggtgacagccctgaattccgtcctagtaatcctccacgttcggatacatcatagagctatagccggaaccaggctggcagaccagcaggggtcggtgcccgaagcaatagataggaaattacctttcttagcgtagataattaaaacacataggaagtcctctctagcctgcctacctatagttgttgtccttggatagccttagccttaggtagattacacacgtttcctgagttcgatatccttttggggtcacctgaaggtgaagtgctacagctgtattccatgcgcttgcggatttatctgtggtcgtaagaaataccaacaatactccccgctcccacgtcaatgttggctcctgcggtgctaaggaacaggcgccctaggatgagcggggtctcttttcccgtgtccatgtccagcaccacaaagtcaaccgggatgaaaaaatctcgtatcttgactggcacatcctccgttatccctgccgggtaacggactcacgaatcagccagttgaaggtgcatcggtgttggtgccaacatcgtgaagttgagcttgtcgaagacgttttttggcatgacgctgacactggctccaaggtcgcacaaggcctggtcgaactgttgtgccccgatcgagcaggtgatcgtcggacaccccggatctttcttcttctccgggagcttgtggagtatcacgttgctccattgctccgtcagcttgaccacctccgttgttgggagcggtctcttgttgttgagtatgcctttgagataacgggcgtatgttggcatttgcatagcgtccaacaacggcacgttaatgtggatcttctggattacttcaacaaaacgagcgaattgctcgtccactaatggtttcctcatccgttgaggaaacaacagcaaccatgtgtcacagtactcctgcggcacggtcttttctggctgatcttccttgtcagccgagtcactagatgacgctttttttgcaatctcgttagttcctgcagggttaggatacggcggatcacgagtggacttacctcccctcatcgtgatcgccttaacattttcaatggaggagtcgggttgccccggaatcctcccagtttcatttacagggactaaggatgctaactgagctagctgggtttttatcatttagttaaagctcagctgattttgaaaagcagaagcaaagccatctaacttgacattattgttttctaggatcttgtcattggttgcaagctttttgcttagcgcatcagtggttttagcctgcgaaaaaactagatccttcaaggagggctggttagaaaagttaccgttgttgttacctccttgataatatgggcgtagttggctccacccctgacctccttgtggacggtaccaattgttgttgcccatgtacatcgcctcctcacgggtttccgggcagtcattcccagagtgacccgtgctgctgcagacctcacacgtaacgtgtgagtccaaggccttgacggtgccttgtggccttttctcgtggttgtccaatcgtttcatgaggaggtccagcttggcagcaagtaattccgtctctttgacggtgtgcatgcctcgctgacaggtctggagttgttcctcgctccaacccatattggagaccatcttctctactaaatcaacggctccttgaaccattttagagaagaaagctcctccagctgccgcgtccaggtgatcgcgggacatcggggtgagtccattataaaagttctacaggatcagccagttgtccatcccatgatgaggacaggcggccacatactcctacatacattcccatgcttccggaatagactcattccttgtctgctggaaacttgaaatccttccacgaagggcattggttttgcccatcgggaagaatttcgagaggaatgccatagagcatttgtcccaggtattgacagcaacacggttggcatagaaccactgcttcgctctcccaagaagggagaacggaaacagccgcagcctggcggtgtcgggactgacgcccttgatggtgtacgtgctacagatctccaagaattgtaacagatgagcattggcatcctcattaggcttgccacagaatgggctaagcctgcgccatcgtgatgaggctggacttcaagtcgaaatccacacctaccatgttgatctgcagcccaatggccacattgtcagcagagggagcagcgaactcgcggagagtcttgttagccatagtcttgaaggtcggtggcgctggtatggctggtttctttgtcggtagagttttctgcggaccaacgactcgcggcctgacgctccagaagaaagcttctggattttctttgaagttttccggcaagttgaaaccagtcatgcactaccctgttttcacaacaaaaagtgaaaacaaccaaggttagcctgcaaaggaaaatgattatacagagataaatataaagtattagttcaagtaatctctattatgaatcttccctggcaacggcgccagaaatgtttgttggtatttcttaacgacattactagaaatataattcccagcaatgacgcataaatacttctggtatattatggttacagagttcatccgcaagtgcacggatataccattgtagcatttcacccgagagtattccaagggtatcgtatttattttatcccgtgggaagatcatgtagagagaacttgactaataatttatatattacttgtgataatcatattctaagcaggggttaaaaataatccaagggtagagtgacacacaagcattaactactcattctcataatatattatctaagctaattgggaagaacagagaaagataatctattcctatacttctaacatacatagtgtttacacccaaatttggcacctaggattaaaatagaaaagatccccgccaaaatttggaagtctaccggtttcctccgagtgggccggtctgaccgctgtgtgttgggcggtcagaccgccggttgagggccggtcagaccggcggtgtgtggccggtctaactggcaggaccgagtccgattctgtttcgtcgggtctcgaggtttccttgctcgggaaggcatgtttcgggtttcctttggcttctatcccgagttggacgtggaggagggcctgtagagggcaagaccaacccctatataagggacatggccggttcattgtaaaagaccaatctactatcaatcaatcgaatcgtttttcatattgcttttagttttctcttagtttgtccatctttgtcggtttgcgccgtaaaccgcccgccgccgctgcgagagtgcaacacctctttgtaggtttgtcctgaaaaccttccgttttgcccacgagacgggtagttatctagaaatcggctccgctagccggtttagttatcaaaacccatctaagtggttggcgactctaggatcaccgcaaggcataaggtgctgcgatcgtgcttgccaacttgtcacaaaaagttgccaacacgatttttggctactccgctggggaggagatccgttcatcgtcaactcaacttcgacttcgccatgacgaagccgccatccaagacggaggtggagccatctaatgtgatgccggtcacatcggatgacttcgaaggagaagatcgtaaagctatggaggagtacatcaacgagctcacacgggaggcgttgatgagagcaactactaggactcgtcaaggcgtgatcatcaagcccgggccacgtcccaagctcgctcccgacgtggtaagtaatgacgaggtatcacaatctatccaacaacaaattgcatctacaatagattcatctatggctaattttaaagatcgattagatgtaatgtttaaggataaagttgatgggtttttaaggagtaggcttggttcttttatggatgattacacattaaagcataaagcctataccactgctaatcaacctcctatagatcaaacgggtagtaaaaccgacagaacggcgttcacggccggtccgaccgggcctggtggctggtcagaccgcgacacagccatcggtctgaccggccaaatggccggtcggaccaagtattaccccggcggtcagaccagctctcaggccggtccgaccgcatattatgatatagggaatagatccgatgactaatgctagttatttgtatcactttaaaacatttgatccttctgtatctactgccacaagtaatccccaagttcccccacatgttcctaatacttataataatgtttctaggggatatcctcccgatactagacaaggccaatataatcatattgcgccacaaacacaacctattaggccaccaaacccaccgccaaatcaacaagggcctaataacatggaggatatgattagtgatattatgaggaatagattctggattgaaactaggaatcgtgctagaacttacaaaaagccatatcctgattattatgataatgtgtcgtttcctcgaaattatagagttcccgaatttgccaagtttagtggtgaggatggtaagaccacatgggagcatgtaggtcaatttatggcgcaatgtggtgaggctaatagtgatacttttaaattgcgtttgttttctctatctttatccggtaatgctttcacatggtttacttctttactggcaaattctattcatacttgggctcaattagaagaacaatttcatgattatttctatactggagaaactgagcttaggttatgtgatttaacatcggttaagcaaaagtataatgaatctgtcattgattatattaagagatttagagatgttagaaaccaatgttatactttgaatataactgatagatatttggccggtcttgcttttaatggtttagttgttcctcttagagagagactagaaggccaacaatttattgatgttagtcaactcatgcaaagggctctggctcaagaaagccgggttaaggataataaaaaattagctagaccatttgacaaaaagcctaatgttaatgtagttgattaccctgaggctagtgatagtgaggaggagggtgatcatgatatttatgttgccgaatggtcatggactaataaaaataagccttttgtttgttctaacttaatgccgactcctcgcaaagatcgccaaagtgaggttaaatatagttttgatgtggccaagtgtgataagatttttgattatcttttgcaagagaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccaatggctccaagatgaagcttgatgatgatccttttccggtgaatacaattagtttcaatgataaaaaggtgttgattcggccgaagcaagtcgaatctactaaggaaaaggaagtggtcattggtgagccgaggcctaagatgatagtgccaaagaagccggaggttggcgtttggaaggagaacaaaagtggagcttcaacttctaaggcccctaggaagaccaaggtgacttttgatatgctcttggagaaatataagaggcaaggtggtgagaaaattcacaacaaagggaaaagaccaagatcacctcctagggagagatttggtcattcaccaagacggtcacattcaccttcatatcatcatccacaaaacatgtcatggggtccctatccaataccgccgccgggctacccttatccttacttcatgccatggggggcaacaccgccaatgttcaactatatgcctccaatgcaattcaatcaagggtggggaggaccgaggaggccaattcatgagcgtttgtcttcatccaacaatagccggttttatggtaagaatcgggctaatgaagaaaagagcgaaggaaagcgcgtcaaggtggaggaaagggcttcggaagtaattactatcaaagtggggttccatgatgtgcctataccttctggagatggagttggaaagtccccaagcaaaaaatccgaagccggtaccagctcttcgcagtcggccggtctgaccaggccctctagccggtctgaccgcggccatgttgccggtatgaccgggccattaggccggtctgaccgtcgacccgacagtgatccgaccgacgcctcaggccggtctaaccgcgtgccacacgtcggtctgaccggcgcgtctggccggtctgaccggtggtctatggccagtctgactgggctccagcgccggtttgatgagaggattgcaaagggcaatgtgagggcttcatcgtcttcaagcaaagttaataaaggacattatctacctcctggaacagagccgaatcctaggtagatgcctaaggatttgacggctacacaaaagagaaggttgcaacgtcttcgggcccaagagctaagggagaaaaaggccgaagaacatagggataaaaggttcaatgagttgcgaccaccaccggtatggaggcctaaatccatagagaaggcaaaaccgattgatgtagaggagaaggaagaacaatcagttgataaaagtgaattatctccaaaagaagacatggatatcaacatggtatgtatgttgcctatggagttttgtgctatggatgaagccgaggttgctcaattctaattaggtcctaaagatgcagtttttgagaagcccgatgaatcaaactgtcacatgaagcctctttatctcaaaggccatgtagatgggaagccggaacttgatgccgtattcgttattcaagaagttggggcgtgaggatgatgagttaaaaaagaccaacatgattctcaatggcttcaatggtgaaccaacggaggcgaggggtatcttttcggcggagctcaccgtgggaaacaagacgctaccaactgctttcttcatcgtcgatgtgcaaggtaactacaatgttattttgggtcgttgttggatccatgccaatttttgtgtgtcttctaccttgcatcaatgtttaattcaatgggacggcgatgatgttgagattgttcaagcggatacatcggccgaagttgcaatggccgatgttacttttgagtggcgtcatgggaatatccaatgcttttcggggagagatctttctagttatgattttattagtatctccgatggcaaatttgtacctatctctgtaaagccggctagtgtagcacggctaagccacataaatttgtataatgagtaaagaggctaatttagagtggttacaaaagagggtgcaagaatatcggtctacaaagaacgatattggtgaaaccgttgaggattttgaagaagtagagaagcttggaaaagggtttacatcggccgatcctttggaagaagtagacataggtgatggaactaaaccgaggccgacttttgtaaacaaaaatatgagagccgattacaaggttaaagtaatcgagctacttaaagaatatgttgattactttgcatgggagtaccatgagatgccaggtcttagccgtgagcttgttgagcatcggcttccaattaaaccgggttttaggccttataagcaaccacctcgtcgttttaatcctttgctatatgaccgagtcaaagaggaga

SEQ ID NO: 9522 - DNA, 660 bp, Oryza sativa
  unsure (1)..(660): unsure at all n locations
nnnnnnnnnnnnnnnnnnnnnnnnnnnnnnnnnnnnnnnnnnnnnnnnnnnnnnnntaatatttaaatcctaggaaaaatcttttttcctttttcttcttttctttttccctttttcctttgttgggccgtcggcccactcctcccgcacgcccgccctcctttcagctgggccggcccaagccgcctccctcctctccccgggtcaccgacaggtggggcccacctgtcgcccccgtcttcaacctctgacaaccgcagccgccgtcgaaaccgcccacgccgccgccgtttcccgcccttcccgcgcccactcctccccactccgtgccgcgcccacgtagtcaccccctctccgctcctcccgccctcgcgcgcccgagaatgggcgggattcgtttcgaatcccccaaactctctctccccactcccccacgtcgccggccaaatcggggggtttccctgccgtgtccgcccctctcgagcccctataaggcttccccgcactcccctccacctttttcctctttccaccgctccctcccgtgccctctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9523 - DNA, 776 bp, Oryza sativa
  unsure (1)..(776): unsure at all n locations
taggtgctagcactagatggtggcttgctagcacataatgcatttcggcacttctattaatggaataaatcaggttggacagcacacttccccgggtgccttatctagaagtagataatatatgcaaaaagtacaataaccctcccacaacaaatattgtaatacttgcctttgaaagtattttcaaaacatgtggatttagctcctacaatttactagtacattactataaaatcaatccagtcaaagtcttggattgaagaccccaaaaacacaaaataatcttaatttggatatggaaggagtatttcaaattcatcagtgacctggcggatgcattaaaaaaataggtgtggaatagaagattagaatccatactacaacaagcagcttggaatacttcaaaggccattcctcagtcgggctcactgcagacctatatcaaatgccacacgaaaaatatgctaaatattttagttgaactagccaaagtgtccgtgcattgcaatgggaagaaaatggaacaaattgtgtacatggagagagagcatgatcggcaaacaaccaagtaagatggcaatgtggaaggagagatagagcggttgttctacggtaatgaaggcgacatatgctagagcaagaggggatgggattttgtttagataaaagaactgaatttctagcataataagccgattatgaactaataannnnnnnnnnnnnnnnnnnnnnnnnnnnnnnnnnnnnnnnnnnnnnnnnnnnnnnnnnnnnnnnnn

SEQ ID NO: 9524 - DNA, 588 bp, Oryza sativa
caaacgagaaccaggctcatctaccacagcaaatctttgccaaccaaccactttccaaatagaacgaaattcaacatccatacctatcttttttagcagctccggagagtattctcgtgtgtgagcatactcccggtcgctcaacatgtagtaggcttgtctttcccgatcactgacaaggtcaaggtcggtgtcgtttaggagtcatcgcggagcttcggcgtcttccatcgagacattagctaatgaacgagtactagactcatcatgatgacttgatgaagagctggaccccttgaacagacgagacaatcgcctcctcattctgcacaatggagcaagaacggactaactcggcgggggttaggaataaaaaaaatttcacccgccgattagtttcaccaaagcagcttgtatatatgcaactaagtatttgaatttgagggaaactatcaaagcttgaatgaacttgagagcaaactttggagagggaatgaaaatttggtgaaatggggtggagttccctctccggccggttggcttaagtagtgcacccacaacggtcaaaaccgacctgtggggccacta

SEQ ID NO: 9525 - DNA, 13917 bp, Oryza sativa
cctatcagactcaaaatcacggttagcatggtagtgctctgcaatcctttgccaatatgccttccctggttgctcattgccaataataggatccgagctaatgctttgccatgaaatgcacagttgaatgtcctccttacgattaaagttgcttgatcttttggctcttcctttttgcaccatttgttgaagtatgaaggtcttcattttgcattggcaaggaatatgcctcaacatgggtctcttcggacatcatgcacacaaaggaatcacattcatttgccatcacaatctagtcactgcaataagtagataaattgacaacttctccaatcaatctcaggaaaaatggcagatactagctaatatatgttggtagaatgcataatggtagcaaatttttctaatcattagaatttagaacaggttatgctagagctctacaaaattgaattaaaaagaaaaccatatagcaccccaaagcagcttattttttttctcttttttaacagtctactcgaagaacctgcatataactaacgtcggtacaaataaaattgtgtagctcaggaaattaagcagcactacacccataccctctagaatacgatcacaagatttcagctggcatagtgtctcaaagtcatgcatattaaaaaccacactgaaaaccatatagcactatccaaaacttacaattcccaaaaccatattagctgtcacaccctgaaaattcaaaatatgtaaattgttgtttaattggaatttttagaaataattttaaaaagtcttgaaaagaagatctaattttttaattaataaattccaatataaaatgggcccagataaaatttccttaaatactttgcttaattctataattcctagatttttctgggatttatttgagctaagaaagtatttttaataaatggaattgcatttaagaaataattttaattgaaaaaggttttaaaaagtcttcttttggctttgggccgaaagtcggcccaaaacctctcttctctctccttggcccagccggcccagtccgccgcagctgcgcgcgccctcgctgtcgctgacaggtggggcccacctgtcagtcgtcgtctaccttcggccgccgccgcccgaaaccctagtttcgcgccgccgccgtttcccttccaaatccggccgttcctttccttctccggccgaatcaatagaggggaaacaatctccgggatctcctctaccttttctcctttggaatctttggctaaatcactttggaaagagttggattcgagttcatctcggatttgttcttcccgagctttccttcgccgttgccgtcgccgtgggccttcgccgccgcctccgagcccctttaaaaggacccccggtgtctcctctacccgtcgccaccttcgccttcgcctctcgtcgtcggaatcgctctagcgccgtgtgccctagcttcgccgtcgccgccgccgctccagccgtgctccgccgctgttccagacgtcgccgtcgctcgggaagaccgtcgtcgtggtcgccaagtcgtcgccgtcctcgtccgccccttcgccgtcgccggagatcgttggagcttcgtcgccgtcgacaacccgaaggtttccgccgtttcctcctcgtcgccgtcgtcgttcgttgtttttccgccgccgttttggtcaccggtgtgttcgtcgcgtcgtcctctacgtgctggtgccctccgtttgcgtcctcgcgccgccgttcgccggcgagcatgcgccgcccgagccgtccgctccgccgagccgccgccgctgtcggtgacgtcattgccgacgtcatcggggtcgtccgccgtgagccggtcgtggaccgttcgatctcggccgtccgttttggattggatcgatctcggccgtccgttcgcgtgaaccgccgcccgtacgctcggtccaccaaaaccctagccgctgacgcaataaaccctcttttccttttcaaaaataattcattattgcgtcataattcaattttaaccgatttaagtgttttaatccgattaaatctttaaaaaattcataactaattcatcttagatccgatttagttggttcaagtctctaaatttttctaaaattgagatctacacattaaaaatatccacatgtactgttcatgcttgtttatgtactgttttggtgattttgctcttttctgcttagattccgtcgtttccggagagtccgttttcgccggagaagagtttgaagagttccaaggccagcaaggcaagtcacacagatcccaaacaaccctttgagcatgttgatcctatttaaagctattgtttcttttcaactattgcatttattttcgaatgtcattgggtggaattaacctattgtttgttatagccctttgttcttgattactttattccttgataccttgggttataataatttgactagttgagctttatttatattggttcaactagatattagatataattgcttagccctgcttagaaaccttagcacacttatgggataactaatgattcactattatttcatgatggcttattgatagttcacgatggacaatcgtgattggttaattaattaatgtgccaactaaaacctgataatggtgggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgtgaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtcgaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattacttaactgttttgttaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggagtggaggtttaggagtagccttggtcaagctgcctgtggagtggagccgtctgcgccgtttattttattttccgctgcttagatctttattgtttgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagccccttgaccctaggttatgccaaatggttacccatagaagccctctaaaaatattggaaaagtagaactgttctcctccctttctcttttaattaaaccaaactaatggcacatgcatttcataatctcttttaatagttctcattcaaaatttattccagtgttattagtactgtacatccattactgtactaatggctcatttatcagcaaaagttttacaatattgttttatttaatcttgctgcaataaaataaatttagcatgatgattttataactttcttttatttcttttgaaacttgttgttaaaaagtacaaaatttgtaaccttgttttcaactatttcaaattatcttgcaagtttggtttactttatttacttaccttttactttgattttcaaattttattcaagttaatccaaaaacttgtgctgttaattggatagatgtcttaactctctcctttcacttgtctttagatgccgcgctacaagcctgagtacctgtttggtgttgagggttttgtccaggagttgcgtacgatgtcctttgccattggatttgggactgcccctttttatgcccagattcctcatgatcgtcatgaagagaagtgccgagtcaaagtcaccttaaacagcaatagtgaagaggtcccctcagtgatgttcgaagctggaggaagaaactacgtccatgcatgtcaggaagtggcaaggatcgccataggagaactccgtgatagctacagtgatcagttggccgacactgagtatcgctaccatcctcgtcaaccccagggaagtgaccgtggcagctaccttgagactgaaggaattgagaatgatgctaccacaaggcatttggttgagatgctgtgggctatggatgaaagtcgtgcggagactgtgttagcagctcaagatcgtgaagaccggaatcgtggtaagatttgcaagctagaagacaaggtggatcgtttggagaaggagctagccgcattgaagggagaagcaccaccgcagaaggccaggattcgtcttaccgcaaggaagagagctctattcgtccctcgctatcaattggcgccaaaggttcgtgtggtggagaaagaagttgcccatcccaagcggatcctccggtcatcatcataagtgatgaagaagaagaatccaagcgcaccaattccaagattgagtgggtagcaacccaagatgatgaagacgagccgaacgagccttcaatcgacctccgatgcttggaagaactagagtgacttgttaagtcgttgtcttagatcgttgtgttagtttgtttgctttaggtttgcttgtgtgtggctcgcatgtgatttacatcagtggtgggatgtaattgcatgcgtttgtttgcttttgagtgttaggaagttggtgagtttagtggtgtgagagtcttcagtttgtaataatgaaactcagttaagatcaataaaagttaaagtaattctctatcctaagtagttttcccccggtttctcttcttgtgccctgttcctgccagatggtgaatactcgcagcaacgggaatggtcccaacaaccccaataacaataacaatggagagaacccaactctggcccaagttcttgctcaacagacacagcttatgaacatgatgatgcagcaacttcagaatcagcagaaccaaggaaataaccatgcacctccccagaacaagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaagagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgacgagctttcttacccactcatggttggagattatcctgatttccagaaattagtggataaggctatacgtcaggaggacaagtacaattgcatggagcagaggaaacgtcggattgctcacttcaaggcacaacaggggagtaatcagaagccgcgctttactttaggaccccagtctatgccacagggaggttcttcgtctgttgttcgtccgcagcgtcagttcttcaacaacaatgctggcaacaacatccgcaatcaagctccacgtcctgttgcagctccaacacagcaacagcctgccaagagggagcaaggcagcaagcccgtggtgtgtttcaactgtggagacccaggacattatgctgacaagtgtccgaagccccgtcgcgtgaaggttgtccctgcccagagtaactctgctgtaccagcatcaaaggcccgtgtcaatcatgtcgctgctgcagaagctcaagatgctccagatgtgattttgggtacgttccctgttaactcagttcctgcaacagtacttttcgattcaggtgctacacattcattcttatctatgagttttgcgggaaatcatgggatggaagtagaagatcttagacatcctttgatggttagtaccccaagtaatcaagcactctctttgcagcgtagcccctcggtcagaatagaaattaaaggagtaccatttgtggccaatcttatcttgttagaatccaaagaccttgatgtcatcctagggatggactggttagccagacatagaggtgtgatagactgtgccaacagaaaagtaactctcaccagtaatgatggtcgagtggtaactgttcatgcattgtcttctgagtctttaaggtcaagactgaatcaaataactttggaagagattcctatagtccgggagtatcccgatgtgttcccagatgatttacctggaatgccgcccaaaagggatatagagttcagaatagatctggtaccaggaacaactccaatccataagagaccttatcgaatggcagccaatgagttggcagaagtcaagaggcaagtggacgatttgcttcagaaaggatacatcagaccgagttcatcaccatggggagctccggttatttttgtggaaaagaaagatcatacccagaggatgtgtgtggactatcgtgcattaaatgatgtgactatcaagaataagtacccgttacccaaaattgatgatttgtttgatcagcttaaaggtgctaccgttttctccaagatagatcttcgatcagggtatcaccagttgagaatcaaagaggaagatatacctaagacagcttttaccactaggtatggattgttcgaatgtacggttatgtcttttggacttaccaatgcccccgctttcttcatgaacttgatgaataaggtgtttatggaatacctagacaagttcgtggtggtctttattgatgacattcttatctactctcgaaccaaagaagaacatgaagaacatcttcgccttgcattggagaagctacgagagcatcaactgtatgctaagttcagcaagtgtgaattttggttgtctgaagtgaagttccttggtcacgtcatctcagcaggaggagttgccgttgatcctagtaatgtggaatccgtaaccaactggaaacaaccgaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttacctgatccaaagaagggtttccaagtgtattgcgatgcatccaaacttgggttaggttgtgttttgatgcaagatgggaaggtggttgcctatgcatctcgtcagttacgtccgcatgagaagaactaccctactcatgatcttgagttagccgcagtagttcatgcgttgaagatttggtgtcattatcttttcggtactcgtacagaggtatataccgatcacaagagtttaaagtatatctttactcagccggatctgaacatgagacaaaggagatggttggaattaattaaggattatgacatgggaattcattatcacccgggaaaggctaatgttgtagcagacgctcttagcaggaaaggctattgcaatgctaccgaaggacgacagttgccattggagttatgcaaggaatttgaaagattaaatttgggaattgtcagtagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgcgtccccgacaacaaagatttaaaagatgcaattctgaaagaagctcatgatactttatactccattcaccctggtagtactaaggtgtaccaggatctcaaggaaagattttggtgggcaagtatgaagcgtgaaatcgcagaatacgtagcagtatgtgatgtttgtcagcgagtcaaggcagaacatcagaaacctgccggtttgctgcagcctttgaagattcctgaatggaagtgggaagaaatcggtatggattttatcactggtttacccagaacgtcatcaggccatgactctatttgggtaatagtcgacagacttaccaaagtggctcatttcattccggtaaagacaacttattctggaagtcgattggcggaattgtatatggcaaggattgtgtgtttgcatggcgtccctaagaagatagtgtctgatcgaggcagtcagtttacttcaaacttttggaagaagcttcaggaagagatggtttctaagctgaattttagtactgcttatcatccgcagacagacggacaaaccgaaagggtaaatcagattttggaagacatgttgagagcttgtgctctagatttcggtggaagttgggataagaatctaccctatgcagaattttcgtacaacagcaggtatccagctagagtcgacttcaggcatggcagcttacgaagcactgtatggtcggaagtgccgcactccgcttttgtgggatcaaacgggagaacgtcaggttttcgggacagatatcctaagggaagcagaagaaaaggtgaaaataattcaggaaagattgcgagtggctcaatctcgtcataagagttatgccgacaatcgccgtagagatttgagttttgaagaaggagattatgtgtatcttcgtgtcacgccttttcgaggagttcatcgttttcataccaaaggaaaattggcaccgcgttttgtgggaccctataagattgtcagtagaagaggagaggttgcttatcagttggagttacctcaatctttggcaggagtccataatgtgttccatgtgtcgcaattgaaaaagtgtttaagggtacctaccgaagaagctaatcttgaacagatagaagtccaagaggatttgacctatgttgagaaaccaatccgtatcttggcaacaagtgagagaagaaccagaaatcgagttatccgtttttgcaaagtccagtggagtaatcactcggaagaagaatcaacttgggaacgagaagatgaattgaagtcagctcatccgcatctgttcgccagttcttctgaatctcgaggacgagattctgtttaggggggtaggtttgtcacaccctgaaaattcaaaatatgtaaattgttgtttaattggaatttttagaaataattttaaaaagtcttgaaaagaagatctaattttttaattaataaattccaatataaaatgggcccagataaaatttccttaaatactttgcttaattctataattcctagatttttctgggatttatttgagctaagaaagtatttttaataaatggaattgcatttaagaaataattttaattgaaaaaggttttaaaaagtcttcttttggcttcggcccaaaacctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgccgccgccgtttcccttcaaatccggccgttcctttccttctccggccgaatcaatagaggggaaacaatctcccggatctcctctaccttttctcctttggaatctttggctaaatcgctttggaaagagttggattcgagttcgtctcggatttgtattacatatggattatgagattaattattgtattaattaatagtcaaaaatttgaggaaaacaaaatcacataataaaaaaacaaaaccatctcatcgtggaaggttagttcctacccatttcttctccaaatatacattttcgtactgacaacttttctctcgaacacgctaggtgctaccatataactcaatccacaaatccactggaaaaatgaaaacatgataccttcaactagcgccagggagaagggcgtcaggatctagggaggatattgctgggtgggcaggtggccggccaggaaggagggcaccagggaggatgcctacaggggaggagggtgccgccgcgccggcaaggaggaggacgttgggaaggaggaggcctaccggggaggagtgtgacgggcagggaggagggcgccaccaaggatgagggcgccggcaggggaggagggcgccggccaggaggagcggcgtagatccgtggaggcgccgctagcaggatatttcgcacgaaaaaagaagtgcccgtgcgtctctgccgcggatgggggctgcggagaaagccccagggactgggggcctaaggggataatttggaggctttcctactttaggggctttagtagggaccttgttggacctgattttttagtctcaactctcaaaattagtataggggctgtgtttaggacctctactggagatgctctgtaggggccttgttggacctgattttttagtctcaactctcaaaattagtataggggttgtgtttaggacctctactggagatgctcttagcattgaattaattgaaaactccaaatttgtataggtaggtcctcaactatattaaaataacatgatggaatatggagtattgcaataaacttgtcactgaatattttgagatactagacgtaatcccacgcatttgctacatggctattttgtgtttctctgtaaataaaattcttatgatagtgggagtatcttttatagagttgtataattttactttaccatgcaaatacatttcatatcaaaagtacctacacacaatttttacacaatggttttcttcttgatttgagttactatctctcgtattagattgggggcatagctcttgttatggtatttcactcacaagtatattttgtaccaaccaaatagtgtactattcattcaaaagtaggagtaactacataggagtatctttttttaacaatgtatggcatgtgttttaatgcaatcatgcagtaaaatggggaacagcaaagatagttgaataccaatcactcaaaactgtgagcatatgctaataaaaatcggcaaatattgtacaaatgtgtgtacagaatccacaaatggcctagataacataaaaaataaacttaatatatacaacctactctaaatgttttgttaatgatagatttcaaactgaaataaaatatcaagatgatttgcaatgtgagaataaatgtatgtgaagaattatgaaaaccaaaaaaattatatgctttaatatcaaaatttcaagatggttaataaatgttggtgtatgtgttttgtaaatattttgctttaaatgaaaatcatattgcgaggcaaagccatggcaatactttaagtcaaaaaataattttggtgtatgtgtaaagaaaaatcaggaaaccacaatgaccaataatgaaaacttgctaatccacatcaaacttgcacgtgtaattccattatttgttgtgtatttattgtttcaacaaattatgcaatagaaaatataccgtacgatgtacgtaaaataaagtatgcttcttgtgttgacctaacactcaccttgtactacatgcatgtaaagaaatcaagcttgtgcatttgcttatattggcacgaaactatggcaatgaagtaattatcagtgttatggtatcataattatctgtgaatttagtttgattttttaattgatcacagtcgagctgcatctatactaatataaaaaggaggagttacccccttgcaatcctaccggtgaaatcattgttgacggtcgttatcgatcaatttcgaccgtcaatattactaaaatagaggagaactagtgatgcttgcaatgcatatatctgttagaataataatattccactagtattaggtatactaaccttttgcagagaatgacaataaaggggaggagaatcgacatcaacttagacgataaatcaatccgaccgtgtcgagaatatgtatggatgggctaagaactcagaaataacacgacacattgggccaaaattcacaagtctacataaaggagcaacagaggaggccgccagccgaaaggtgggctagttgggccggcccctggttcggccgaacctccctcgcctccgttggatccaggttttggctgcacggttgagatgaagccccaatgacggttggaggatattactgaccattccaaccgtcacaaccgtcatagttcagctataaaaggagctcctcttctcacttcactcacacacctcaagcaatagctccctcatttctctcaagtttagtttagtagtatctagctggtggaataggaatagagtagaaatcaggagtccagaagccttcggaagagttcgggtatggctctagtagcttttctcttctcttttgtaagctttgtacctttattagaatactcttctatatacatttatggtattgaaatactttccgagtatatgaatgcctactttacattatgttcatgttatactgaatatacggctagcttatctgggagatgctttggtgcgggtataatgtttgcatatgcaattactttatgtcatgacgatgatattagagtagtatctggtagtttagacatgatgtctagattacgggatatcattatttggggttatatattgcggatgagaggtgggccactgatggtgacagctcagtacgggtattcctccgcgccggtatataatcctaagttaattccctggggagggtattcctccgtatttagccccggttgtatggtcatgatgggctgtcgtaaggaactcgacagtcaggggtggcttctcgaagtaccaggagggcatcggatagagggtattagctaatatgtcagttaactagaatgtatctatactatgtgttggcaactttttgtgacaagttggcaagcacgatcgcagcaccttatgccttgcggtgatcctagagtcgccaaaaatcgtgttggcaactttttgtgacaagttggcaagtacgatcgcagcaccttatgccttgcggtgatcctagagttgccaaccaccttgatctagcaaagagctaaacctagatgggttttgataactaaaccggctagcggagccgatttctagataactacccgtctcgtgggcaaaacggaaggttttcagaacaaacttacaaagaggtgttgcactctcacagcggcggcggacggtttacggcgcaaaccgacaaagatggcaaactaagagaaaactaaaagcaatatgaaaaacgattcgattgattgatagtagattggtcttttacaatgaaccggccatgtcccttatataggg

SEQ ID NO: 9526 - DNA, 432 bp, Oryza sativa
  unsure (1)..(432): unsure at all n locations
actatagggcgaattcgagctcggtacccttagacgataaatcaatcggacggtgtcgagaatatgtatggatgggctaagaactcagaaataacacgacacattgggccaaaattcacaagtctacataaaggagcaacagaggaggccgccagccgaaaggtgggctagttgggccggcccctggttcggccgaacctccctcgcctccgttggatccaggttttggctgcacggttgagatgaagccccaatgacggttggaggatattactgaccattccaaccgtcacaaccgtcatagttcagctataaaaggagctcctcatctcacttcgctcacacacctcaagcaatagctccctcatttctctcaagtttagtttagtannnnnnnnnnnnnnnnnnnnnnnnnnnnnnnnnnnnnnnnnn

SEQ ID NO: 9527 - DNA, 12574 bp, Oryza sativa
  unsure (1)..(12574): unsure at all n locations
tcctgcagcccgacagcaggaattttagcgtggcaaggagatgctgcaatgtcatgttgccctgttttactaataaaactagtaagtttaaccaaaaacttaaggttacgctggccagctaattaacgagcacaattgcttaagctagtagagaaggccttgttagttctaaacattaaggcctcagttatcaagtcggcacagctagagccagattagagggagcagcaaacaagcagagttcagagttacacacctcttttcatcgtctcctccctgcttttttactcttaatagattacaaaacttaacaatcacaactaatccaagtgaaatagatgggagtggacatttccccgacggcagcgggatccgtcggggaccctatcagtagagatgaaatcggttcggatagttttcaagcgtccgaatgtttttatggaaaaacaaaagcaatgtcggatgaataatttcacataggatcgaaaatagaaataaatttagaatttttcagaaacagatatgcatatagttaataaatatgaagttttatccctattagacccttaatttagatttttatttaattataaaataataattaacaatgcaattaacgtggattcctctttttaaaataacaagttttcacattaaaaaaacacatattttttaatatttatacatatatatatatacacatatccggatagtatatcttgcccaactcatttgtcaaatatctttagaaacatggtatgtgttgcagttgcagctatctgttatacttactagttccagaccatacatttcatggaatgtattattttttttaattttaaataaactaacgaatctaaattggttacaaatgacatatcgtatttaacataaatttaatatattattttgaataaaagaactatttctatctcatcgttgattttggaagcatagtccaagggcattcatattgcaatattcttgaccatattttttttatttgctatgtatatgtatatgataatatcttttttcgtattatgggtattcgtatttgtttttagttttttttaaaaaatatgaaaatgagtataataaagctgatgtccatctgtatttgagccattttcatctgtagctatcaatgtactaaatagatatatgctctgaaatcaaccaaggaacgggagcaggttggccagcctgcagattaccatatatggacatggagggatgggagccatggattataaccaagaggtatatggtatgagagctgctacagcccgggattccgtcaaaacgggatatcacgacttcatattccgacttcctcccacactacgtacatgcacgagtcgcgagctatatctcgatcgcgttggcgcttctctcgtagtatcacactgcggccgaagaggtgcgcatcgtgccactatacgagcagcacatcgaggacgtcgagtccgctacgccactgcgctcatgcgccgtgaacaaccaattaatccatgtctctctcgctggtgctggcgccggccggcagcgtcaatggaactagcagttccgtgggcgccgccgccggccagcgtagtctcgacaacgggaaatctatacgcatccatcatctctaaagctttgcatgtgctagtgttcctctctctctctctctctctctctctctctctctctctctctctctctctctctcatatatatatatatatatatatatatatatatatatatatatatatatatatatatatatatatatatatatatatatatccatggacactttatgatatggttgtgtctatatatgtgctaatacctgataccgacatataccaggtctggtatctatatatattgggactgataactaggtactatgtatcgggtatcacacctgataggctgatacctatagatatcgggtctaatcattgttagtaccaggtaccatatatgatacctatcaatcaagttagatacctatcgatatcgggcctaatcattgttaatatcaggtaccatacatgatacctaccaatcaagtctgatacgtattagtatcagacctgatcattgttggtactaggtactagacatgatacctatcgattaagcctgaaacttgtcagtatcagatctaatatgtatcagacatgatacctaccaatcttgatacttattggtatcgggtctgatacgtatcggtaagggggctgctatataacggtatctcgttttcgaacgagatgatcccgagtaggtatcaggtgtaatacctatcaggtatcagatgattctacacacgtttcaggtgatacctgcaagtatcatgtgatacttatcaggtatcatgcaattttctaccacgtatcgcgtgatactcgcaaggtatcatgtgaaacctgttaggtatcagatgatttcaaccacgtatcgcgtgatactcacgaggtatcatgcgatacctgtcatgtatcagacgatttctaccacgtatcacgtgatactcgcgaggtatcagacaatttctaccatgtatcacgtgatactcgcgaggtatcagacgatttctaccatgtatcacgtgatacttgcgaggtattagatgatacctaccaggtatcaggtgattcctactagatatagttgggcatcccgttgggggaggagcaccccgacacgcgcggtcgcccctagcagccgtcccttgtagatgaggacggcgatggcggcagcagaggacgggcgcggcgacggcggcggtagcgggggacgggcgtgtcggcggtgggggatgggcgcggcggcggcgacagcggctgcgacgggggacggacgccgcggcggtggcggcgggggacagcgacggcggcagtgggggacgggcgccgcggcggcggcggtggccgcggcggaggaggcgacgggggacgggcgcggcagcggcgggggacggcgacagcggcaagtgaatgtatggataagaatcgcgtgtggagaggagctatcctgttgggggacggtatcccgtcccctagcattcccgtatcggtaataagcctgattattgttggtacatgatacatgacctgatacgtattggtaccgagtaccagattgatctgatacctacttataccgggtctcatcaatccttattagtatcaggtactaccaaatctgatatttataggctagggacacggatcaagtctaacatatcaccattcactgtagtagtttatatgccatccacctgcaaccacgatcgaacttgtcaaaatcctaattaatacagtgcagctgcaagccatttccattttattgggacttgggatgcgtccagatctgagtagaaacaactagctgaggtttgatacgcagcaattctactgacacattctggataaaaatccgtagctcctggatcatcaatgaaaacatttactttcccgaaactaaacaaaatgaagcgaactctggatcaatcaaaaccacctcttgcataaaaaaaaagttccctaatccaaagacgtagcaacacaccgcatgaatcaacctccccgtggagcagccactagctgacagctgctgcgcatggcctctgcaagaagctggatcacgagcaatgagagaagaaagaggaggtaagagaaaggaggaccgagggagagctgccaggccaccacgcgaggaggagagagccaatcccatacgacggaatcccgttgtatagttttttttgatatggtatatgcagggccggatccaacgtgggtgttgggaggacttgagtcccccctacatccacaagacttataagacccatggataccccggagcaccccttcgatttttttaccataaataataaactaaaggtccctaaatagctagaggttgaagaaactatataattgagccctcaagattttgtcctggatccgccccgtatatgagcaagtataaccctatcagcctatcataaatcccattattgacgttggtttctctccttcagctgtccgactgcacgttgccacagtactgcccgtctcgacgggaactcaccaaccagcacgtaccgtcacaccgcaggcctgaccggttttttttgcttccacccagcctcgcctaggcccattgtcaaacccgtggataaaggaaaaaaataaaaatatactgttcattgtttttttaataaaaactggataacgaatgttttgcacaaatatttcacagacgtgtcgagagtatcatcttctctttctaatcatgcatatttaacagagaagcaatcagacgcgccgaaagtgtcatcgtctctttctaatcatgcacatttaacattgaagcaatcagatccgtagtcatgcatatctaaagtagggaaaatactaaagtttttcctcaccatattgcgccacgtcatcaagtaaatactgaccatctgatgaaagaaagatttattccgagccgttggatctggatgagtctgaataaaggaggctcagtaaaatactattgtcgctcccatctctcagtcaatcaaaggagaggcttcagaaagcttcccccatctccccgtcactcccgtccttgctgctaggcgctaactcccaccggccattcctcccaatctcttctcccaccggccaccattcctagcaaaccattgccgacgcaaggagaagtggactcttctagaagcttctgaacggaaggatctagagtttttgtcaaattccacacgtaagttacgtagatacgtagtacagttcttcaataggagaactaggcaactagcagaagagaattgagaaaactgacgaaaaaaaacgcaacgcttccttgatcttcaccacaccaactcaccatctccctattgggaccaagtcagtgcaggcagcacaagatagaagccctcgatgcgctaccatgctgctggccgccgaaaactcatctttagaaaagatcgacgaaagggggctaggttgaggagatcactcctcactcctcagtgaagccagcctcatccttcagacattctcctccttttcagtgcaaatccacggcagcaaaggtcgagctacaggctacctatagcagagacgaaggggacaagatgcggtcctactcgtggagtcgtggttggtctgtgtatcccagaacccagagtcagatgcaaaagggaaacaatgaataaatgagtagggacgataatgatgaggactggacggttaaattttttttgactgtaggaaaacgtctagggctagattggtttgagatctaaattaatcttaccaatttttataatttcaataatatttagtgtttatttggtttgaaattaaattttagcatgccttaaaaaaaggccatttcaatagttaacttaggttattttgatttcgattcaaacacaattttagcttgccaaaatttggcatgacaaaaattgataaaacctcaaacagcccgtagtgcatccatcatcagcatgtcctgtacatatgtgaccctgttaaatgcagagaaaaaggctataggcaggatgtgtgttttaatatgcatatgtaaatagtgtagcaagtattcttttaaataaataatttagttaagtacttatatgcatatgtactaattactccctttattctaaaatgtacttagatacagtgttacctttttacacaatcttttaacattatactttttttagggaaattttaacattatactttaactactactaatttctttcgtttattatcgataactacgaaatcaacgttacataaaaagatttaaatagaaacctgacggcactcccttatcatatagtgatataaaaatcaaataaaaatcgacatacatagcactaatcatatactcctaaacttttagtccattcattagtcaaatttttaagttttgattttcctcaaaataagaatgccatatatattttagaatagatagagaaacacgttagtatttatttatcatataataatgcactctcttttgtcataaatatatatcttttgttttttttaccgaacctttaaaattttgcccatcaacgagaactcaataacggggcactgttggcctcacccatatatacatatttttacatatctttcgaacgggtcttaaaagagccatgcaacgcgtggcttacatggctagtttaaccatgaagcgatcagacacgccgaaagtgtcttcgtctctttctaatcatacacatttaacagggaagcaatcagacgtaccgaaagtgtccttgtctctttctaatcatgcatatttaacagtgaagcaatcagacacgccgaaagtgttctagtctctttctaatcatgcacatttaatagtaaagcaatcagacacaccgaaaatatcctcgtttctttctaataatgaatgttttctctgtgcaacccagatggtgcacaccttttttctatcctcaaacccctgtaaataattgaaagaataattaaaaacacctaaaatcacattttacggtggattgaataactcctaataaatttttggtttgtgaaacgtgattttacaagcattaagtgtggtaaatcaaagaaaaactgcccccgaaaattcagccaaagttgcagcgaacgttacttgaaaactgaaaaaaaaatatatatgaagaggaaaaaaccccacgtcgactagattgcatcgaaaattacaacacagcgagcgcggagatgatccgccgccgccaccgccccacctcgccggcgccgccgctggacaacgacgacctcctctccgagatcctcctccgcctcccgccgctgccatcctccctcccccgcgcctccctcgtctgcacccgctggcgccgcctcgtctccgaccgcggcttcctccgccgcttccgcgcccgccaccgcaagcctcccctcctcggcgtcatccaggtctgcgcctaccccatcttcgcccccgcgctggacccgccggaccggatccccgccgcgcgcttctcctggcggctcgacaaccgccacgacctcaacgacttgctgggagtccgccacggccgcgcccttgtccacgtcaacacctgccgctattctcagcgcaggctcatcgtgtgggaccccgtcgccggcgaccgccgcgccgtggctattcccggcgggttccgtgacaggggggtggtcgtccgcgccggggaggtgcgctgcgtcgccggcgacggcgacccgggccacgtgcacggcggctgccattcgagtccctttgaggttgtcatactaggcactaataagaatcggacacacgcgttcgcttgtgtttactcatcggagaccggcatctggggcaatgtcatctcagccgcagttaattttggggattgcatatgcaattttactaccttggttgggaattccctttactgtttgctcctaggtgagcagaggaccagcttctttcagttcgatttggataaacagataacagctcagatcgatgttccacccgatatgcatcctgatgggaatggccaccacagatttggggatacaatctgcagatttgcgcctgcagagaacggcgggcttcttttccttgttgtcacacattatactctcaatgtatggaagagtgagaccaatgctgatggtgtcgctggatgggtgctggagaaaactattgaactggacaggctcctttctttggaaccagggcctcagaaaacggcaccgatgcttctgggcttctctgaggaacataatgtggcttttgtgtgcacgtatattggtgtctccatgatccatctggagtcaaaggaatttaagagtgtttcccaaagaatgagtctaatctatcatccattcactagtttttatactaaaggtaattgcttcccatgccttttccgttgtacatgtagcaaaatcatgttatttccagtagcttgctttttctgaatgccttttattcgctccgtgacaattaatgttcctttaactgcttgataaactgtcctaaatattgaatgttgtttctaatattagtctctatctgttttagcgggtttgactaatttatgctttgaacatccatagcttagaagttaggaccattattactcatatcagaaatactagaactaaattttgagctcctattcatttattcaacttgtctgatggtagtattaatgtgtgcatactacatggtatagtactttttagcttgagttacatatcacttttgaaattagcaacaaccatatggaaaacatacctgaaccaataaattgaaatatcaaattaccaacacagttggcccacttagaaggttccaagctaggtgcagtctttttgctcaatacttttatataaattattgactgtgttgttaaatgtatggctttgaattgttacctttcaactaattgatggttttaatcatatgctgagaagtccttttgcaagtgcgtgctccatttgtaaaagagaagacataagttgaatatgtttggcctaagttctataaaattcattactggctacatctgtagttatagtttatttgctttgccgtatttttagttttgtctgtttgagaagcatggaatgaacttgtgaaagattatatatgatgcactttttcctgaccaactaaattgtgcagggtatagctcttcattttacgtaaatgaacaagtagtcagggaggtcaacccattttttattgcaatgttgttacattagagtctgcaattgagaatggaaactcattgatggacttggaaagatccaaaatatcttaagaaattaataacagtttgcttaatttgtagtcctaatttttcttaggatgctgggtggtgaatctgtatttgtgtattttcctgatgtttcttcatggagttgtatttttgtcccagagttatttacttgctggctgtttgtatccacatctgactagtattaattaagaagttggttttgtttcctggatacatactatagaatgactatatcacttcctgtaagcgaatttttgccaacatgcgtgtccttcatttgagttagatgttttaagaattgagatttggcctgattttggtgtagcagggttccgtttgcatattctgctgactaattgtcttttgtgtgcttattgatggcagaactgtcgccccactgatggatgatcatgtaatttgaccatggagatcacaagagcgccattcctggtgattttcgtgagttttaagatggctaactatatttcccaagtattaccaagtcggatatgatattcgttgtcagtcctagcaggttttgtacggtcacatgttcctaatacttggatcgatataatttagcgacaataatgtaaatcatgttcaagtgctgcatagataccttcatctgcaattcggtattgtcgcctgtgtctggaattgtgatgtcacataatagcagtcattattcttgctcctgtgaatgtgctctctatcccgttcaggaaaactgaataatcacctcactttggcgtagatactgtgttatttgtgtttggcttgactgatggtaggtcaattggacataggcgcaacaaggtgcaaagttttcctgaaataaaagaatgaattgactttgttgtcaagtttatcaccaagtagtgcttctgtaatatgcatgccactggttgagtagccactagaaaaaaaaaacaaaaccaatgttgtttctgaaaaattgaccctgtgccacaaagttgattggtattgaaaaatcgccccatagttgaggcgattgccctctcttttgccacaacaccatgtacgttccctttcaaatttctcccttcttcctccatcttcctatgcacgttgccaagctccaccgatgaacgcattcaagncttcgccggcgccaccctgctcccaaactctgctgcatcctctcgccatcaccgtcgataccgtcgaggctggtggcagcgtgggcacgatgggcgatgttgatgggaacgggtggcttggtagagacttccacgtaggtgagaaaggtcatgaacacgacggcatggcctagttagacgtatagagaaagaagatgagaatggagggaaaagaggggtaactttggaagtccatgtgttgggtatgttgtgccaaaagagagcgcaagctagcgcctcaattaaaaggggggtaactttggaagttcatgtgttgtgtatgttgtgccaaaagagagcgcaagctagcacctcaattatggggcaaaaaatggagcgcataggagatttttcatgcctagccaccgtgttgcctaaagaggtaactcgggcgacaccccaaacctagcaccgctcctccccctacccatcaccctgcctttgtcgccgtctaaccagcatgttgggagcacgacaagcaacgaggaaggtggcagcggggcaatcccacccagagaccttacgagtagagaagatgctgatggcggcaacttgggtggtgcgagtgtagctggtgtttggaagcattcagatccacaactagttaggctagatctagtcggttcgtcttactgatgcttgtgctcatgagcacggcgaaggtaggcagatctggcacatccattacaagatccgcggatctagtggcgtcatggcatccgcagctgcaggtagaggtcttcttggaggttcgggggaccggcaacgatgacttcaggatggaggcctacgaaatcttcggtctggtgtagccagcatgtggaggcatgaccctgcggtgatttggttacagtaacgatagtggcttgggcggtgctgacttgcgctatcgatggtgttggaccaaatccatgtgcgagaaggcaactgtgcttggcctcgtggcaatctgtcatgtggtgatgacaacaacatgggcggtgctagccggcgaggtcgatagcaaaggacaaactacactatggggagagcgttgtgctcggcccttgcggtggtttgtcttgtggtgacaaaaatgacatgttgatttggggtgatgcatgaggtgggtggagggtggcctgtagagggacaatgggtcatgattgcaggggttggtaggctgtagcctgcatgtgtaaacctatcctagtggtttgttgcgtcagtaacaccgacacttttgagtgtcttgttacctgatgagggcattgttgaggcacctccccctgccgctggtgggacactctaggtaaaaaccatatccagttcattagatgggcagttgcggcactatggcatcacatcctccctggaggcatcatctaggaggtctcgttcctgcctttcccacctccaaatagtttagccaacgcttttgaatggcggtgggttatacgagggatgcacggatcatcgtctctctcgctctctcgcccttcttcacaggtggtgtccatgaggccattttgtttcttgctgtttggaggtggtgaacggtataggggtgggtacgttataggtttggtggcgttgttatgcatagtggcaggcgggcggttctaattaaatttaggtgtgcgtaatgccgtcggtgcgtggtggtcctattttttttttcttttgcccgattataacatcgtagggctatagtcttgtgattttttttctgctatatcaatacaaaacaccatactctcaggtgatgttcattcaaaaaaaaaagaactaaggtgcaaatttgcaacatcaatcagccttgtggcaattgtgagtacactcttcgactttgtagcataagagcaatttttattttctgatattaatcgaaaaaaaatgtgagcatgcacctgtactaagtaactttaaatctaggtgggccagtttcacaatagcctaatcatgagatgcccatttgatcgaattaataacagaaatggccattttagacaccccagaaaaaaaaaagataaagaaagataaataaacttgccaactataggttgttgcatatccaatgaaaatatattgtgacaatatgtactttcgtagaagtatagttttatatatatttatgctaccatactataaaaataatatcataaaaactattccctccgtctcaacatatagcaagtaggatgggctcgtcttagctatatattgggacagagggagtgctgtcaaatggacaactgcgtcacgtcgaaggacgtggttgctcaacagtgttggaaaagcaataagtgtattgattgataaaatttcttgggatcccccattacatggccctaggggtctatttatagccttagcacaggcttacacctcctagggtttaggtttacaggggattttacatggttgcccttataaaagggatatttacatgggtacacagtgtcatttgcatatatgggcctttaatgggccgataggctgggcctggtctatggtgaaggggccttaaaggtcgggggcagcctggtgggcctccttaatgccgaactcgtcatggcgaagtctttgtagttcgccg

SEQ ID NO: 9528 - DNA, 3081 bp, Oryza sativa
cggctcggggcacgaggcgcgtgcggcagaggacgaggcaagggctagggacgctctcgaacacctagcgcgcaatgaatagtgccagattccaattaaccctattttagcctatttcctatataaattttattctataaatcctaatttttgcataaatgaagtttactcagtatttgtgttattctaaccaatagattcaccctagattaatattacccatattatatttctatataatttatttgaatccttaattagggctaactcttattccaacgcacttaaatttaattgatactaatatggtcgcgataatatttttatttatttctatcctcacctaatatttattttaaattgtattccaattatttatttagccaaattaattttagggtttattcctaattagttattcttttattcgcgattaatgaactccaaaatcaaaatccaatgaaataggcgaataaaaccggcatgatgcaatttatttaaaaagtttttgaagatccgtatttttagagttttgattttgttggtcgcattttcagggtgttacaagttttacccgtaatgattatcgttaacaattaattgcagctggcaaagtagtactcagtgatccaacactccatgatcagttgaacagaagcacgtcaggttaaaaactcttacagtcatttaatttacttattgtaatattcgtattcaattagattcatacaaaattaattggtatcatctcttctaatgtttctttgaatttttgttcgctgatcttgttatttcttgcacaggaggaggaattgatgctgcagatgatgatggacagcacacagatggtaagtggtgacattcttaggtttagctagctgaagggttttcatttttttacatggttataagtcttctgttatagctagctagcatccaaaaaatgtattcagaatataattttgctgcaagctagtaaaccttcttctccacaatcctactacagtttgttttatttctagagctttcattccaagctttactttgattattttcgaatatgttagaaattataggttaattacttgaataattttttctcatgtcattcaccactaggccattctatggatttaactgaacaagatgataccaaagcagtattaatacttatcttcatcaacttttacattattttttatatgtaatcgtactgtcattccaagacagagctcctaccatttactgaataactgatcttcaattcagtgtatatagctagcatagtagcatacccaatatatacattattgcattcagaattttttttgtgcaagtaactttttcatgcatgcatggtgtgtcatatatatgcaaacttcgatattttgttatgctgctagatatctttaaccagaatgtaatgacaagagttcctttttgatttgacaggtaacaagagtcattagtatgatggaatggaagattgagcttcaatattctgcttgtgaacaatttaatcaatcgatttccgaaataatttgtgaacatcaagattttgcttgaaattaaacaatgtttattgaactattgtgtttgccatcatctgcacctgatatgtgcttaagctttgtgatggacactgcttttctgaaatattaggtatgccatagtcatatgcctgaggtagtgtaaagcatctgtacactagttaagaaacgggatagagacggtcattagagaaccattttaaataataatactggatctaccaaattttgcacatactgctctcagcaagctcatcccattccttgacaattcaaatgagtttgcgtggattgtaacaaagtcatggtttcacccacaaactgcaagtgtgcaacaaggtcacactcgctcggatatcaaaatatatcccccgaataagcaaatatacatatcacacttaagcttccaattatgaggacccaccatcaaattgatcagggcagtccacccaaagaggattcccatgaggaagaaaaaaaaacccggatgacacatagagcttgggttacatgatacacaaaattatgggtgaagaaggagcggaagagcacatatccttgaccgggagagatgcctagggaattccttccccaattctttccccttgtggcgtgatgcgtcgtggtggatatagcccgcgaccttcatcacaatagttgacattgtggtcatccatcactcacgaccttgctagttgctagtgaggcataaggagagggaggtcaatcatacactttgagagagagcacagtgattatgggcgagttggctaaaatgaagccccagatcccaccacttcctctcatgcagattaattcgcaaccgacttcttaatggttagcttccatccaaccaattcagtgaccatcagcttgattttatccttggggcctatgcctggatggttgaatcgttgaattcttagcttggattttctccacgattgacttctctcatatcaaattgttacatttcactaagcgaaggagtttaaaattcaaatatacggtgttttgtgccattttgtaggaacatattggttttataaatattcgtgtaaatatgtatgaatcgccatgtgacaagcatacataatgaagcatcatattgtgattggctgtaagagtgtaattaagtggctaacttgtgaacccacttgtaagtcaaataaataggtaacccatacccatgccggtatgttgtatgaagagaccaacatattatgacatgcacgcattgcgctgaccaagctcctgattcgcttcacttgattaatttgttgattgatttgattccagtgactcgtttgtattttagatattttcatgaaaaggcggaggttggatggatgcgttatcatgtagcagcgtggcgagagcgtccaggactcgtggtattgctcggctgttcagagaaccacatagtgttgctctgccagggcgatttggaaatattattcgcaaatatttttaaagctgctatattacattactgtaataaattgtgaaaaaataatatattcagcggggc

SEQ ID NO: 9529 - DNA, 5744 bp, Oryza sativa
aaaaaaaaacatatgcaatcttcatggaaactacactatgtttgataaaaaaagagtctgtatatatgtcatttgaaaaaaaaaacacctaaccctaatatccctttaatattcttgtagtgaacacctaaccctaatatcttcttcaattccctcttacctcaatcttgactcccacagccgctttgctcccctccctcacgcacgagcgcacgctccacccgctcggcctcactagctagccaaaaagtgtcggcgaggcctcctggtaacagtgaaatttggtaagcccggagtagtcatcggcttagagtcagcatcggcttcgaagtcctgagattagccaatgagagttgtcaagtcgttagttgtcggattcttgctatattcggttaaggaaattgatctactaaaggaagcttatccagaagagaccgagttcaaagagaatgcggcatggcaagttatctattaattaggaatagtttgttagtttccttttatctttaggaaagcgtgtttagtgtcctataaggactttatctttttcttttatttttaggaaagtttctttcttgtccgacaaggacttgtatcaacccatgggtataaatatgtacacctggggtctatgtaatttatcttcatgatcaatacaattcagcgcatcgccaccttttaccttttctactttattttattgtccggcgggacttggcacctgacgcggggctgcatcggtgttcgatctccggctaaggggtaagtccaatgttccgcctgcccagggaattgtatcgtttacgtcggtgtcgttcaaggctgcatcagtacattcgacctcttggattgctctggtttggatgatatatttgcctacctatttaacatatgtctctattaatctagtcttagcatatcaatttagctctatcggctgcttctcgttttagggtttctgctggtatcggctaaattgcgttgctagattagattagcttagacatctaccaccctgaaaactcagtcaacggcttgattgtctagatattatgtttcttttcatacttagtgctacatcagttaagtttgatgtactaagtcatacttagaaccataatctctagcctgcttcttgattgccaataagggtttcatcgaggtttcagccggtgagttatctggacgttgcatcggctcataaggattgcatatacatataagttggatttggccgatgacaacaaaggtttcactgtttaatctaatcttgtggatttcatgatatcagacctccagccggtgtatgctttaaccttcggatcgatgcttatttatcatatcattatttgccgattggtttatactgtattatattgttattttattatatcatcatcagccgattgcctttatatcattatctacattggacatatagctgattgcttaaaccctatcgctatcggctagtgtcggcatcggctattatcggctatcggctggaactactccatcggcttgtcagccgatcggctgttttgatctactatttgcatatcttatcagttgcaggatcaaactggctggcacgcccgcatctcatcaagatttggatctgcacaagagctaagcagatctcccaagccggtgtgtttgatttttttcgtcaacacctccccagccagcctccttcctgccaccctcccctcttcctcctcgagccgtcggtggcgagatgccctcgctccgctgtcttccttgcctccgacggctcctcgccgccaaatccaccaccacctcctaaccacaagctttctatgcacccgccaccaatgccagtccatcgccctcccccatccccctttcggcttcggtgctgctgctggcgcctcattgcccgtctgttccgccacctaccaccgagccgttgtctcccatgaccatcccactggacctgacgacctccctcttctcccccctccccatcctatccctcccgccctcaccctaacccgggaccctaattcattggccctccatcgcagcttgggttgtcgccagcacgggagaaagagatcgccagaattggagaaaaaagcacattgagcacaaatcacgaagcatatctagtgacctactccctccgtcccaaaaaaaggcaaaccctgggtttccgtgtccaactttgactgtccatcttatatgaattttttttataattcgtattttcattgttgttagataataaagcatgattaatattttatgcgtgacttgtctttttaatttttttcataattttttcaaataagacagacggtcaaacgttggacacggaaatcagggtttgtcttttttttggacggagggagtaaaatttaccagatttggggatgaattttctgacgacataatgttagcaattccttaaaaaaaatcaacttatttttttgtctttcgatccaagtcttttttttcttttgttcttttatgggatccaacatccaagtgttttacggtgttaccttacagcggtacagtacagacagaaatcccactttccggcagacggagatgtccacctcgccgtcgccggcgccgccgcagccgcttgacaacgacgacctcctctcggagatcctcctccgcctcccgccgcagccgtcctccctccctcgcgcctccctcgtctgcacccgctggcgccgcctcctctcctccgccgcttccgcgcccgccaccggcggccaccactcctcggcctcttcaaggaagattcagtataccccatcttcatccccacgctggactcgccggaccgcatcccgcccgcgcgcttctcatggcgggtccccggcggcagcggcgaggactaccaccagctgttcggatgccgccatggccgcgtccttcactacagccggaggcggcgcctactcatggtgtgggatcccctcaccggcgaccgccgcgccgtggatatcccggcgctgttccatcgctgggacatggtcgtctaccatgggtcggtgcgctgcgtcgacggcgacggctgctactccaacccattcgaggtggccgtggtaggaactgacacgagcgggacagtggcgttcatctgcgtttactcatccaagaccggcaattggggaaatgtggtctcagccccgattagtcctggggattacatgtcattttccagtatcctggatggggatttcctctactggttgctgggaaatcatgggtgcccaatccttcagttcaatttggttaaacagacagcaactctggttaacgcgccaccggatttgcgtaccaattcgtatggcggcttccatattgcaccagcagaggatggtggtgggcttgtaatccttgctgtgacacatttcagtctaaatgtatggaagggtaagaccaatcgtgatggtattgctggatgggtgctggagaaaaccattgaattggacaggctcctttctttcggaacaggacctgagacatgggcaccagtgattctgtgctttgcagaggaacatgatgtggtatttttgagcacgcatgttggtttcttcatggtcaatatgcagtcaatgcaattcaagaatattccccaaatcctgaaaggaggcctgtattatcctttctctagcttttatactaaaggtaatttcttcccatgccattttacactgtacgatagcaaaatcatgttgttttctatagctggttatttgtgaatgccttctatttgctcggtgaaaatcattgttccttttaactgcttgatgcctagatgaactgtcctgcatatgacatgctattccaaattttaggtctctgttcagcttgttttgcggtagtactaacgtgtacatactgacatggcttcagtatacatctttttaccataagttgatatcactttgagaatcagcaacaaccgcatgaaaaacttacctgaaccaattgaaatatcaaactagtaactcaattggccttcttagaagcttgaagccagtgcagtatttttacccgatacttttatatgtattgactgtgttgtgtattttctttatgcttcttcatgaagttgtacttttgtcccggagttgctttactttccgattgtctatgtacatttgagtagtattatttgataggtcagttttatttccagatatgtacatactttagaatgactatataacttcttgtaagtgacataatgtgatcacacatgttcttcatttgagttagatgttttatgacgtgcaatctgggggatttggcctttggtggatcatatgactgtttttctaatattgaaggaaatgcagtattttggggtatttggcatggattccagtgattcatcgctcatctagtcacgtttccatttgcatatttgtgtggctaattggcttttgtttgcttattgatggcagaagccgcagaactgttgcccccatgtgatatgtccaagaagcctaaggttccatttgctggtgcgttgcctgatattgaagaatatggttcaaatattggagagattagttgctactaattctggtccaaggcataagaagaagataaatccaaaacaaaccttttatgtgggctctttacaagtggagatcgatccaaactaatggttcggtcatgcttaattgaattaagtacctatcagtagtaacctagccgcattagtttattccttatgcaggtgctagctttgtgtccttttgtgtttgctgtgaacatgtgattcgatgttgtctatctggtgaaggaaaactgaagaatcacttcactttggtataatgtgtcatttgtgataatgctttgcatgtcctttggttgcccaagaggttaatcaaacatatagttggtttgggtgctggtactcgctgcttgtactagggtcaacagatctaacagcccatttggaacgaatgatgcagtaggtatacaagtgcatggcacagagaggattgtgatcattcttggtttctgctagtactagctatagcctagattcatttgtttagattctgaaaaaaaaataggtggtttttattgttccagttcaaattggatcactgaacaccaccatgcttactgtgcctatcagcttacacctagcacaggaattgtgttttacacatttagttagaaatgatttacatatcactgcactgcataaactgaacagagcatgggaactagactttctcgatatagctagctaaacaagcattggaattggaagtgctcattgctcaatactggaaatgacagtactgtctgatggaatttgattcaggttagagtggagtggggagcatattcactagttagttgcttatcgtttctttctcttatctatcagaacaatattgttagtcgcatttctgctgttctggttttcttcgttgccaatgtccaccatcaatagatgagtccaattatgagatacatcctaccacagtcctcaccaccatttgatcattggaccatccacgcccatcttgagtattatgagaacatgagtatatcaatatgcaatggtggttttatccatcctaattatcattaaaatttctaattaatacttagtctaagaaataatttatccgtaacgaagcacgggcattttgctagtaatacatatagttggtctgtttttttaataatacagatggtttttatgctacgatccaggtcgtcgagttttt

SEQ ID NO: 9530 - DNA, 525 bp, Oryza sativa
atacacacaacaaatagaattgacacaaaaaatttcctctttatttgattgcagattaaattagtctatataagaagggggcccgaaggcctcggaagaagaaaagaagaagctatttaaagattggcgggggcctgggggctcactccgatgcacccgggtcgccagcctcgtcgccaccgtcgcccactccgccgtcatcgtcctcctcgtcggagttgagggcgaacgcgagccgaggggccgaaccctcgaagctgtggacgatatggtcggcgacgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccgataggcgctgggcgaggccccctggttggcggcgtacttcgcagt

SEQ ID NO: 9531 - DNA, 649 bp, Oryza sativa
tgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctgggatcgcaggcccgccaagcggttgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcgggtggaagtagcaaccaccaacccccgacggcggcgacaccggctgtacggtgaagaaccaccggacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggg

SEQ ID NO: 9532 - DNA, 2132 bp, Oryza sativa
cgttggtttttgttacaaccacaaataaatccgcaagcccatggaataccgctgaaccacttcaccttcgggtgaccccaaaaggatatcaactcagggaacatgtgtaatctatctaaggctaagactattcaaggacaacaactgacgataggcaggctaggctagagaggtctttctatgggttttaattatctaagctaagcaaaggtaattccctatttgttgcttcaggcaccgacccctgctggtctgctagcgtggttccggctatagctctatgatgtacccgaacatggaggattattaggacggaattcagggttgtcaccacctgccgcctacctctgacaaatccgtgggatacacaacaaacaaaggtaatctctactctagacaccacgcctaagttattaattactactctaatacttgcgtaggaactttcttctctatctggagtcctagtactagagcacttagtatgaatactaaacaatgaacccgcaaagatagaaatatatcttactcagacaaagtaattaaataacataagaaaggagcatgaatgcttactttatataagaagtttctctgaacccgaagcagagtgtactgacagctccggtactcctccagaattcctcctaggaagctacactcgttgaggtagaagtcggatgagtgccaaacttccagacactcctacatagctttctctcactccctaccttattataatgtacaaaagatacaatagagcctcttgtaattcagctcaaagttgtgtgtgttggaatgagagtgagctcctccttttataggctccaaatgacggttaggggtatggggaatgaccaaaacaccatgcaaccgcctctgggaaggaatccaagccatccacgtggaagcagatggcaggaagcggcaggaagggttcagccgaactggtgggttcggccgaacccaaaaacactcctcccggcctctccttcggccgagaggttgtttaatgggtctccaacaacctaggctaagttttggcccaattctaaatggtttttattgacttattgggcctctaatccgtgtaaacgcgtcctgaatgcgcggaggtgcattttgccacatgacggatgtgttttctcctcaaattacctgcatacacatatttcaccaacactagtggaaatgattagtaataatccctaccactaagtttgataccatgttttatttcattatatgcaggtattgacggtcagatattatgatttaaggaccgtcaacacatgctcaacaaagccaaggtcgacctctagcatttcaaaaagctcctccgccgagattcatgtcccaagcgtttctgtcttgttgagctcctccatcctaccatctcatcgagctcctccatcatcgccgcctggttgttgagctctagatccaatccttctcctcgtacagctccttcatcgccaccaccttgcgagcacagcatccacctccacctccaccaagcagctcttccatctccacatcgttggtggcaatatgagaaaatggtggctcttcatcctccatgcattggtgaggtcaaggtcgagctccgcctcctcaccacctctgatcagagcacctcctccatgcacaggccaactggcgagctcaagctccgcctcttccccccgcctctagctatagctcttccaccgcctccattgaactcatgctccccaacctcgccgccctggtcttggagatgggtcgcatgagcaggagaagtagtggtgttcacggaggcgcgacacagagtcctgacggcatctggcctctcccctttaaccgtggttgctgtttggatctctttatgagatgattctaacgggggcgagtcggcgatccttgggggagctcggcggcggtgctccatagtgaggtagcgactactctcgaggaggagctcggcagtgacactccacatggaggactcagtggcggtgctcctgtgtgttgccgtcgcgagaagggagaagaaagatcgatagagaatggaagaaagaggataagaccttgactgacagatgggccctagagttttttaaatattatcttttctgaatgaactgccatgt

SEQ ID NO: 9533 - DNA, 699 bp, Oryza sativa
tccattatgtctcaggtcatgaattgacttagctacaaatgtaacattaatgcatagctaaatgtaaatcacacatgcactcatgcacgcataccacataacagtcaataggaaccggctcatcactgccagttcacacatttttcccacccaaataatggttaattgatatgaatgtgatattgatactccttatcagtgccagctcgtggcatgcaccggcacagtttttggacagacagtgatatatcatggtatcgctgttggttgccaggtgttcagaaactagcacaggtagccattgtgaaccggcaccaatggcctatccagtggtagtgacagacacacagtaacacatactccctccgtcccatattataacaatgaatttacacatgcttcctgtttagattagttgtactataaagtgcatccggtcctaggttgttatattatgagacgtagggagtatatacctacacacacaaatattctactgttatatacttctgctagatgatttgaaattttatatatttccaataaggaatggtactgtacaccagtaataccagtagattgagatataattgaagtgcgcataaaaatttaatgatgatgttattcccttggccctcctatatatttcgctcaataacttgtgaataaatagtcaaacaaattattatattggcagta

SEQ ID NO: 9534 - DNA, 1029 bp, Oryza sativa
caaataactatttgccacccctatctcaatgacatgtgggtccacatgtgtctatggtatgtgggtccagtggtaaaaagttaattgccatatttaaatgtggcaaatggttaaatatctcgtttgttggcacgttgtcaagttagagaacaaaacgaggagctgcacaatacaacagtgttggcattgcatcgaatatacttcactggtactgtacaaaaatttgttttttccccaagtgacaaaccctaaccctcataatcgggtgacattaacagaagcaagcatataaattagaatcatatcttccaaattcagtaccttttcttgcaaagaaaatcaaatcggttgcaaacaagaagagagggcatgcatgcatgcatgaagaacagaatctggaggccggccttgcctgatgactgtaaatcagggttttaaatctcccgctatagctgtttgagaagggttctagctatttgctctcatatacaatttagccgctatagctccatttagcccgctatagctgccgctatagctgtttgagaagctaaccgctaaatactttagcccgctatttaaaacattgctgtaaatcgatagtggtcgaaaccacgtggagcagccgagagaggagtagaacaggatcgccggggtacgcagccgcccgccggcgaggctagcgcacggcgtcggaaatatcgctccggcgaagcagggcgtcggaatcgggacggccgcggccgggaaggggatgatggatcgggagcgagcggtgaaccaccatgaggaggaggaggaggaggaggagagaagatgaaaaggaaaaggaaaatattggaggggacaacaaagctgtgggctgccgtatgtgggccgtacgaggaaacaaggctggtaggcccagtatttaggtagagcactggagcctgggtttaattgggccattcactgagaagctgcctgcggagaaagtccatactatatcccagaaaaacatgggttcggtttgatacggggctgcaggaa

SEQ ID NO: 9535 - DNA, 2128 bp, Oryza sativa
aaccgctcgctcctaccgaatttggtgctagcctcgtggagcatggcaccaggacaaaaaggtccttaattttggactcgtttgcgacaacaacgagtggctcatgcttgatcaatgctcatagttatgtgcactgccgtatagaggctaaaccactggagacggactgccatggccccctccttgcgggttgccgaccactactatcgccttccttggcagtcaccagtcaccaccaacacaagcttctcgtcaagacttaggagaatcgcataaactaggaaaggagagaaaaagggtagagattgaagatgacatgtgggacccaccatactttcaaggtgtttcttctaattagagacttggtgtgtcacatagtcgtcaggtcagatgaagaccgtgtcaatgtgccacgttaaaaccaaaactgctatcaatattaccgaggaattcattttgcgctgatttttaagagttggagatgctctctaactggttttgcggtcgagagatgcgaatggaactcgacctgtccttgagggacctgaagtgaactttctgcgctgcctgtcgatggttgtggttgtgggctgttagtccatatgaaaattgatccgacagacagaaaaccccaaaaaatgagtgaggcggagatgacaagccgccgccggcgtcccacctcgccggcgccggcgcagccgctggaagacgacgaccttctctccgagatcctcctccgcctcccgccgctgccgtcctccctcccccgcgcctccgtcgtctgcagccgctggcgcctcatcgtctccgaccccggcttcctccgccgcttccaatcccgccaccggaagcatcccctcctcggcttcttcaaggccgggttcaggagagtagaccccaccttcatccccacgctggacccgccggaccgcatccccgccgcgcgcttctcctggcggctccccggcggcgacgatgaccgctactccatgttcggatgccgccatggcctcgtccttctcttcaactgggttcttcaccggctcatggtatgggaccccgtcaccggcgaccggcgcgccgtggacattcctggctcgttcctcgacggccatggcaggagtctcgtggtcgtcttccggggggcggtgcgttgcgtcgtcgacggaggctgccactttgaggtagccatactaggcaatcacccactgcaaacacggctcttcacctgcgtttactcatccaagaccggcgattggggcaatgtcatctcaaccgagttttattcagcgggttacatctgtcatcattctagtgcactggttgggaattctgtttactggttgttccagggtgatggaatctccatccttcagttcgatttcgatacgcagggactagcccggatcgatgtgccaccggatgtgcatgcccatgtggttacctactaccagattcggatcatgccagcagaggatggtgggcttctcctccttgttctgccagaatttagcctcaatgtgtggaagtatcaaggccaattgtgatgggtgttgctggatggatgctggaaaaaacaattgaactggacaggcttctttccgtcgaaccagggcgtcatggagctgcaccaactattctgggctttgtggaggaacataatgaagtattgctgtgcacagatattggtgccttcatggtcaatctgcactcaatgcaattcaagaagctttcccaaaccatggaaccaggattttatcatccattcactagtttttatactaaggtaataccttgccaacgcttttacgctggtagttggtcctttgtgaatggctattatttgttatgtgacaattattgttcctttaaatgcttgatgaactgtcctacatagtatggcatgcatttctgatattagtcttcaattatgcagtttgcatcaggggtatattcatgtgttagctcgtttggttaatttattctatgaacgttcaccataccatgattactcagatttacatattactttgaaaattggcgacaaacacatgcaaaactacctgaaccaattgaaatattctcttgctgactgtttgtgtgcatgtttgactaggggctgcaggaa

SEQ ID NO: 9536 - DNA, 5231 bp, Oryza sativa
cctgcagcccatatattataaattatttttttttcatattggtagggatacaccaaggtactattaatttttagtaagcatgtcttgttctcacccagagaacaaacgaatgtgtaaattattagatgttgatctagtccgaaagtgattgatcgatagtctcggtttattcaaatggtctcaatgtaaacacacggaaatttagcccacaaaaagatttaaagatacgtatattctaggacaagtacgcacgtacgtacgctgactgagcttatatacgtgtgtacgtacatggaaaattgttctaaactcttaagatatgtcctcccatcttttacatgccgttcgtctaaatagttgcaaaaaaaacttttaaaaaattacaagataattagtactccttccgtctcataaaaaatcaatctagtactggatatgacacatcttattgaatgtgtcacattaaatcttatatttacttttttagggacggagagaatatatagtaatatcactctgcatgtttaaatatgacttgtaacaaaaacaaatatatatgtggatatactcataggtttgttttttttcacaactcatagaaaggcatatttaaaactgtatatttctcatattaaaataatatgtttttaactatttagatggtatatgagagacggtgaaatatcgtcgagagttttagaatcctctcccgcgtgtacgccagaatagtaaatttacgtcgttgttgatggatggctacagctaattttttactattcaactacagctatcaacttttaattggtctccatgatttcctcctaattaaatacattcttctccaatgattcagctataaaaccttaccaaatccacaaagttaatcaccatatttaggtggataaatctcatcagatcgagctaagcttggaggcaagcacaaatggagctcacatggcttctactcctcgctactctcctcctctccaccactctcctcgtcttcctcttccatggcggtagcagcgccaccggcggcgagaagcgccgccgcctgccgccggggccggccaccgtgccggtgctcggcaacctgctgtgggcgaccaactccgggatggacatcatgcgcgccgtgcgccgcctccacgcgcgccatggcccgatgctcggcctccgcatgggctcccggctcgaggtcatcgtggcggaccggcggctcgcccacgccgcgctcgtcgagagcggcgccgccatggccgaccgcccggagttcgcgtcgcgcgcgctcctcggcctcgacaccgccaccatctccaactccagctacggcccgctctggcgcctcttccgccgcaacttcgtcgccgaggtcgcgcacccggctcgcctccggcagttcgcgccggcgagggcggcggtgctcgaagagctcacggacaagctgcgtcgccggcaggaggacgccggcgcgggcaccatcctggagacgttccagtacgcgatgttcttcctcctcgtggccatgtgcttcggcgagctgctcgacgagcgcgccgtgcgcgacatcgccgccgcgcagcgcgacctgctgctccactcctccaagaagctcagggtcttcgccttcctcccggccatcacgacgcgcctcttcgccggccggatgaaggccatgatcgccatgcgccagcggctgaaggggatgttcatgccgctgatcgacgcgcgcagggcgcgcaagaacctggtcgacgaccatggcgacgccacggcgccaccaccgccggcggcgagcgccacgacgttgccgcactcgtacgtcgacacgctgctcaacctcaggatcaacgacaacggcggcgagcgcgcgctcaccgacgacgagatggtggcgctctgctccgagttcctcaacggcggcacggacaccacctcgacggcgctggagtggatcatggcggagctggtcaagaacccaaccatccaggacaagctccacggcgagatcaagggcgccatcacctccaactccggcaaggtgtcggaggaggacgtgcagaagatgccgtacctgaaggcggtggtcatggagggtctacggcgacacccgccggggcacttcgtgctcccgcacgcgccggcggaggacatggagctcggcgggtacacgatccccaagggcacactggtgaacttcacggtggccgacatgggcatggacggggcggcgtgggacaggccgagggagttcctgccggagaggttcatggccggcggcgacggcgagggggtggacatcaccgggacgagggagatcaggatgatgccgttcggcgccgggcggaggatctgcccggggctgggcgtggcgacgctgcacctggagtacttcgtggcgaacatggtggcggcgttcgagtggcgggcggcggagggggaggcggtggacgtcgacggcgagaagctcgagttcaccgtcgtcatggagaagcctctccgggcgcgcctcctgccaagagccgtcactgtttgactctgggtgagctttgacatttgggggggtttattagacatttgacactctctcgctaatgtagtttcatgctttgtaataatggtattattattagtttccttttgatgaataaaagaattccaatctattttgtcatagcacttgacttactataaaccatcatttgactcgttctatcccatgacaactttatgtattggtaaactctaatttgtgtgtgcgcttattagtcttgttgcgtgacgggtttcaatgtcgtctaatcagacgaggtgacgtgtagacataatgacttctattatacgatcattgcttattagttactctctccatcccaaaatataagaacctagcaccggacgtaacatttactactacaatggtaaatgtcatgtttgttcctaggttcttatattttgggacggagggagtactctctttatccataaatataagaaattttgattggatgtaatgcattttagaaccatgaatctagatagagggtttgtagaactagaatacgtcatatattcactcaaagtcacttatattttgggccttatattttgggacgaagggttagtttagtttgaaagattcttaacctatctagacgcctctgaaacattatggaaaattacaaaaccaacccttaagtcacttaaagtttgatattctatttcataagttattttgttataaatatccactcacctactcagtatttttgaaaaatcatcgcaatacgcacgtgcttaacttaatcaatatgttttcataaagtatattcttgatatatatttttttaaagatttcacaaatagaattgttgatgagagattaaatgttgtcacagtgagtttagctatatatgtgctcaaaaaagttcaatcaaacattttaatgcaagaaaagaaagaaaagagaagagatgagagaagaaaaagaaagaaagaagatatgtgggtccgataatttttttcttttcatttacatgtgggtcctatcatttttttattttatattttgctgactaggataccacgttagcgaaacgagagatccataccgtcatagaaccgaaattgcatggttttgtataatttaggagtgaagatttctggtattggagattagcgatgtcatacaaattgacgtaaagttgaaggacggctggtgaacttattccttatcattactcctaaacctacctagttgcaaaggcccatccaccaacatgtcttctgcgcttgtcgatcgtgaacggattagttatccgtttccgctgacgtgaaaatttaaaatttgtcttttgctttgacttattaggtcaaccgttgggctcctagttgcgctcgtccagcatggctaggctacgttgtttggttgcatccccgacccaagactgacatccagttccagtcatcttccaaagcgccggtggccggtgcgagaaaggagctcagtagcaggcacggcaatgggaagatgatgtcctagttgctgtgttcttcccaatctccattccgttattgcttatgtttctactccctccgtctctaaatatttgatgccgttaactttttatttaaacatgtttgaccgtttatcttattcaaaaacttctgtgaaatatataaaactttatgtatatataaaagaatatttaacaataaattaaatgataggaaaagaattagtaattatttaaattttttgaatagaacgaacggtcaaacgtatttaaaaaagtcaatagcgtcaaatatttagcgacaaagtactagattttaggaacagctaagcatagttggatctgtagggattcgttcattatataacaactatttatgctttccgtaggagtatgggagtgccgtttacgaaaaaaaatatagaagtaacatttaaattttctattggacaagtttccagaaatttcaggattgagatagaaaataaagataatgctggctaattcatgtattgcagaacaagaaacagccgggtgtgcattatgaccattatactaactagcaaaatgcccgtgcttcgctacggataaattatttcttagactaagtattaattagaaattttaatgataattagaatggataaaaccaccattgcatattgatatactcatgttctcataatactcaagatggacgtggatgatccgacgatcaaatggtggtgaggactgtggtaggatgtatctcataattggactcatctattgatggtggacattggcaacgaagaaaaccagaacagcagaaatacgactgacaatattgttctgatagatagagaaagaaacgacaacggcgacctccggtctgatctgggttgctcatttttttccggtccaatctggtttttcttctaataatacacatggtttttgccgagttttttttggcccggtctgattttttaataatacacacaggtcgcttattttttttcgtctaatctggtttttgcccgtatgttgtaacgggtgaaggctattttaattatattattgttatgctagaaaaatgcacatgcttcgttacgggtaaaggaacagttaaatgctataaagtctagagttaacatgtatatagtaatgtttcaagatagataaactatttattaggctaatgataatcacgccggataaaaacagggctgcagg

SEQ ID NO: 9537 - DNA, 708 bp, Oryza sativa
ttgaaacaactggtgtcccacaccagacagttgacggcgccaacaacggtggcactcgtcatgaaatcaaagttgcagctgcagcctctgaggagtataccttgctctactcctttgtctaggagctccagactcacacgcatatgtggtctacgttgcagtcatccagacagaagtagggtaagtcgttaacgcaatagtgatgtggaacttcattgattggcagtcacaatcatcggttccggcatgttctgggctattgcagctgccgatcatggcggtgtggtaactgtcatcattggtgaagtaacttccgggcatggggattacgtcctggcggtggtgagaaaatccgaaaccagagatctccccttccaaccaattaatggtttgcatcgacaggtcaataaaatgcctttacacattaagtgaaaactgagatttcttttacagaagaagctgaagtcacacatatgtcaaatcaatgcatattaatttgtgtcttgatgctgaaaccatttgtgtcctcttccctaccacccacccagtggacggctcaagcgacgatggtgctcggcatgaaaccaaagtcgcagctgcatttcatgtactttatctcccaccactccttcatctacgagctccagactcacatgctgatgtggtataagttgcactcgtccaagtagaagcaaggtatgttgcgaa

SEQ ID NO: 9538 - DNA, 1094 bp, Oryza sativa
agctccagactcacgtgctgatgcggtataagttccacttgtccgggtagaagcatggtaagttgcgaatgtgttgatgtaaaaacacgaggcctgggagatctgcttaactccagtgcaggtccaaaagcttgcctttaggtgtatgagcgtgctagttgatttgatcctgcaatcaacaagaaacaaagacaaagaaaccgcggttaaatccataaacgacagccgattggctagttgccgatgacatatcatttatctctgagccgatgtcatctatagatcgatcggcaatcgtgaataagtaagaaagaactaaatctactcgatcggctgtagatattaacaatatataatccttatgtcgatatatacttaaatcaagtgattgggatagatcggtcgccatgccgagatagtataaatcacttagatcgaaatatatattaacaacaagactatatatgttcatagcatagccggttagatagatctagcatgtatcggctaatactccgataccactctatattaagatattaaagcaaatagaatatactaaacagaagcataatatacttaaatgcaacaagatcttaatataaagggcagatttaacatgtcaatcaagcatatagaataactatagttaaatcaggtaagatcggctgaaaccccgatgctaccctaatcaggaatcaaagacaggctagagattgagattctaatcacgactcataagatcaaacaactgatgcagctataagtatgaaaagaaggacaatatctagacaatcaagccgttggatgtttcatagagtggtggatatcgtatataatctaagcagcgttgatatttaacctaatcgactgccctctactgatagatgttagccgattgtaggttagatagcaatattgccagagattatataaaatatatgataactcgacgaattacataaataagattagagtatcataaagatggaagcactaatcccgaaaacacaagccgtcataacaagtttacctcttgttgaagatcgaaaccgatgcagctcaacccgaaagcaagaactcgtcgaaacaaa

SEQ ID NO: 9539 - DNA, 594 bp, Oryza sativa
cagtggtttggtgggaacgcaaacctcgccgacgatgctctggagcgcgcactgggcgccgccatcgggacatcgtcttcgttgccgtcgaaccggagcaagccgagccgagccaccgcaccatcaacatctcctcggtgtcctctcttaaatccctcatgaacccctgccagtggtgcagcgagcttggagatcggcatcgtcttccccaattccggccgtcaagctccacctcgatttctccctctccggtgagtcacagttcaattcctcgggcataaagctttcctgagacctattcaacaccgtgtgtatgcatgcatggtagatcatcagccatatcaagccggcgtcgtcatcgagcgaggctccctgccgtcgccgagtcgttctgctcgtggtcatcgctatctggacctcgccaagtttcattggacgctcggtaagcatcctaggatcccatagaggcacatgcatcaatgctctagctccacatgcaccgtcacccgagaaccaccgccgctcgcgccgccgtcgccattaattccgatgaccaatgcttgcaaaaataccacctatagcctcgccttgaac

SEQ ID NO: 9540 - DNA, 3228 bp, Oryza sativa
ttcgcggcgccctatcgtgagtaaaggtgttattatttatagtcatatgaagtaagcattgaaatataaagcaatagaatgataggaaaagcacattatcactatgctatgaacagttcaaacgaacagaacaaatcattacgcatagagatatgtaactaatctagcacatttgcaaagcatatcataagtagtatagcgattaatacattaagtgatgctccaaagcagtagttagatagcatagcatggtacataggaagccatccatgtggactattccctccgtcctattatattacaacttaggatgggattaggcccattttaggactacgaatatggacaatatcatggttatgtccaatttcatagttctaggacccatcctaggttgtaatatattgggacggaggagtaacacatatcgaaaataatcgaggcaatgagaatctattatgtttatttagatggcgtcgtattgcagtttatctttatcctccttcaacatgtccacggtcggttccctcagaatcaatggttccttgtacccattgaaagtccatggtcagttccctcaaaatcaatggttgcttgcacccattgaaagcttttgatggttggctttcttggcactacaataagtacaataagtacataggaaacgaaacatgtaacaatatcatggcatcgaaaatagtatatcagtgagcaccatgtgtagctaaaccaacaaaaatacctacacgaaaatcaaacaaattgaaaaagttttaggagcacgcataaggcaaaaatattcctttccatttcctctttagaatcaatcttcatagtcagcagaactgcatccctttgatcatcatctatcacctgagacagtttaaaagaagaattttatataaattacaacacatttagctaaatgagttgcctgtgactatgggagttaccacagtagattattcactgaaatgagtctctggagatttaaatgaattcttactttgactttagatttttcagcatgtgcttggataaggacaatcttcaataacaacacataaatcagttagaagaagttctatagcacatcagcacctcactatttcgaattgtaggtgtttcggttcatggcaagaggattttatgccactattttagctgacatgggacagtctcaatgggatgtgaacatggaggatatagctgctagcaaccatgagatacaatatatggacagtccctaaagcttgcatgtctgctctcgttgtaacaataagtcatttacagtgagcgtctaaacatatggtccttttaccagtgtagaactctttacggtagagatgtactttaataatcgtcataaacaaaatcagaatgtcaggaaacacaaagaacataaaaattgaaatatttcacattttctcaaataaaaaaaaatgctaagatgcaaatgtcacgtcaaagacattcttatccaatagttcggcgtgaggcatagctaattccaaaccaaaccaaaccaaatctagaacctcgggtactgttacaaacaaattcagtatgtaattgctagggaatctaccttgatgctgaggggaaaaacaaaacatacgcacaaacaagaaggaatgaaaataatctctctttttacagaacagcacaaggcatatatcacattgtcagggattacatcttataccgtcataaatacaacaatctttagttaacaaaaaaatcagtactccttataatgatgcagaaataaagcgaaagaactcacatgtctgtgattgtgactcggtgtggcattgtcatgctcgttgagcaatcagtgcctgttgtatacattgaggtgtgagcagttcggggcaacacggttgggcagcggctgcaaccatggcctgaggcccgagcgatggattcaagggagatcatattgtaaggaggaggccaagcatgcagatagctgcgccacagcgctggcacaaatagacttcaataccagcaggatgaatgagctacttgtacttccggtcgcaaaataaggtcaattgggtctgcatctgagtgctcgatgaatcgctgcagtgactcattcctccaggttgcaagatcgattccttctagtgtgctcgtatcagttgaaccaccaaattattagtagagtgaatcgaagccatcaaacctggataggcaaaccagggagaggagtgcgtaccggcagtggctaggcctggagtagtctacaccagggtagttagtatccgccgtagcaacaagatcccacacatcgcatcggaggaggccagcgagcgagctggtgaagccggtggagcgacgcggagcgcgtgccagaggacggagtcgaagacgccatcggaaaggagtgcgccgagggcgtcgtcgccgcccacacaaggttcgacgcgagggtgcgatctagcctcgccccgagccgtgtgttgccgtcgtcgagcgccgcatggtccctcaacagggacgccgccgcggcgtccgtggcgtcgagcgcagcctggaggtggttcaccacggcatcgaacgaccgtagcagcgcctgggcgaaggaggacgcgcaaaggagtctgtggggaggagggcgaaggacggctggcagcgtcgctgaggaggaggaggaggcggcttcggtgcggctagggtttttggaacgcagagcgcaatggacggaggaaaacgcccgacgggtctgatgaacgagcgagcggtgaaacggcgaacctgccagcgcaccgtcccttggttgggccccaccctgacagcccatttagagatacccaagcccgcagcagcttcagcacaagcgccggaggcgctcccctagcgcgggaaacggcaggaaccgggcccacagccgcatcagcctcgcgcgcgcggagggagcgggacgatgtggatatcagcagaagcgagcacgtcggcccgaaaaggtccggagcgctgtggggaggcgaactcgccctcatctttaatttacaccgataaatagtactccactatattgtgttctccaatctccaatttcttactagttatttccaaacaggtaaaactaccctcataattaattatcaaagtcatacagaaaaactcatttagttttatttttgtttggtgtatgtgctctttatatgatacttcaaatttcacttactcaatgccatgcttcagaccaatattagaggt

SEQ ID NO: 9541 - DNA, 2373 bp, Oryza sativa
ttactttgtaaagggcataatatgtaaaatgcaaaacccccctttttaattagagtaaagtgcttcttactttgtaattcaggtagcatccatcaacaacaacagaacttgaaatcatgcagttcaataaatttttgaacccgactgcttatttgcttagccaaatcacggttattggcttcaccacctctacaacaattgccacctagcagaacatatagaggattaatagcccgattagattatttcaacttgcaagcatagatacatatgacctttatgttcacttaatactcaaaattcatcataataattattcgtgtacaaaattatggcatccattgaaaaaggttttgttttgttcgatttacattttcttaggaaaatttagacagcacctatgttattttttatagtggaagaacacacatttttttcttttccccgctatacaacacacaggtcgagcatcacgatcttgcgcatgtccctgatggatgcgccatgggtgtagttgcgcagcgtccagagctagaggacatacccggacatggcggtaaggctgacgccgccgtttttgggatgacgatgctcaggttggcctcgggaacatcgtcgaaggcatgagcgggcaccaggatctagtgcagctcgtgtatcttgagtttgaaggcgatgatgctgtgggagatgaggtgctaatagaggatttaagctaagtaccgtgagctgtttttcttattaacatggtgaatctccccaaatatagaaaaaacaaatatgataaaatttgacactaacgggaatttttagggtaagtaccgtgtgcagttttttttaataacacaaagtgataattttctgctgaaaaactaatatgggtccttattagtagtaaagaacatactcccaagcttattatttccaaaagaaactcatgtggaggcacttttgtagaggtcccctcaaaaaatcaggagtttcaaagtgtagagacacattttagagacattttaaaaatgcctaacacttttactctagggaaactttagagacatttttccgacgggaggcggagcaggatgctccgcaaggcgtcgttgggcaggtcagccagctgcagcttcttctcctgctgctgctgctgctgctccttctcgccgtcaacaacatcgacagaacaacattgatctcggccatggtgatcaggggctagctcagatgacaacgaactcgatccgacgagtgatagttgctggaaagcgatcgagtttggtgagggtgaagtgaagagcacagagatggatataaatcaagaggacgagagtgatgggtgccgtgacgcgcgccatggcgagagagagacgcgagacagtctgacgccgaaagcactagcattcgtcctggccgtgggtgacgaggacggcaaggctgctagcgccatgccatgcgatgacgcagcaattgtgcgtttatctatctatttcacttttttccaatccttttctcaactgctcaagtgttcttacattacatgtgactgacttggctgtatatggagaattggggatacggaaatgtgcatggttctatcaaccggtagaagaacgttctagaaatttttagtttctgctaatctacgtgcccgaggtgattttagtttcagctagatatatacggtggtaatatcctgccattttgtatgggcataattaggcaaaattttatataggatactcgaatttttgtaatttggtagtggacatcgcaaatacttgtaatttgtcggaagatactacaaccattattttattatttctagtccaattagagagatatttttaaaaaaaaacaagaatgcctctccggccacaggtttgtaacctaggactgagtaaagaagaaatacaatatgtggtagtaatgtacttggtttacggcagattgagagttgcaaaataaacattttaattttttttttgaaaatttaaaaaagttatgagatatactcatggccgccgacctaaggttttggaggggatcggatcgagtagagatggcatggtatattcaaacaaaccaagctgagtaacctgtgcttcctcaagggcaaattcatcttttcaacgtagtttctctctttagttggatcaggaataataaaataatggttacgacatcctccaataaaagtaacagcattctgaagatatccttcagccgtggcacctttttcaatacccaccagcaaattatatcctgtaataacatttgctatataataacggtatgagatcgagtaattgaacgacggactgctggaaagggatatctgtttggatgcttattagcattgttaggtgataagctaag

SEQ ID NO: 9542 - DNA, 3134 bp, Oryza sativa
aacaaatgactcaacaaggcttacatgtactcaatatcagaaggtcttgtttaacgaatagacagtacttagttaattgaaacatatggattcaagaaactttatgatccaaaagaaataattccttcaattcatggactaagaatggctcaaagttccatttctccaattgattgctttttttggttgatttctttacagtttattctattcttcccctcgtatctatgcagaactctcttattaaaatatattaatcagagggattttggtgctgaacaaactggattgagcaattgagctggctattgagaatttgagatattgactaatattaaaatactctgtaaacaagcttaatagtcaatattgatgtatagctaggttgtgcattagaacagtaactggaaggtaaaagtgacttagaaaccaccacgaaaagctctattccatttctattgaatatgttttattttttttacatattgtcctaactttgactaaacaattttattctgctctgtttaaagtaatatgcagggggtttgtttggtgcccttcaagctttcagaggatggcattgagctgcatattgcaacgaatcacgttggtatgctccactcttccagtccttaaaatgcaaactaaaacatttgattgcaggcaggttttgctaaaaccctaaaccctaaaacctaaaaccttttttttatgtcaatacagaaagaaacaaggttagcaccaaagaagcatcgtactcgaaaaactgcaattgaataagctaataacgaaattttaatagaagggaagcagatcaaatcaattttcaatttagaaatattgctcattggaactcacaaatcagcaacacatcagcctttcaaagttctcattatccaagatctagcaggtaagagatccacaaatcaaaatcaaaatatagcttaccttcatcaggtatagtttcacatgagggtgcggcagcattgccttctactgttcctgctcccttcggaggatctgctgagttgctgtcatcctcatcaaatcccataatttcggagatggtaccaactcttctctcggctcttggcaaatcacccactagatgaggagtgatgttagattggggagaagggatataaaattataaatagcaggagatgattggctccttataaaattacttgttagttcattttatgggttataaagtcattacatccccaatggccatactactttggacagagtcatagaagccagcaggaactaaaaaaacagtcatgactagatataattaaacatctaaaacttttacggacggataaacacaaaaatactgctacatccatccaagctactcataccctgtttcctgacacatatggaactctcaataacgttgacttctgttttgaaagaaagggacgtgatccctctccaatttctattactagaaatgaagattagacacacagcatccacaacctcaaaagcaaagcaacctaactatcagccttttagttctgccaatggtgccagaaactctaaataactgtgaccatgtaggatgtggattgtggaaaacgatagaaagaatactgatatcaaagaagaaaaaaccaaaagaaagggccatgttttgcacattaaaagggttcaagccagttcaatccttctgacccattaacattgtaactctatttatttgcatgatcggcaaaactttttaactctttcctttatctcatttcttgcagcagtgttattaaatccataaagaaatactagatgatttgccgatggataaagataaacgttatcttagaaattaaagccattactaaatgaaagattatcatgcaaacaacagcaagaataattagattgttcttgtttccctgtagtgtaaagacagggagttacctgcggtgcagaaagcactgtatgcatgaaggatgccgtcgaagttgtcttttccaagattcttgaactgcattgactcaaggtggatcatgaagacaccattgatcgtccttacaaaaataagctgatagtcttcatcatatgccactattaaattttgccatccccccatatggccgagccctaggatcacgcccaattcaatcttcttcagcatcgtccattcggcgacaccgacaccatcagagctgatcttcctctcccacaattccatgatctggtatgacagaatggcaaggcaaataccaccatcctctgccggcataatctggaagctgcgatgcgaattataatgcagaaattcagatggcatctcgattgtagctagactctgcctacccagatcaaactccagtatgccctcctcctcgccactgaacaaccagtagagcgaatatccaatgagggtgctgggcaagcatgtatcatacacaggaggacactctaatgtgatgagatcgccccatacgtcggcctgcgacgagtagagcgaagcgtagacgggtttgtagtcggtgtggatgcctatcaagacgacctggaagggctggagtggcagtcgccatggacgtggccttagccggaggcggcggggcagatcacggcgccgttgaagacgatcttctccttgtcgtcgccgagctccggcggggcggccgcgcagctgcggtggccggtggcagggtcccacacggtgatctcgttccgcgtccggttgtagacgaggacgcggccatggcggcagccgaggacgtcccagttgcatcgcccggcgcccttgtcgcgcggcatgaggaagtgctcgggcgggatgcggtcgggggcgtcgtggatggagcggaagactgggtagccgcagtggtcggcgaagaagccgaggaggaggggctcgccgtggtgggcgcggtagcggcggaggaaggccgggtcggagacgacgcggcgccactgcttgcagacgagggaggcgcgcgggagggaggacggcgaggtcgggaggcggacgaggatctcgcgcaggatgtcgtccccgtccagcgccgacgtcggcgacggcgcggcgcggcggcggcggcgtcggcggcgagccatcggatgatgtgggagcctagtgggagtggataggtctggggggggggggggga

SEQ ID NO: 9543 - DNA, 5720 bp, Oryza sativa
  unsure (1)..(5720): unsure at all n locations
ggggggagggggtttcactgtgttttattttcccaaaaaaaaaatattttctttctttttgagaggaaaaaaaatattttccgaaaaaaaattaccgttcgcgcgcgcggggtcagtctgtcgtgtggattaggaaagcgcgggagaaacgtccgttgcgcgcgggctttttgtttgtttggcccatttggcttgtgggccttctcttcacacggcttgttaggctgtttggtttggaagcaaaatttaacctactttggtatacctctgtgtttaaatatagagtaattttttttatcaaaatatcctataaaattatagatttaaggtattttctcataaaactataaatttaacaccaaatttatcaaaaaactatagatttgtgactaagtatcacaaaactacatactatatatttaatattgaagttatcacaaaattacagattttagagtttataaatccttagcagtactgcttatgttgaaactttaatattgtacttttatggttaaattgtgactaatgttttgtgataaatttggtactaaaaatatatttttgtgatactacatcttaaacatttagctttgggataaatttatttgctaaatttgtagctttgggatacactgatttaaatctatagttttgcgatagtttgatatagttatatgtggttgtgtaaaatttaatctcaaatatatttttattactaattttctattgcaatatagtgatactctatctaacacaattataatattgtaaaattacatgtaaactatactttttttttttgcaaaatttgctctagtacctaagtttgtgacattttgacatttggtataagagtctctaaggctatgttatttggagtagttggaacccttctccctgctaacaaaacggcatggcagcaacgcatgattaatttaagtattagcttaaaaactttaaaaatagactaatattatttttttaaagcagctttcctatataaaatattaaataattgcagcgtttaatagtttaagaagcatgcgtgaaaaaaagggagtaaaagttgggaaaagaaaacaagcgagcagaagtacggagaatgcagtacagaacacaccataattttgtgactttgttataacacactctagatagagttatatgataattttctaaaaaaaacactgtcaattatttaaagagaaaatcaaacaaattccattggcaagcccctaattccaaggaataccatcggtaagtgcgagttacatgaaatgtcatcgtacacctgactttgtcccataaataccatcgctgttagagcacttaacggaggatgctaacaaaaccttaagggtaatggtatttttgagacaaatttgtttgtgggatgacatttcatggaactcgtacttatcgatgatattttttaaaaaaattgcgtacttcttgtcaatggcatttcttatatttttattttgatatactcggttacaatggagagattaaactttacaaaagaccattttaaccttgagagactttgcaagattgaaatgtgtagctaaatttagctatatttttcaagaatgaacctgtcctaagctgtggaaatgagaattgctaaaatattgtttttttcccaaaaagttgaacaaatattttttaaaaaatatatttaaattgaatctaattgtatttttcaaaattcaaaactcgtcctaaaccatggaaatgataattgccaaaatattttaaaaaattacataattatagccctgggaggctatgattagagaaaaagaaaagcacaacaccacacgtggcaactcctgtatacaaactcgagaatataattaacaccagccggccggtcaccgctgcctatatatgcatgaccggtatccgccaacccttcaaaaggagaacaaacacattgccctgctcttctccaaacacatttccaagcactattgcaaaataaattgattgacggggagaaagctgtcaaacattgcaaccccatttcatctcaccatccgatctctgccaacatgtgtagcccgatgcatgcccatccatcatcccgccaccacctgactggctgactccaagactaaatacagtggccttctgctccacaaccgccaccacgtcgacacctctttaccagcacctcacctctgcacaccgtcatctcgcaaacgacccaccatagccttgttgatgtaccagtcaccagggctagatcggacccctaagcatctacacttgtcatggatctcctcggagaagtaggggaccgaatagagtggactcgaccgtcgtcgccattcgcaccgtccacgtgtcatttgggcctttgtgtgtgccttgacctcgttggccatttgtcggagcatgctactgtccgggagcagatgtccctagccactccctcgctacatcccgacgtcccgccatccatgcctcgttgcagcccagtactgtccgtctactagccaccaaccgctcgagccagctaccatcgctgttgcttgccagttcggtgtgctggttcggactcctctacccccgtcgatcactggcatccttaccggatctggccgaatggcccagttctaggcagagatcttagagggagggataaagagccctgctcccaatgtccctggagttgtccaacttccaacgtccacttcggcggcgatgacncgagggagaggatgcaggaaggttgtgtggtggtgagttagtcgtgttcgcgcgtgtagcctctggagtgggagcgacatctagcattacctatgtttgttttggctgtggaaagatggctgagcatatagatctcaccgttttcgtaaactgaaccaaccgctcttagattttaatttttaaaactttaattttagagtactttgaatgtagttttttaagcgttaaggatatgcatataaaagttttaccagtaaatgattatttttattattaataaattcttttggtttataattagctctcttaaacaaccgacgatggagctacgattatagaactcgatcagatacacaaattcgggaatcgttcattagtatatcacactggcggtacggtagtgttgactacatgcaacctcgtgcaacacacaccacgtattatattagtatattacctagactatagtttgaaacgaagtgtgatgaagctaggttgacttctcgctgttgatgttctgcccccggccacctgatgattaatttgatattagtagttaattaagaataatatcacctcacatgcagagctaggtgattattgatgtataggccacatggggtcaccgttcccagagatgcgcgcatgcaattagaagcaacatcaccggagtcagcagtgagatcgagcaaactagctagcaaattactcccttcatccctaaatatttgacgcagttgacttttctaaacatgtttaaccgtttgtcttattcaaaaaatttaagtaattattttttttatcatttgattaattgttaaatatatttttatatatacatatagttntacatatttcacaaaagtgtttttaaataagaataacggttaaacagcgttaaattttcgggacaaagggagtagctgaaatcgcgtgcgcgcatgtgaaccaggatatgtgcaggattcatttttattttcagactcttttgaagcgcagggattctaaaactatagaaataagaaaacaaatgggaaaacaaaggtttgaatcatataattacttaaaatgtgtttcgatggcacagaaaaagatataaatattgaaattatatgttatttcgagttgagtagtaagagaaaagagaggtgtggctttggaattatcatagaaaaacanataacacgaagtacgtacgagctcatgtntaaaatccttaatttggattggagcatangaatgaatccaacgggattttaatttgcaagcccaaatcttaccaaccaaaacaacctcttcataaagaaaaaaaagcctaaaaattaattaaaatccttcaattttcctttgaaaatgctttaatacaaataagtctttattgggttcagggatagacagccacatgtaagtgataaaatcacctgcctttgccttccaagtagacgacgaaagaacctacgcatgcgcgccacccagccactcactcagctcgcgcgctggagtacaattactaaacaaaaactcaaaaagcgagggcggcgtgagctacaagtatacaaggtgggggcatcttcttcctcccgctcgcttgtcttctcctccacgcgcgcgcacgccgtcgggctcgtgaccgatcgatcgatcgagagagaggtcgctcgatcaacatgggggaggcggcggcggtggtggcggtgaacggggagaggtacgaggcggtgggggtggacccgtcgatgacgctgctcgagttcctccgcacgcggacgccattcagaggccccaagctcggctgcggcgaaggtcggtcagctctcttgctagctgctgctctcatttttgtctcctgtttctatttttttttcgtgttatatatgctacgtttctagctattcttcttgttcttgttcgatcggaattaattaatcttgagctggaatttaataataatggttgcaacgtcgtcccatccacctactacgggatgtagttgtagcgatccagtttttggttgatttatcttccttcctagctagcttaattttcaacttcctagtgttttttcagacgcggcaggaacgtactagtactgtttcatttcattccggtcgatctaacattgtttagcctacctgattaattattatatatatcactctagttaattacagcatgagaaaactagcaacaatcgtgtacgtgcagcaaaattgttgtgacagttttttaaaaacacgagataacttgctattgctactaccacaaccaatcttgggagctatacgcagtggatgtgaaatcattggacaaaaaaacttctcccaccttcccgtgatactactataatagattttgtgtagatataatacatccgtctgtcaagattcactgtactataatgtgtcatatccacccaaaattacttatattacggaataaatgtgtaatttattagacaataaaaaattgtctgagtttactaacagaaaaatactaaacttttagtagtataaagaggaaaggcgatcgagtttgttcaagtcctcgagagcattaccttgtaagaaatggaaaggtagtacacgtactcacagtagcttactgatgattacgctacctagccgtcaacgcatacgtttgtacggattattgttattactgtgttgattattttttgaacctaacagttttaattaattagattaaaaagatgggctcgcataaattatagcttgctaattaatttgagattttggaattaattaaattaacaaagcactaaattattagagttcaaatctcttcacatttattagttcaaaatttggaattagtaaatttaaaactataagtcataatttagattatcagtttggagcagtttcagcgcacctctcaatcctagggaatcattccaacctttccggctgcagtttgtacttttttgtttgctttttgtttattttattaaggagtattaggtagcagagcctcacatg

SEQ ID NO: 9544 - DNA, 26440 bp, Oryza sativa
tacaaatctgtagccagctgcagtgcggattccaagacacaatgtgtgtatgacaggtgggaccatatatattaatagtatagtaagcaaatattgtatgaattggctataaatgaattggagctagtagtgggctatgactgtacaaaagcattcattcagtaataagctcataattacgtattattttggaccctcttatacatgtgcgatcttagtattgagtgtatttatttatacactttaaatgattttagtggtggtgtctgagcctgctagaaattctacaatctaacatgtgggactataaggtgctcagagcctgctagaaattccacaatctaacatgtgggactataaggtgctcagacgtaatgtttttgctttatacattactagaaaagatgcatgtgcgttgtaacgggtgaatactattttaattttattattgttatacggtttaactaaggtgaaattcattgtgggaatttccttggatatttttttttaaaaaaatcatgagctgcaattagtcgacattcatctcaagttagcatgtgagtttttttaaagagattccttacacgatttccaaaagaaaacgaatttaaaatccgactcaaacacggaaccgtattttcaacagcgaacgaacttaaaatccgtctctaacatggattagtatttctaaaagcgaacaaacttagaaccgattctactatttttataatagtagagatagagaagagatatgcctattcaactaactatgttaagttagctataaacctgtagtaaagttgttatttttgcatttatctgttataaatatctgttgcaatgcatgtgccttcagctagtttgagtaaactttaaggggctgtttggatggaggctaactttgccacaactccatttgccatggtaagctacgcaaagtgcggccaataatttgttagccacaactatagcaaactttgactagaaaacgagagtatgacgcgtggaccaatatgctaacaaagtgtagcttgactcaaatgtagcactctaccaaacgctagctaagaacttgtggcacgcctaagatttggtttggcagactgctgccaccgaccaaacagtccctaaattactgaggacttcttttcaggaggatgcggggcgtgcgcggtggtggtgtccaagtacgacgccgccgccgacgaggtgacgtcgttctcggcgagctcgtgcctgacgctgctgggcagcctccaccactgcgcggtgaccaccagcgagggcatcggcaactccagggatggcttccaccccgtgcagcgccgcctcgccggcttccacgcctcccagtgcggcttctgcaccccgggcatgtgcgtctccatcttctccgccctcgccaacgccgacagggcggcctccgccgcgccgccgccgccgccgacgccgccggggttctccaggctcaccgccgccgacgccgagcgggccgtctccggcaacctctgccgctgcaccggctaccggcccatcctcgacgcctgcaagagcttcgccgccgacgtcgacctcgaggatctgggtctcaactccttctggaagaaaggcgagcgcgctgacatcaccaagcttccggcctactcctgtactgccgatgttgccaccttcccggagttcctcaagtccgagattaggtcatccggtggtgctccggcggtggcggtcaccggcgacggctgctggttccatcccaggagcatcgaggagttccacaggttgtttgaatgcaacctgttcgacgaaatgtccgtgaagattgtggcgtcgaacaccggctccggggtgtacaaggatcaggacctccatgacaagtacatcaacatctcgcagattcctgagctctcggccatcaacagaagcagcaatggcatcgagatcggagcagccgtgtctatctccaaagccatcgagatactacggtcagatggtggagacgcggtggtgtttcgaaagattgcttatcacctgggcaaggtggcctcaccgttcgtccggaacacggccaccataggaggcaacatcatcatggcgcagaggatgtcgttcccgtcagacatcgcaactgttcttctcgctgcaggatcaactgtcaccatccagcaggtggcttccaagaggatgtgcctcactctggaggaattcttgaagcagcctccatgtgattccaggacattgctaatcagcatctccatcccagattggtgttcatatgatggcatcacttttgagacatttcgtgcggctcctcgtccatttggcaatgctgtctcatatgtgaattctgcattcttggcaaggagttcgttggatgcagcatcaggaagccatcttattgaggatgttcgcttggcattcggcgcttttgggtctgaacatgccatcagagctagtaaggttgaggagttcttgaagggaaaattggttagtgcatctgtgatacttgaagcagtccggctgcttaaaggagttgtttcaccagcagaaggcaccacacatcctgaatacagagtcagtctagccgtcagttacctgttcaggttcctgtcttcccttgctaatggcttggatgataagcctgaaaatgctaataatgttcccaatggttcatgtactactaatggaaccaccaacggtagcgctgagtcgacggttgacagctttgatttgccaataaaatcaagacaagagatggttttctctgatgaatacaaaccagtcggaaaaccaatcaagaaagtcggggcagagctccaagcttctggtacatatatactttcctgttcctttatgtgcacaatcttttttagtttataagttttgctttaacttttcttttgaaataaagaaatttgctttaactaatttctttgaactactgtactctaaaatcttgcaacgtacctactatgtgttgagctccttggactttgatagcctgaacttctaaacttgttactcaggggaggcagtgtatgttgatgacatccctgctccaaaggattgcctctatggagcatttatctacagcacacaccctcacgctcacataaaaggtgtaaactttagatcatctttggcttcacagaaggttatcacagttatcactgcaaaggacattccgaccggtggagaaaatgttggatcctgcttcccaatgttaggagatgaagcactttttgctgatccagttgctgaattcgctggtcaaaatatcggcgttgtggtacttacgaccaaaccacctgaactttctttcgatgagacaaaactagctagtaatatgtcaaatattcagattttttttataatgcgtttgagcttaccatgtcctgatccatttctatcattcagattgcggaaacacaaaaatacgcctatatggcagcaaggcaagctgtgattgaatataatactgaaaatcttcagccaccaattctaacagtagaagacgctgtccagcataacagctacttccaagttcccccatttttacaacctaagccaattggtgacttcaaccaagccatgtctgaagccgatcacaagatcatagatggggaggtacggacatttcgttttctcttaacacgctaaagctttaattttgctattctatatattaattagaagaacaattttgattcacactggaatctactgagcaacagagttgctctgaatgaaacgaaatatatagcctcagttcatgacaattctaggagaaataccttcaccttatttgttttttgggcacatacaggtgaaacttggatcccagtactatttctacatggagacacaaacggctttagctttccctgatgaagataactgtataaccgtctactgctcagcgcaaatgcctgaggttactcaagatattgttgcaaggtgcctcggcgttccatttcataatgtccgtattatcacgagaagagttggaggaggtttcggtggaaaggcaatgaaagcaacacatgtaagaacctgactgaccatagctttgcatttgcaggaaaattatattattgaactagtggaattaatttcccgtacgtctagctagttccgttgctatagatatactgcagtgcatatgcttttgtttgaaaataaaactatatatatatatttgtaataccacaaaatgacaaacgtttgtgattgaacatgtatgtagcagtctttcacctttcaatagaaatatactagtatttcaccactaaaattcagcaattcagatctctgttttgatagcaaaacagagaatttttttccgatcttgattttgatttatatctgagtatttgaaatgaaaaacttctagatgtaagtatgaccagaagtattatgatttgacaggttgcaactgcttgcgctgtggcagcattcaagctgcggcgcccagttcgaatgtacctcgatcgcaagacggacatgataatggcgggagggcggcatccgatgaaggccaagtactccgtcgggttcaagtccgacggcaagatcacggccctgcacctcgatctcaagatcaacgccgggatatcaccggaattcagcccggcgatcccgtacgccattgtcggggccctgaagaagtacagctggggcgctctcgcgttcgacatcaaggtctgcaagacgaacgtctcgtccaagtcggccatgcgtgctccgggcgacgcgcagggctcgttcatcgccgaggccatcgtcgagcacgttgcgtccacgctctccgtggccacgaacaccatcaggaggaagaacctccatgacttggagagcctcaaggtgttcttcggggacagcgccgccggcgaggcctcgacgtcgtcgtacagcctcgtcatcatcttcgacaggctggcctcgacgccggagtaccagcggagggccgccatggtggagcaattcaacggcagcagcaggtggaagaagcgtggcatttcttgcgtgccgatcacctactcggtgacgctccggccgtctccggggaaggtctccatcttgaacgacggctccatcgccgtcgaggtcggcggcgtcgagatcgggcagggcctgtggaccaaggtgaagcagatgaccgccttcgcgctgggccagctgtgcgatgacggcggcgagggcctcctcgacaatgtccgtgtcatccaggctgacaccctgagcatgatccagggaggatggaccgccgggagcacgacctccgagaccagctgcgaggctgttcggaagtcgtgcgccgcgctcgtcgagcggctcaagcccatcaaggagaaggctggcaccctaccatggaaatcctttattgcgcaggtgaggaagaaaaaaacatccaaattttcgactccctccgttttgaagttttgagattacaagtcattttgactttggttaaaggcaaagtcaaattgctttaagtttgtagaaaaaaaagtagtaatgtagaaatcctagattgtgcaggtgaggaaagaaaaaaatttcaaaattttttagtaaactgaaagcatcagtagctaggcagatcatgttttttgaaagatcactgttgtcagtctgaagacagcattgtaaatttgttttcactttcaggcaagcatgggtagtgtaaaactgacggagcacgcgtactggacccctgacccgacgttcactagctacatgaactatgaagctgccactagtgaggtatacacactacacgaaccctgatccaaattacatcagcaggcagctctgaaaatgcaattttaatcggaaatctgcatatatatgatatgaacactgttctccaggtggaagtcgatgtgctgacaggggcaaccaccatcctgaggagcgacctcgtgtatgactgtgggcagagcctgaatcctgctgtcgacttaggccaggtcagtcagtcactcaatctttttttttagattttgttttatttagatagatgattacatcctggcctctgcatctgtgatacatacagccataaagtttgaattaaaaaaaaaacagtgctcctgctactaattggagtaccttcaaaacatcaattaattactttctccgttccaaagcataatttttttaaagaaaaatgtttctgggtaattttggaatggaggtagtgatcagatctctgcatgatgttgcaaatcattaatcaattgcaagaccaatgaaatccatgtgtaaatatatatgtataatctgaatgcaagattgttagctgaatattgttgattttggcggtctccatcgataatcaggtggaaggcgcgttcgtgcaaggtgtgggcttcttcacgaacgaggagtacgcgaccaacgccgatgggctggtcatccacgacggcacatggacgtacaagatccccaccgtagacaccatccccaagcagttcaacgtcgagctcatcaacaccgctcgccatcacagccgcgtcctctcctcaaaaggtgacaatataaatgcatcttctgctaacctcttcttcctcctcaatctttttttcgccggaacggcggaaggaagccgatcgattttattagatttaggagaaaataaaagtatatcgtagtacagggtgccactaacaacaagtgattgcaatttccaaacgaaatttcggcaatttcgcacccccacaggcaagcacatttctggcccagaattttcggttttttttttcaattttttgtgaatttggtcaaattttatttaaattcattcaaaattcgtcaaattttccaaaaaatttcggcaaaaaagtaccgaaatttcggccacccccggcaaaaaaaacaatttcgagattgctaacctgtgaacaacaaaccctatacaagctatacattcacaactttaacactgaaaaatctgaagctgttttggcgtatgtcatggcagcgtccggtgagccgccgctgctgctggcgtcgtccgtgcactgcgcgatgagggaggcgatcagggcggcgcggagagagttcgccgctgtcggcggcggcaccggcggctcagatcaggtgacgtcgttccagatggacgtgccggcgacgatgccggccgtcaaggagctctgcggcctcgacgtcgtggagaggtatctcgagagcttttctgcaaccaccgcctagtgctgggagaaagccgaaatggcttcgcatcttggctggaagaaaattatgcaggacctcagtccttcgcccacccagaaagacttctcatcttgagtgacacgtgtccgcacgaatcttgatgtagtcatcttctacctgagctcaagtcaagtgcagagtgccaaactttccctttctctctcctctccactctccacctcccttcctcctcctcggccagggagggaaggttccacttgctagaggcggcgagctcgccaaactttttcatcgtggcgttgtctctcctctccactccactctcatctcaccacctccttcctctctttcttcctagccaatttttggccggatgaacagcaacagcggcgagttcgtccaatcgatggtcacagactagcaaccttaccagcctcccaagctaagagcacaagtactgggtgccgagttgccgactagacatgctacattgctgctcttgcatcatgttgcatcccgtgccggagattgggcctctggctgtgcagaaaggagccaggggaggtagggactgggaagtggaaagggagaggagagagggattggggaatttttcggcactttggtctgaggtagaagatgactgttctctgctctaagattcgtgcgaacaagtgtcactcaagatgagaagtctttccaaatgggcgaaggacccaggtcctgtataaacaccaacaataatggggctgctgacttgtatgttgatgagttttttttttatgtatgttgattactggaaatgatgtttaactatttattttattttaaaatatcatgcagttatatttattttgctgtaacttatatttttatatctttactaaatttttaataaaatgtatggtcaaatgttatatcaaaagttaaggcgttagatattttaagttgaagagagtatgtttagaagagaaaaggtttttacttttgcaaggtaaacctgtatatgtatggagatgagcaattctacagttcttaaggaagtaccatgagatactaaaaatttaatgtaaaatttggtacctcatggtaccttatagtatctaggtaccaagaggtaccaaatttataatagaaaaaatggtatctcatggtacctcctcaagtaccataaaattgctcgtatggagataatatatggacagtaatgttcttatggctcgtgcaaaaaagagcgaaaaatatgccattatttctctacatgggattgggcgattggccggacttgaaccggaccgaaccagactgagctctgggtcatctgtggccgatgcttgccatacggttggtttactggtcaaggcaccacatgtaattgtatactaaagtactctctctaatcaagatagaactctagacccatactctctaaaccatagatgtctagtttaatgcacacaacgagcgaccaaatgatcgatccaagaaatattcctaaataaagattgatagtaaagcataaagatataaaaggatatatatatatataaatattggaaatataaagcatatatattaaccaaaatatccgactcagaaaagatataaaagtttttaccaaacttccagaggcactcctctgaacttttgtcggttctcgtacttgacttgactcccgatcaaactcctactcctctacgaagtagagttggctattcctaatactctagcaactacagtgaacaaagtggagcttctactctgagttagagtagtggtgtgctcggccttgaagtgattgggggagggaaagtttggtctgccggccagtgacctccgctgggtcggttggcctttccaatatctgagatcatgtcctaaagtcggtgttacaacttgtattccccactaacatcggttggaccaacggtcgtggaaggggccaactaaccggcctaagagagtggtatgtcagatgtgtactaaatcaaaaggagtgtgtaacctagaaattacccctctgaattatcgtggtcgactgaattacccctctgaacccgaaaaccatacgtcgcttaccctaaacttttaataccggacgattcactcccctcaacccaatccaaatcagttttgtcccacatggcatacgcgtggcaatccagtcagcattttatttttaaaaatggtgggacccacgtgtcataacccctcttcctctcatcctctcttccacattgtcagtgggcggcagcgtgcatagcgcgacgtggggaaggacaatgggcagtagtgcgcgggacgggctggccatcggcgcgcatggcagcgtgcatggaggtggaggggatgggggagggcaagcggaggtggatggggaaggcagtgggcacgcggtggcgctcgtggacgggcaggaggtcgtgcgcggtaaggtggagaggatgggggagggcggaggtcgatggggaaggggaggagatggaggtggaaggggaggggcggtgggcggcagtgcccgtggataggtgggcgggcgacgcggacggcggcacgccgggatgtggaggggatgggggagggagagggggagtggaggtggatggagaagggaagagatggaagtggaaggggatgtcggcgcacggcggcggccgtggcgggcgaggcaggggcatggccgcctgtccccgcgctgaccgcccccgtgcgctgctgcctgtccattgctcgttctagcgttgccgtgcacgccttttgcccaactgcccgagagagagatagagagagagagagaggggagggggagggaggaagaggggaagaggaggtacaggaccatgctgacgcccggtcggcctccatctccgttgccgaccgcccgatccgcctccaccgccggccaccaagctcctctccccatctctctcatccttctctcctcacggtgtggagaggccctcccttcgccggcggcaaggtgctggacgccgccgcctccagcatcctcctcagcgccgtcccgcgatgacgccggccgcccgagttctctccgcctccgcctccaccacccgccacctgagttctctctgcccccaccgttggtcgcccgagctctgcttccgctgccagccacccgagcgagcgagaaagagagagagagagagcagagggattgggtaggggagaggaatgacaggtgtgtccaagagtttttttaattctttttgttgactgaattgccacgttggtgccacgtgtgcaagctcaagtcgaaaacagctcaaaacagtgcttaggagggttatttgcccgatttgtacagtttgggggggggtggtgaaggatgcctggttttacggtttaaggtgggtaattcaatcgaccgtgatagttcggagggtaattcgtactttttctgtggaacctaggtgtgagctagagagaggcaagaggagtgggacccacttgttagagagagcatcacatcgaacctattctacattgtagagagaatacagctaacagttaatttacattttctttaaagtgaaaatcacctgatataaaatgttttggaccttcggcatcacatagagttgtacattgatctactggagattacatgcagcaaagagccggggcctttcttcaccgccacaccagtgacagcatggtgaggccatcttggccatcttggccgcgtgagtgttctgtgcgcgatctggttccaattttccttttttgggtcagtttagtgcatctgtccttttttcctgttttgggtgattcttggtggggtcacaattaacattcttgccccatgtgcatatgatacattattgagccaaggttgccaatttttggtccatgagacgtgtgatttgtttttctgttctgacaaaatcagtctaatttttcatgggcttggcccaattatcatacgggcctcacatccaacacatattgttttgtgttttgttttccttaattttattttaattcgtttcaaatgtatagaaaaaatttatatgtataaagtttctagtttatacatataaagtttatatgtataaattttcatgcatttaaagttctatgtatttttttcccaggttaatatgttaaatttatttcaatttatgcaacacgttaaattcgttccaaattgatacgtagaaagtttccatagttgttaaaaaaagggggcttgatggatcaggtcgaatcgagccgctccccatcacccttatacctccatcgatccatacaacaacaacatataatcaagattttcacgcaacaaaaatcacaaaaatgtcaaccggatatccatcaacattttcacatcatagaatcaagcattcatgaaaaaccaacttccctcatcccttctttatgaagttttggcaatctgttgctggcatctctggagtaggcgaaatgacttgatctttaatggtattcaagcaaactttggcaaatggaaggctgattttaaggatgagtttactctgcatacgcatagagtaaaggagacatacacatagagtaaaggagacaggaaaaccattgtagcaatcatggatttttttttgcggggcaatcatggattaataacatatactccctctgttttacaatataagtcattctagcattttccatattcatagtgatgttaatgaatctagacatatacatctatctagattcattaatatcaatatgaatgtggaaaatgttagaatgacttacattgtgaaacggaggaagtattaactagcttgcctttcagtcagtcttttcttctttctttcccttctattatattccccctgtacagtttcccttgtatattgcccttttattttaatatatttgtgtagtaggagcctctcctgctgttttaacagttaaaaaggatgtgtagtcgctcactgcagaggagaacttcgcttgctgccatcgctcactgggacatggaggttgcctctgctactgccccatgcgcgagagccatcgctgtcgtgggatccaccgccaccggatccacccgatccacccgtaggggtcgctgttggtgcattaggtggatccaagcgcgggagccactgccatggcatcctgtggatccgcccatagccactaccaacagattcacctgtgggagccaccatcgtcgcagccggcaaagctgcctataggagctgccaccgtcgaggaggaggattccatgatgccgtagcggcggagaggggttacgttggtggtggtggagagagagagaggagatggagggggtgggagagaggagagagggcaatgaagataaggatgagtggagagagaatataaacgttgcacacgtgggacgagggagatgctcgagctcagaggtttatttcttccaccccgcttagctcagctctatcttctcgacatgtgtcggtttaataaaaaccggcaccatgtaggtgctggtcaaattgagaaaacatgcaccagaaatatatgtgctactatttttttaataaattgacacttataaagtgttatatatgtggttttttaatttcggagtctctaaagggttaggaggatggggaaaagctcatttgtgccggttttagattaatcaacacctataggtgttctctattacgttttctatagtagtgttaatatgtctttaataaatatgtaaaacaatcgtcttttgatgtagtagtgttaatatgtatttaataaatatgtaaagcaaccgtctttgcaggacgaagagaaaataaatagggcatataaacagcgaagacagaccaaggcaaaagaaagtggggcctatccagccgcctatacctacctttaagagagaggaacgggttgaggaagaaacatatgataacattgaagtcactactaattacttatatatacaaaaatatatagaataaatacagctagcacttgatttatatatttttttttaaaaaaaggagaatcacttgatatacagcgtatgaaacctgtctcgctgcacagttgtacactctcctggagaatgcatgcagcagcaagatagctagggtcgctttccctatcttcagagatggatttttggacatcctctttgtttattagtacccgtctgaaaaaaaaaaaatccaatcctacgtactaacctagaaatatttgtgtgtccagatttattgctaagattaaattttttttacagagtagtacgtcccacctaaataatcaacaaaatattattttaaaaaattaagaaaaatagattaatataaaaatatcacatcacgaatataaaaatttaaattcgacataaaaacaacgaatgtaaatgtgaattgagattttagtttaatttattctttttgctatggtttataggagttgtatttgcccctgcatgtttgtaaagtaatcactactggtgaaacccttatctctccctttatatatttatcttatattagtctatcttatctttttataaattttctaataactattaatgtgatatggaagaaattaatggtgtccaaaaatgcatctctgaagataggggatacagctaggacaggtgtacactctcctggagaaagcaagcagaaagggtcgatcgctttcacaccacgcggctataaatatcactctatctgcagactgcagcaggcaacaacaaagcatcatcactgtcgctgtcatcaatcattgtcacttactacttttgtcttcgtctccaccaaagtctcctccctttcctcccccctctcgatttcttcctctcccaaatcgatttccaagccctagcactacactcactcacctaccccgagacatggctgagttgccgccggtgcagatcgtcgcagccaaggacgacgtcccgccgccgtacctgaccgacaacgtcgtccacaacctgctgctctgcctggcgccggagccggcatacctcgccgtggcgacggccgtgtccaccaagtggcggagcgtcgtccacagcgaggcctgcttcggccgccgcttccgcctggactacgacgggccgacgccgctgctcggcttcttctccaacaacgccgcggggccgttcttcaccgccaccggcgccggcgtggtgggcctggcgccgccggaggaggccgtctcggccggcgacggcagcgtgcagcacatctacgacgcgcgccacggccgcgtcctgatggacggccgggaggacaaggagctcctcgtctgggaccctctgtcccgccgcaaggacttcatccccatgccgcccggctacttcgtcggagagggctacggcggcggcgcgttgatctgcgaagccgaccacggcgccggcgacgactgccatgccgcgccgtaccgcgtcgtattcgtgtactgcggctcggatcggccccccaccaccatggctagcgtgtacagctccaggaccaacacctggggccccgtggccaccatggatgctcgcgtcactttcgagctcaagcaacccgctgtgctcgactataccgtctactggttggtaaatgggaggacccaaatcattgagttcgagttcgataccaacagcctagcactattcagaacaccggtggatctcccggacatcgtcgtcttccccatggaagacgggcggctaggctacactggtatgatgggcccaatcgtcagggttttcgccatcgaagatatctatgaagacggtgatgccacctggacaaaagttactactcttcatctagatgctatgcggccaagccagtcatatcagcaagttcttgattcggacacagactctgactccgatgatgaggaggaggttgtattattgttggcacatcagtttggtcccaaggcgaagaaggatagcaaaatcattccctcgcacccgccaactattaagagtgataacgacgaatataaccatgtcgtgatcaggccaagagttatcgggttcatagaggatcctaactcaatcttagttcgaaatgagctaggtgtattcatggttgatattgaatcaaacgaatacgagcagttatctcagaggatctacttcaccactgtctacccttacgagagcttctacaccacaggtataaatctgtcatatctattttctttaacaaaacaacaatattttagttttgcctaccgtttaattaaattacttataaacacatttaggaaaaaaagtccttcttattagaaaaaatcagtgttagtatacagatttatcttccacactgcggtttcttagcatttgggtttgctgtaaacttagtgcaacaataatatagctagctagctaggggcaaacattttgaaaaaaaagtttaagtctctatattatagggttagactcctaaaaatgtttcttttggataaagtaaatgcaaaatagtgtttttgctcgggcagcaagtgcaaatttatagagtgtattgcattattatactaaaaaatggctacccatctaattattttccatagaattctgttcatgagtattgccctcttcatgttgcccatattcttcatatgatgattagactatctcattaagtgtatagtgctccgtttattttgttttgttgaataaatttgcttgttctaattatttgaggtatggtgcagcatatgatatattattgatctgatctgtgttcaccaaattttgcatagtctttctgcatatatagttgctacagtaggacttcacaaactgcatatgtgtttcaatgcaaaggtacattagattttcctaaatataatacataattatttaaacaatttgttagctagtcatcaattccattttcctctgtgcattttatggttggccacatcagattatacatacaattaagttcatcaactaatgtatatttctattacaacgtcttaagttgagctgataagcaagacggaatataccttcgaactgaactgccaagtgcatcttgaaaattattcaaacacaaatttagtttattcaatagctttgttactcaagtgataactacgatagaatttgtgctctaatagtattctgaattcaacaaactgcagataattgatctgagttaattattattcaattctagaatagtatatattacaattgtatgagtaattaaagattgtgcatatatagttgtaacttgcaatatgcatgataaattagctgttcttttatacccttttgcatcttctaattatcatatatatttaaaatatgttgacatggaattttgttcatttacgatcatgtgcttatctacatctgaatatgatattgacaatgtatacatttcctgtactgagatatgttcatatcagaatcacatctaatgaccggcattttcctaaaaaacagttgcatttttcacagcccaacatatctttcttgtcaattgcatagatcttatatattcgatgttgttacgtacatacagttggcaaagcaaatttcaatgatccggtgctgattgatcatgagaacaacgatgaacaaggtttacaacagcttgaacccctcaatgatacaatacttccagatcaggagaacattggtaaagaagtttacgacttaaatccattataatttataagtaaacagtaagcttatatggcttaaacagtaaagttttgcctgttcttgttttcccacaggtggagggattagtgcttcaggtgatggagacgagcagtaaacaggtctttctgttacctcatcagttcaagtggtatgaattattgtttgctcacctgctatatagacattattctcttttttgatccaaattaagttttcatttatagatagctagttagcagtttttttttagataatggattatatcaaacccggcctctacaccttgtgagggtgtacacagccaaaaagctacaccttgtgagggcgtacacagccaaaaagctatagttagcagtttaaaaagaccgtatgttcttatgtatagtttctgaaactttgctatgtcatttatatatctacacatttgttctttgtagacgtactagcatacaactccattttctgaggatcttgcagttgtgctagcaagatttctacacattttcttatgttcattttactagagcgagagtagcaaaaaaaatatggatatatgcagacataatagttagcgctaggttcaaatgttacaaatcttgcaagagctggcagatagacttgaatttagtctgacgatgctttttttatgttgacctgctcattcttatattcttcaattcttttactttatttaattagttaccagttccccaattgaagatagacttaagaagtttctggcaaagaaatgacgttttcattagcgacaaaatatcatttcgctatgtcatatttttgtaaaaatatttacatcaagttatagattgagaaattatttttctggaacaacagtaaatgtgtggactttgggatcagtttatataattgataattgatgacaattatatatcttattaattattatacacaggcatcaagattgggcgtacattgaagatttcttggtcggcagctagctactataataatcaggctatcgcacattcagtcagattctcagatgtgctgtaaacttgttaatttaattaataaacccatgtcatgtgtttgttgtttacctgcattaattttcgtatgtgtacttgcccctgcaacaactggtgctgcgccgttcaaatcttcagctagtataagtttagacgacagcagggatatatgtgaaatcaatgttttgattcatgtttttgcgatgaaaaataattggcatgatcagttgattgtactggttttaatgatttgatgatttatccgcgaaatgtaaatttgctatctggatgggtctggaccggccgtggttggtcacaccggacaatatttgactgtgaatagggttatcgatttggatcaatccggtcagaccggacaatatttgtgtgttggggtattttgtctcttgacgaggccacattggagaaccatctttggtcggtcgaccaaattccacaatagtcctggttccattaaaaaccggaactaaaaacgatttttagtcctggttaaaaaatttgaaccaacccgggactaaagatgatttttagtcccggttcatcccctgtcagatgtatgtcagggggccgagaatctttagtcccggttaatactaccaaccaggactaaagattaccactttagtaaagatcaatttgatctttagtcccggttggtaagtattaaccaggactaaagattaccactttagtaaagatcaatttgatctttagttcaccaaccgggactaaagatggatctttagttccggttagagttatcaaccgagagtaaatatttctctcccacatctgatcggttaagtcccagacagatatttagataagattggatcatcccctctcttcctcttctcagatccaatccccttcctcctccccttcctcttctcctcctcccctctcgtccctcccatcagccggcccttcctcctcctcccctctactccctcttccattagccggccggcggcgggcggcggcggcgcggccgtgcggggtaggatggcggtggcggcacggccgcgcgcggggaggcggcggcggggaggcgggcggcgggcggctcggctgcgcgcgtggaggcgggcaggcgggcgggcaggcggccggcgggtggcggcggcgagcagcggccggctcgtgtcatgccccgaattagtaccgaccggaactagcccgcgacgcttcaaattaacctgttgatcgataccagtcccaggaaacagtgctggtatcacagggagacagaatatcacagcaacagccgtctctttattatagagtaggagtacagtcatgttgggctgcggacagatcccgagctcacaactgcattacaaaagggaaacagaagcaggacttggaccaaacaacacaggcgtgacttgggaactaggccgaaaccctaaaactcatcgtagccggcttgctcctagaagaactcctcatcagcaggatccgcttcatcttcttcagcaactgggggggggggattatttatatagagcaagggtgagtacgggagtactcagcaagccatgggaaataagtgtttaatgcaggcttcaaggaaaggctgttgtttttgcaattgattttagttgaactcttttctaaaaacaactaagtgagtgcttctcaaacgacacggatgagacagtacgtctcgtccggtcggagtatgtgcaatgtatcagtctttaaaatttaaaacaaggttggcacccggtcaacagcttttcaaacggccacccgggcctacaactttcaaacggccacccgggcctagctgatcccatcagctgcagatttttcaaacattgaacccctttccacaacagcaatttcacaagcagtagtcaaacaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgatacaggtttaccatatgccgacaagaggggtcccagaccaggttaggtcccagaccatactgtgccaggaagcccaggggtcctccccgacaccaccccggcgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccgtacacccggtacgttccccggtccgcggttttggaaattcatttagttcgcaagcgccgactcaggtgtcgggttttccaagtcttttgtaaaactccagttttacccaagttgttactcagattttaagtttgaaggtgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcaatgcataatattttgcaagcaacataattaaatttcaaatataggctcaagatgttcaaaggtggcttgccttgctcgagatctagagcttgatcctcgaaatcctcgcactgcgggtcttcgggctctgaaactacacgcgaaacggggcaactcaacaaacggcgaaaataaagccctattaatgacctctaagcgtgccattagatagatctcgagatttgaggaattttggaagttgaacggagtcaaacggatttatggttgggaagatattgaatttctaagattattggatttttggtctaaaggaaaaggatttaattaaatcctttttggaaaagaaaagaaaagaaaagaaaagaaaagagggatggaaattagacttttcctcgggcggctagggcgcggcccgagagagatggggcggtccggccgagctaaatgggccggccggcccaagacagcccaagcgcgcgcgcgggggaggggaggagagagtgggccggtggaccgggctcactgtgcgcggtcccgggtgggacccgcttgtcagcggctcagctcaccgtgcggagggagcacgcggcgcacgcgcgcgggcgggggagggacgcggtgcacgcgcgcggtctgcggaggaacggatgcggcgggcccacgcgcagcctcacggctcgcggtggaacgcgcgcatgggaggggctgaccggggtcggcccgtcccgacctcggctgagctggcgccgacgtggcgcctacgtggctgccacgtgggctggcgggaggtagacgacgacgccggccagaacggacggcggacaacagcggcgagcggcggagcggaccacggcgataccggcgaaaacgagcacaccgggtggttgcacgagacgaggggagacgagccaactgctcggattcgccggaggaagcttgacggcggcgaatcgcggcggcggcaaccggcggggagggaagagggaaatggcgacgaggtcacgaggggccgattcccggcggtgagagcacctacgcggccacgggaatccgatgctagcgtcggattgtgcggagctacgccgagcgaggctggcgacgagcgggtgctacggagctcgagcggcgacggcggcgagcacacggcgggcgacggcaacggtcggggcggcgccggctagctacggggaggctactcgtgctaccaccgaaaactaagggggggagatggagcgaggaggaagaacggagggaggcatcaccgaggtgaggaggggcgctgtgacgagaggccgacgatgcgggagtaatctctccggcctcgggccggggaagaggaatgagagggcgcggccgaagtccccttccgcgtccttgctcgtgccggctcctccgacacgcgcaacgacgaacggcgacggcgaaacagaggggcggcaatggcgcggaggtgaatgggagaggaaaggaaaaaggggggggggagctcgggtttataggatggcaatgtcggtttgggaaccgacttagggcggtcaaaggagagggctagcgctcggcggtcgtggccaaagcggcgacagggaggagggaggaggatgacgccggcgggagggaaaaaggggaaaagagggagagaaaagggggcttgtccccttgcctcttcgggaaaaggaggagggagcgggggcgtctcggcagagggaggagggaggctctgcctccgtcccttggaggctagcgcgggagtggcggggccgaggcgatgacgacggcgatgacggcggggcggtttggagcggcgcgacgtcacgggcgacaggcgcgggctggcgcggcagagggtgacggcggcggcgaccaggcggtcggccactcggcacgcgcgcgcgggaaacaacgggcggcgcggctgggcacgcgcgctggctcgcggggccgagcggctgcaggcgcggcagagcagcggggccgggcgacgcggacggcgcagacgacgcggctcgggcggggaaccacgcgggcgcgcgcgcgaacgacggcgtgcgggggccgtcttcgcgagcggggagctcgccagggagaggagaaggagagcgaggggaaggggcgctcggcgcggtgcttgcgcacgcgcgggcagagcgaggggaaagggagggggcgctcggcgcggcgctcgcgcacacgcgcgcgcggcgcgcgggcggggcggagcggagcggagggagagggggagagggagcgcgccgggggaggggagggggctagagagagagagagagagagagagggagagcgggagcgcgccgggggagaggagagggccgggggagaggggaagatgggccgagagaaattcggcccatcgaccccgggggaggcaaaatagacttttgcggaggaattgatttgggaagggtttggattcgggattgaactcgacgatagatcggggatttgagatctgagatggcacggacactagacaacaagcaaataaacaaatttcgcaattagggtttttagagataattttcccgctaggcgccacgacggaacgggcgctacagctcgtttgcttttttttttataatttgtgtttcactggatgtatattttttttagattttgtgattcattgcatcgcatggatttgagatgtataatcttgagatgtataatcttgtataatctatgatgtatttaatttatgtgtagtttttttaggatttgtgatgtatttgatctgtgtgtaggatttgtgatgtatttgatgcgtgtataagtaacttaatatttaggatgctgatttagggatgtgcatcccactcgatttgggagaaaatataaggattaactctagccattagcaaatcaacaatgaaaaaacaatgaaaaaaaagggcctcgagggactgccgctaccctattgggactaaagattccccctctttactctcggttggtgttaccaacccggactaaagatcgatctttagtcccggattcgtagtcccggttgaaaaaccgggactacaaagggttctgaactgggagtaaagagcatttctccaccagtgccagccggtctctggacaaagtattgatgtatatatcgtttatatatcgtagtaaagaactaaatgttcatgaagatatatatgtagtttctaaaaactatgctatgtcagtttatatatttcaaatttgtaatttgcagttgtgctagcataaaactccattttcagtgactagagggagagagtagtaaaaactctggatgcagacataaatacataataattagcccaagttcaaatgtaagaaatcttgcaagagctggcaaatagacctgaatataacttggtttgacgatgcagtttaatatattgtcttgtgccttgatcgtttttgttaatcaaaataaaccgagttgatgatagttatttatcttagttcacaggcatcaaagattgagagcaacttgaggatttttccgcgtggctagctagctactcatcaggctatctgattgaattaatcaaaataaattgatcaatcttccttgatctgtcctgcacgtcaggcagatgtgtttatatacactcgtttcgtatgtttggtgttgcactactagaaaaagtatttttacaggcggccaaaagtgattttcccaggcagggggaggactgcctgcagcccacaatcggggcagtggcccgcctacaaaaatccattgaacgagcaaaaaaaaaaaaattgcgggtgcgccttgccgccgccgcccacccctggcccgatctaggcggggaggggaggggagccgccaccccgcgccgtcttcgccgccgccgccgcagccgcagccgagccatcgtcgttgccgccccgcaccccaccgcccttcccaggcctccctctggccggatctgggaggggaggggaggggagtcgccgcgccgcaccgggagccgcatcgtcatcgccgtccacgccgccgccgccggtagaggttggggaggggagggggacggcccggccggtggaaagtgttgagggagagagagagagagagttgagtgagggaaatgagtggtggggagggggtggagaagataagacttagatctttttggggtagatacgattttcgcaggcgcggcttaagtggtccgcctacgaaaatgattttcacaggcgtcgcttaagtggttcgcaggcggacagcgaacttcaacctgatttatatttttgtaggcggtcaattggcttcaagggtcatgtccgcctgtgaaaatcagacctccacgtcgagaaaaatgtatttttctagtagtgttattcacctgcattttcgtatgtatgtacttagacgtttgaatttgatcagcttgtggcatacagttgaaaactgtttaactctgtaatagctcttttttaaggtttaaaagccggactctacatccaaacaaaccggatgtacgtaccaacacctctgcaataactatgatcattgataagctgctgaacagtttaaataatcttcagtatttatgtaagtttagtcgaaagcagggatagttggttcaagatcagacaaattaagttttagcttagcttatcacttaacggcgctaattaagcatcaaattaattaaatcaatctttgttccggctgtgtcttgttcccaactcgatgaatcaatttcataccgtaattgagagtgaaactaaaatcatctcagtcaaattttggcagagattaaaaatttctagaatgctcttctcacatgtaatgtaagacagtaagagcagtacgttgagaacttgagattgagatatagatagatagaaacgatgctgcgtcatcgcatgccatggcgcttgcaaccgcttgtcgtcgtcatcctcggccaggccgattgactgctagtgctttcggcgtcagaccgcgtgtcgtcctccctcgcgcacgcacgcaccttgccatggcgtcacggcatctctcaccttcttcctcggttcctcctctttatatctatcgatcagtgccgatcacttcacctaactcgatcgcttaatttccagcaaccaggaaccagcactcgtcggagttcttcgttctgacctgagcaagcccctgatcaccatggccgagagtgttgtctctgtcgatgctgtcgacggcgagcaggagcagcagcagcggctgcagcaggaggagttgcagctggctgacctgcccaacgacgccttgcggagcatcctgctccgccttccgtcggagccggggtacttggctgtcgccgccgccgtcaccaagaactggcgccggcaggtcctcggcagcaacggcagcttcctccgcgccttccgcgcggcgcacggcggagtgcctcccctccttggcttcttctgcaacaggagaaatctgccctgtccgttcttcaccagcacggtggatgccggcgtggtggatctgtccccaccggccgggaaacagcggccgttcatccacgacgtgcgccatggccgcgtgctactcgacgacggggaggacggccagctcctggtctgggaccctctcgcccgccgccgggatatcatccccacgcccagatgctacttcaccaacgatgacagctgcggcgctgccataatctgcggctgcgatggcctggaacacgtcgtcggcgccagcgtcggtggtggtgactgccatttggcgccgtaccgtgtcatcgttgcattcaatgaccggcccaactatcgttcggacgagtggaaccatgaatgcatctgcactagagtctggatctcggagaccaaagagtggagtgaggtatactccatgagaggaagttgcgactttgatttcatgccgagcgccctcgtcgccggtgccatccactggctggtgggggacaccaatagtgttcttcagttcaatctcattaccaaaaag

SEQ ID NO: 9545 - DNA, 4521 bp, Oryza sativa
cgtctgtttcatgggaagggtaatatactctaaaagttgatctaattaattaattaaactccgaattgcctcttgatcaagacagtaacatactattaattcttacctgctttctgcctttgaatgcagaagctctgaacacataatttgtgctgttaattttatatttgaaacgaattcacatgaattgctggtttctgtctattagagcatgtgttgggcgacgcatttgcggggacgtgaagtgtgatgttacatatgtagtggtgtatgatatatatgtgtctgccttgtgataaaaaaaagaaatgcccatgaatatatgaagctgcatgtacatatatatacatcctactagaaagaaaaaaaaataccatagtcttttctttgatatatatgaaagcatttacttgtgtttcttgttaatattgttccctcgctacatttacttgtgtttcttgttcaagctaggagaaaaccaagccatcagtgcacgcataagtaatatatcgatcaggcagagtcaggaacatatatgcatatcttcttcgcttaattgcatcgagacaaacattgtcatacttcttgggctgttgtagtagcaagaacagtgctgtcgatcaccaggatagctgcagcttcgcatggctgctttaagcaaaaacaaaaggtgcttttacctggcgtgtttggagatttggcgctagcaaaaaatgctcatgttcttcttacatgcatatatcttggtcaatttgtgtctgccatagtcttaaaaaaagtttatatttttcagtgcacgcaatcaattaattaagcaggcattttctaatgcaaaataaaggtttgtgcttttttttcttcaacaggagggctcggctaattaggaaattaaaaccgtcgatccctgtttttataagatgccacataggttaaaccgatcacatgacaataaaatatatgaagagataaaggttacaatgggttttataccggtatacacacttacctatgtcttggacaaaattaaaactcacaatttagcaacactatagctagtatatgaaacccaatgctctagagcgtacattgtttaattcatcaactcaaacctctctagacaacgcggcactctttaaaactgtggaattaaactccccataaaaaatgaccttatgttcaactcaccccgaaattattaataggcttatttcgaaatgagagtattacactttgaattcccaaagccattaaaattttcatgctatgcaaaagctttataataagccaaaagaaatttcagaaaaaaaacatttatttcgcaagctgtgtcattgtcatcatgcactagcttgcaccatatgagagacctaccaacaatcttggccgtaagtaaccgggctctgatcacgagaagacagcgtctccagtggcgtcactccatctccagtgagtcatcagcagccaggggcaaatcgggaaacacacgtgcagccaggggcattttcggaaacccccgagcattttaaggcagcaaagagagcattgcatgcatagtgtgagcagcagcttcatcacaccgagctcgcaaaaaacacaatcaatcgatccccaattcgatccccatgggcgccgcgatcagctgctgtggctgtcctcctcgccgccgtgcaggcgcggccgacgacgcggcggcgggactcaccgacgacatcctcgccgagatcttcctccggctgccgccgcacccggcctgcctccgccgcgtctccctcgtcagccgccggtccgccgcgtggtcaccagccgccgcttcctccgccggttcagcgacctccacggcggcgcgccgggggctcccctcgtcggcttcttcagcaaccacaaccatggcccctgggcggacacccgcttcatccctgtcggcgtcgacggcaccggggacagccgtcggagccgctgccgcagccgccgcgccaccgcggcgcgtaatcccggcggggtgctcgccctgggcgacgacgccgagtggcacgtcatcggctgccgcggcgggcgcgtcctcctcctcagccccacgcggctccgcctcctggtgctggagcccatgctcggccgccgccagtacatcccggcgccgccggcgccggagtacaggccggcatacttcagcaacgccgccgtggtctccgccgcggggggccacgacgagctccgcctccggccgcacctgttccgcgtggtgttcgtctcgagcaacgccgccaccaagcgctccaccgccttcgtctacaactcggcgacgttccggtggaccaaggcggcggcgacagagatgtcgtcggtgatcgacggccggccgagcgtcctgatcggccagaccctctactggcacctcatctcgcacggcctcgtcgcgttcaacctggagacgcacgagctgcacgagatcctggtgccggccgacgcgttcgacgacgtgcacgatgccaacctgagcatcgtcgtccccaggagcggcggcggcggagtcggcctcgccgcggtgtccgggtacatcctccagctctggacgctgcgcgactacacccacggcgcgtccacctgggacctgcgcaacatcgtggtgctggacgcgctgctccccctgcgcaacgctcggctgccgccgccgccgcagctgccggcgtcggcgaagccgatgcctctggtgtggttgatggcgctggacgaggatgagaacgtggggtacgtgtggaccgcggctggggtgttcgctgttcagcttgacaccatgaattaccacaaggtgcttggacctgtttgtagggggatgcaattcgtttttccctacaaaagcttctttctccctcaaggtacataacatatatactcctgatcatagctttacttaattttgggcactaaattttgaaaagttcaatgaacctaaattatgctcttggttgaaaataattgttgttttgaacttggctgatatataccaaactttaaaaaatttgactataaatcaattaattatgagttacgacacgctgataattcactagtcagaattaatgatcaacccgtactacgtataaacaggacatacattgtaacaattgtttgtttttataaaaaatcttctccttttgtaattgttagttacatatgtgcaaatcttggtcatataaggacttattagttggaatttgacatgaaaatttctgtttgataaactcaatgaacctaaaccatgtgttcttatttgtaccttattaaatacggatggcgctgcaaagtatttttgcaaatgcttatcgtttgttattggaaacagtaacattcaatattaattctcacgcatgtgcttacactgtttttgtttttaagcagactatatattgacgaaaagtttaattaactgtgtgttttgtgcttttccacatttacttatagtctattatcactttcttaactctaactgcaagtttttgttttggtttgttatcatggttttccattattataggtgtaaatatatatatattaatgaaacatatttcagagcatatctaaatttttcaggtggaagtgcagccatgattatgtaattctactccttcctgggaaaagtaagttgatttatccaactgcatgaacataagatcgagataactaattagtgtttaataatattttgacagaaaatgacaatatatatgcatttgtatatcttgcttgaaaaataataagtttataatattctaacttagtttctttttcaactgcatttagaaagaacagtaggatagtagctcaatatgcattttgaaatagtatatggttgtccatattccacacttcatctttctttttgtgactgaagggagtagcacgttttcaccatgctctttggacagatataattaattcaaacagataagtacaatataaatgaaggctgtatgttgtgtttttacatattacaaatttctgtaatccatagtgcctatgttggatttataaaaggtgaaccacctgaatcctaaagcaatgttttgctagtagtaggttttcatggtttaaaattaggctcttgatgcagtcccaaaatacaattgtgtttatgaaaacaaatgtaagacttggatcggaaaatctatatctatgcaaaattgcatcggaaaatctgctatatctagctagtttgttactataggcacaaaagatatgatataaaagttatactactgcgtacatatgatcgatattgatggtacaccatacaacccatttatatccacgccattgtgtttgattatttttttcctgtttatgttttgttcttcatgtctgttgtatttgatctatatatgtatatatgtatatatatatatgtatatatatatatgtgtgtgtatatatacatatatacatatatgtatatgtatatatgtatatatatatatatgtgtatatatgtgtatatatatatatatatatatataatatatatat

SEQ ID NO: 9546 - DNA, 5149 bp, Oryza sativa
tagcattacaatatgtaaaatcactatattaaattcttggttctgtatctcggcatattttgcattagaaaaagtgggaacatagaggttgcggaacatgcttgagaacagttatattaaagaaatatatataacatgtttatagagtacttaaagatcgacaaattctccccaaatatagaacaaacaataaccttaggctaaatcctgattaggacctatcatcattcaagcatacatatcacttttaagttcacttattacataataataaaattaaggaatccattaaaaacattttctttgagtgaattattgtcacgccctgaactagccccgaacggaaccagcccgtgatgctccaaattaacctgttaaccgataccagtcccaggaaatagagctggtatcacagaaagacagaatatcacagcaatagaggtctctttattatagagtaggagtacagtcatgttgggctacggacagaccccgagctcacaactgcattacaagagaggaaagcggaagccaagatttggacctaacatcacaggcgcgacttgggaaccaaatcgaaaccctaaaactcatcatagctgactttctcttggaagaactcctcatcagcggggtccatctcatcttcttcagccattggggggggaattatttatatagagcaagggtgagtacaggagtactcagcaagtcatgggaattatgtatttaatgaaggcttcaaaggaaaggctgttgtttttacaattgatttttggttaaactgctttttaaaacaactaagtgagtgcttctcaaacgacacggatgagacagtgcatctcgtccggtcggagtatgtgcaatgtatcagtctttgattgattcaagattggcacccggccacaactttcaaacggccacccgggcctagctgatcccgtcagctacagatgttccaaacatcgaactcaaattcccaacagcaatttcacaaagcagtagtcgaacaaaactacgctaaggaatcaccttacatccacccatgaccgtgggcacggctgttcgaacagtttaataacctctgcagagggggcacactttacccacacgacattactaacccggatcacccagcccgtggagaacagccacacctggtgaccttaaggctttcatgacaaggcatttcgagagccgacacaggtttaccatatgccgacgagaggggtcccagaccaacaacaggttaggtcccagaccataatgtgccaggaagcccaggggtcctccccgacaccaccctgtgaatccacttgtctcccggtatcaaggctcccctgattagctaattactcagccaggggtgtcccattccacccatgtggtcgtacttgctatatgtttagatgaaattccaaaggaatcggtccttaagtgcaagagcgggaaaccgtgctcccggcacgtcccccggtctgcgatttttggaaattcatttagttcgcaagcaccgacccaggcgtcgggtttttccaagtcttttgtaaaacccaagttttaccaatcgttggatattttaaatttgaggggaggactccgacgtgcgtgcccgaaggcccgtacatcgaagtacaacagtcgacaaaggaggtttaagtgttcaataattcaaggagggtaattgccgcaattaggattggggccggtaggctatctcgcaagccgcggccaaatttcttgtgttaatcctatccatgcattatttgcggaaaagaaatacttagatttaaattataggtgcaagatgatcaaaggtgacttgccttgctcgagatcttgagcttgatcctcgaaatccgcacactccgggtcttcgggctccgaagctacacgtgaacgagacgactcaacaaacggtgaaattaaagccctattattgtcctctaagcgtgccattgggtagatctcgagatttgaggatttttggaagttgaacggagtcaaacagatgtacggttgagaaaatattgaatttctaagattattggatttttggtctaaaggaaaaaggatttaattaaacccgttgaaaaagaaaagaagagggaggaggaacagacttccctcgggcggctagggtgcggcccgagagaaggggcgcggctcggccgagctaatgggccggcccgcccgagaaggaggcccaaaggcacgcgcggggagagagggaggggaaccggtgggccgggtccacctcgcgtggtcccgagtgggacccacttgtcggcggctcggctcaccatgagcgaggtgcatgcggcgcggtgctagggttatggtcggtgcggtgcacgcgtctggcttgcggtggacgcggcgcgcaagtggcccacgcgcagcctctcggctctctgtgggccgcgcgcacgcgagcggggacggagggagcggctgaccagggtcggcttgacccggtccggccgagctagcgccgacgtggcgccttcgtggctgccacgcgggccggcgggaggaagacgaaggcgccggccgcgaatggacggcgggcggcggcggtttctccgggatgccgtgtgacgacgagggcgacggggtgtacaccggaatgacaaggggaaatgagatggagcgagccaacggctcggattcgccggagggggctgcggattgcggcggcggcaactggcggcgagaaagggggaaatcggcaacggcatgatgggagatcgattcgggcgagctagagcatctacgcgactccgggaatccgtttctagcgtcggattggacggaacatcgccgaggaaggccggcgacgggcggctattactgagcgcggcggtgacggcggcgagcctactgcgagcagcggcagcggtcggggtgtcgcaggctagctacggggagactacacaagctactgctcgagtctaaggggaggaggaagagcgaggagtgagaacggggaggtgttctaccgagacgagacggggcgttgtgacgagaggccgacggcatgggagtgatctctccagcctcgggtcggggaagaggaagaagacgagcgcccgaagtccccttccgatcctagcgcgcaccggctcctccagcgcacgcgacggcgaagggcgacggtgaacagggcacggggcgaggcgacaatggcggaaggcgaaagcgagggagatgggtttgggggaggggctcgggtttatagggcggctatgtcagttcggaaaccgaccttgggcagtcaagccagcgagctggcgccctggctagcggccaaaacggtgacagggaggatgacgctggcggtggaagagaaaagggaaaaaggaagaaagaaagggggcttgccccttgcttctttgggaaaaggagggagagagggtgacgaggcaggaggaggaggagctcttcctccatcccttagaagctagcgcgcggagtggcggggccgggtcgatgacaacggcgatgacggcggggcggtttggaagggcgcggctacagggcagcagacgcgggctcaggtgtggcaggcgctgacggcggcggcgacttgccggtcggccaccacggcgcgcgcgcgtgggacgcaacgggtggcgtggcgatttgagtggcgtcggcgggaagcggcaacgagagcagagagggagggagaagagaaagagagagagcgagctctcactctcgctcagcgcccgagcggcgcatgtgcctcacacgtgcgggcaaggatggaggggagaggagagttgggctgaggaggaaatgggtcggggagaagagatcggcccacgaactcgagggaggcaaaatagacttttcgagaggatttgatttgggacggatttgagattagggtttggatttcgacgatggattggggaattgagatctggaatggcacggacactggacaacaaacaaggagacaattttcgcatttaggatttttaagagatggttttcccactaggcgccacgacggaacgggtgctacaattatgttattttaaggaaaattttgaccgcgcccattttatctctcttggctgagaaacacacatttttctattctcgccgctatacgacacacacagcacagtgctcgcacaaacacacacaagacacacacaaacaaaaaaacgcattccgtagctcattagcttaggtgagacactcatgtagggatatatacagtagagatgttggtcctttgagatagatgcttgtaatacttcaatttcgtgattattaagacacctagcttggtttgaaccaaaattgagttcggatgctcataaacccaatcacgtatggccctcatcacgacatgtttgtactcatcgttatccattagatgcgaggttgtgggttctattcttcttttcctaggcacaaaacttggttttttccagcatcaaaacagcgaccatctcatgatctatattcgagtctgaatcctaatcaggaacttggtgataggaatgggttgggcgcatagcactaaggaatgataaacatatgtggttcttatccataaagaacatgctcgctagcttgtgtttatggtatacctgcagtgttgaagctgatgtaggcaaaaacgtggctgtagtaagcacaagcagccactctctgggtgtctttcgtctcaatgtcaattacgtgcacccctctaccagctgcatgcagtaaaactgcatttgcttcctcaacgaagccaataacatttacatttgcgcttattactgggatcggtgcatcgttatcctggtgaaaatctttatcacaccataagtcactccaccacggggattgactgccactagcctcgttgttgtgctgcattattggagaaattgctctagtcttatcaccatagtcatcatcatcacgatcttcttctccatcatcagagttgtagacgtaatagtccactacccagggagaagctaaaaaaccacaagtcccaagaatgttggcgtgggggtggaaagtagtggtccattggaataatgcttaggatattccatgtcctgcccacaacaatggtatcatcggcaatatccatgcgagcccagcacaatagtgaaccctagtttcccatcct

SEQ ID NO: 9547 - DNA, 789 bp, Oryza sativa
caagcaactagtactcgttgtacaacaaatttcaaacagcgcgtgaactctgaaaaaaatacattaagcggtagcgttaattcacgtgttgcgcgcggaatattagttcgagcgccgcacaacgcactctccttccgattttcctcttttttaccaccccacctttactccgcatcccaccttttctcagttcgcgcgttttttcatttttttaccaccccgcctttcgtgttttttttctctttaacatctcttatccatgcttcatcataggacccaataaaatattaaccatccagattttttttccttctctctaggttttttgttttcacgttttagtaaaatatttaccatttagtttttcattttcagtttttctagtgtatccccacgtttcaaaaataacgaatttattgtgttgagttttccatttattcctagagtaacaaatttactcgaatgaataccctcttctaaagtaacaaatttacttgcacgaatacccccatataatacgtgcaccattcctaaatgattataaaagaattactaccagcttataacgctagttattcatttaccagtgttataaatattatttaaactagcatggtggcccgcgcagattacgcggctagcatcattatattttctctcatataatagcatatatgttttctcattatattatttaaatatattaaaatgacagcataattttaaattttgcaataactttacaaaactactcatgtgtaatatccatattgtattttatatacgtgt

SEQ ID NO: 9548 - DNA, 2058 bp, Oryza sativa
  unsure (1)..(2058): unsure at all n locations
ttaggctccgggggtgggggggcggcaccatatactaagttttatgcggagtcatgtctcatatacagaaggtattccggataaggaagaagaggcagagttctatatgaaaactacaaggactactcatatcatatccatacttgtctctctcgttctacttagacaaagagatatctgtgaatataaatacaagaccccctaggagaaaaggggacacagtcagtcataatagacaccaatacccattgccaaacattaacatcaaaagataagcctaaacatacccaatctaatattacaaaggccgacaagagggatctagcgttatctctaatctcgccaagttcatattcagaaggaagactaccccatcatcgactacgcgtgggttccataccgccaagtggacgatgactagataggttatcctaaattgtacttgtgtgatcctgatgaataagaggaacaccggcttcggccaacaggagtagagccattaccttacaaataaggggcccgaacttatataaaaatccctattcccatcttttttacctcaatctcacgcataccccggtaccaacaatcctcatactctgcaaataccgtagtcgtcatctacttagtcaacagaaatacataaatttcttagaaattttcaaattgatttggtgctcacccaaggaatattgcatatctgcaacaaaaagggtgaactttagcgtgtttcaaactttcaatcacaatattttagctgtttataactcaccaaagcaatcactatattttagttgattatagtgaacaataatcccgtatactatttaggaactaaccaagagataattctcacaagataaatctgaattactcaggaagaatattatactgaaatcagagtataaacagaataaaagaactgagagaagattaccgacaactccggaattcttccgacttcttctactctactctcttcctattctattacacaatatagtataatagagcctcttataattcagctcaagcttggaagtgtgtgtagtgagggagtgaggtccatttatagggcagttatgacggttgtgagaaggggaaatgtccgaactaccccgcaaccgtcatcagggagtgatctggagcgtccatgccaaaacctgngatcaacggcgatcaccagtgttcggacgaactgtcacgcccggaatttctatccaaaattccaaacgcttacatgtgcgtgaaccctcgtccaggaatcagccgaggcacacaataacaaattgataatagagtaccattattactctaattaaataagcgaataaaatgtcattacagaggtagatagttcctctcaatcaatagagatctaagcagcggaaaaataagataaacggcgcagacgactccactccacaggcagcttgaccagggctacacctaatcctccacaccatcagcatcattgtagaactctttctctgatgaatgattgcaagggggagttttttgacctacctcagccaagccaccccaacaaaatatgccaggtgcacaaggataacaaaaggatggccatagtaggggtttcattttgcataaaccagcatttaataaaacatttcagaatttaataaaacagttaagtaatagacaatattaatccaacgctatacaacataccctgttgtataggccaaccattctgaacaaccatcccggctgcacagttctatctccaaaccaggaatataccattccaaaccaggagctaatcaaattattaccaattaaagcaccttttattatgatgagaagggtgagactaatcacgaaagacattgttagacccgcccataaccgcgggcacggatattcgaatagttttactctgatcaggagtgtaccactgtacccacaagacacagccccacatcatgtcaccatgtgctcaatacctccacggtacctcggaaaggagctgttacattacccctcgtacaacacaacccactacagtgcacctttcctggatcataatcaccccct

SEQ ID NO: 9549 - DNA, 786 bp, Oryza sativa
atataaatatataaattagtttatctatacatgtaggggactccatgtaagtttttgccctcggccttaaaccccaggaccggtcctgttcaccggcgccatattctccgcgcgcgatccgagttcatggcggcctcggcgtgtgcaaacagaggatcctttggagctagctgggccctgctggtagctttagcgtgcgatttctggagagaaatagatggattggttggactagttggtgtggtgtgtggacagtgtggtgtactgttcttgtgggacaaaagaagcagaaagaagagcaaaaatgttatcgcttgatactttgatgactcgtctagggtgaggtgagtgtcggtaattacagtgccttctacaaacaatattatccttttggatttggaggattctgaaggtcaaggtgctggtgcttgagacgtcagctccatccgaactgggataaaggcccttcaaactttcaacttttccattacatcgaacttctacacacgtaaacttctaacttttccatcacatcattccaatttcttcaaacttccaatttagagcgtggaactaaacacattctcaagggtatatccgcttgtttttgcatgtcacttaaaaaatcatcaaaagatttaaaaaagatttatatgatagatcaatatgtgatagtgtcactttatagattggcatattcaaattccacttatacaagtagaagcgaaaataataaatctgactatgaaaagaccgagtaattcacaatcaattttttaagtgtat

SEQ ID NO: 9550 - DNA, 442 bp, Oryza sativa
acacattccgacctaacgaaagcacgaaaagtgacaatgcgaaaaatagcgaaaaggaaataaagcacatctatattaacttcgaataaataatcgaagaatacaagtcttacaacatggtacaagcaaagaaagcaatggctttacaacctagcttacagataaattacacctttgcccccacatcaatcctcactccctaaggaatggtttggcaaattgggttcgtcatcactactaatattatacatgaccctaagaggggaagggggcgaaacacagactagactataacgacgctaggagatcgcctcctgacgattggtcatctgatggtttcgccaaaagcgaaccatgtctccagaccttctgtatgaacatggtcgtagtcttccagggttcgcccggggtgcgcccgcatccagccgacaaccttcaaaac

SEQ ID NO: 9551 - DNA, 676 bp, Oryza sativa
aatccaagaggtctaatgtcctgatgcagccttgaacgacgccgacgtagacgatacaattgcctggaccggcggaacattggacttatcccttcgccggagatcgaacaccgatgcagctccacgtcatgtgccaagtcccgccggacgataaaacaaagtacaaacgtaaagtggcaatgcgccgaattgtattgatcatgaagatagattacatagaccccgggtgtacatatttatacccatgagttgatacaagtccttgtcggacaagaaaaaaacttttctaaagataaaaggaaactaacaaactattcctaattaatagataacttgccatgccgcattctctttgaactggtctcttttggataagcttactttagtagatcaatttccttaaccgaatatagcatgaatccaacaactgacgacttggcaactctcatcggctaatctcaggacttcaaagccgatgctgactctaagccgatgactactccgagcttaccaaatttcaccattaacacatccccccctagttctggagtacgagaattcatgcttcaaaatttcttgtcttgataactccaaaaccaatcttcctttgcttcttgtaatcggctgtcatgagccgatactgatgtgctccaccatgttgaaactgatgcgcttg

SEQ ID NO: 9552 - DNA, 1487 bp, Oryza sativa
  unsure (1)..(1487): unsure at all n locations
cacgccgtcgaaaccttcgtcaaagcgtaagactaacggtttcaataacttggtaagatctctagtagttagatggtgaaatattaccagctttgatggcatttctagcggccacacggaagtcctcgacgatctggactatctcccctgtttccagcctttgaggtgccgccggggccaggtcatcggtatttccaaaatagctgacttgaggtgttactggattatctgtgtttgaattcggggcatgaagggaagtttatgtgaaacaataagagcatatataccgtaaaatgttctctttccaatactcccttcctagagaaaaaaaagagttgtaataaagaattaaacatgttaatatacccgttgaaaacacgcgaccgttgtgccagatttggcagaagaagagtgcgcccttggcgtgcacggcatcaacgatcggccgccaggcctcgatttgctcctggttccaaagtccaggcgcgtctagggacgacggaagcgtgtagtggctttcttcagcaccaccagcattcccgctctcgtttaggcgtgacatgaaccaccattttgacaggttattccggtcatttacccctgattcagttgctttgacaccatctgtagctgaattatagtctgttaagttcgtgccgaaaagaaagccacggggacctggacgctggccgtggattggaccgttcgcagcgtcgtccttggatcgtcccaacgcagcgtaggagactgcgctggcctctgcaatgaggagggcgcccggcgtctccctctgcgcgtagtagaggagattgtgtggctggggcatgctcccatatgatcnntgaaccttgataccggtgcatgtacaatcctgtaccaccgccgtaagtttccgtaatgaattttagtaattttttcacggatttgctagaaaacttcccccaacagcctgtttggcaagagaagggaagatgaatgggagtttcaaggagggagttggtggtatgattggttatgggagttacatttttagttcccatcccttgtttgcgctgtgtttattcagcgcaaagtttgggttttgattgaaattgaagatgatgtgactgaaaaattgtgtgtgtatgacaggttgatgtgatgaaaaaagactgaaatttagatctaaactttgaatctaaacacagccttagtcgaatcccaccaagtttcacgaattaataggcctcccccaggtaagagatttgtaggaattggacctcttaattccccatctcaaacactctcaaatcccaagtcttccaaccaaactacaaccaaactacagacttaaacttccagatatcataaactcccattccccatcaccatctccctccaaccaaacaggctgcaagttcttttcccccaaaaacactcagatttgtgaccatcgtatcacctcgagatttgtgcacgaatgaaaaaaattgctagaaagaaaattt

SEQ ID NO: 9553 - DNA, 388 bp, Oryza sativa
ggggggccgcctgcaaatgggcggcggggggctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataacctcaaatctagattacgtattaccaacgaataggctt

SEQ ID NO: 9554 - DNA, 189 bp, Oryza sativa
gagcttttgtacttcgcgtacgctcgacgggggcttcatttgctgaatggaatcgattttctcgtggttcgcctcgataccctattcagaaacaagaaaacccaacaactggcccgcgcgaacaccaaaaacacacttctcacgatataatttcatacccgccgcgcgtaagttgtcgaaggtttcctg

SEQ ID NO: 9555 - DNA, 324 bp, Oryza sativa
ccttcgccgtggcgaccgtgtttggcctctgcccggacgaagcggcaggagccgaaggtggcagttgcggcgccggtgccgaagccgatggtgctcccctagcttcgcccatggacgtcggaggctctgctccttcttcggcggccatctcctctcctgcttcggtctcctttcgctttgcgaccttcttcttcacgaccctcttcggtggcattcgctctcaatgatttcgctcggaggtccccacggtcggcgccagctgttgtcgaaacgacagcggcatacgtcgaaagtactcaacagtggttggaaaccagtaaagtg

SEQ ID NO: 9556 - DNA, 745 bp, Oryza sativa
agagatagttttcccgctaggcgccacgacggaacgggcctacaatgtggtagggaaaaatcaagaaacatgcacactttagctccttctgggccccatacataagaaacgatagctttattacctcaaattcgtacaacatgcatgcaaactcaattttcatgcttaaatgcaataatattacaagtaaacgaagggtctatgattacgtgatgatcaatttgaaaattttaatttgtgttaaacgatgatccatataaaacgaatggagtattttatactagttggtccattatgcggcaaagccgcgtctattttctagtgttgacctatcttcaggggagtcctagagaagcgtcagaattgtcggtgctctctcctcgcttgtactccgcggatgcttcttttaataaagtaagtgttcgggattttcttttttatttaatttactacttaagtgagatatatattcctatcgttgcgtgtttgtcgcttagtatttatgttgagtgctttagtactaggactttgtaggaaaaaggaagttcctatacgaggctagagtaatcaataacttaggtgtgttgtctaggttagcgattacctttgtttgttgtgtgctctctgaaaagtgaggtaggtagtaggtgatgatagcgctgttcatcctttgtatccctccatatttggacacatcatagagctacatgccggactcagcttggtagactggggggagtcggtg

SEQ ID NO: 9557 - DNA, 1024 bp, Oryza sativa
  unsure (1)..(1024): unsure at all n locations
tttgtttataaccagactgagccacaaactaaaccttacccactagacatgtggaagtacggtagtgctttgcaacagaggcccgaagaccggcccttatatggccgaggtgctactatcaaaaccatgcaccccgagcccagcctaaaaccattttggggattttgaatgagggggaggtgtgaatccaattccacaataatccaacaattccatagtgtccaggtgataagagtattcccaaggtctagagttgtaaaaccacctaatgttgcctaattaaccagcgaagcagctacctaaaatcatactagtggtaccatgagtggagtgtccactagttggggttttgtttaatctagggtgaacaaggtaataataacaataacaataataaggtcataacaaaggtaactaggcatggctagataaaaacagtgataacgcgggaatttaagaaaagcgataatgcaataatttaaatcaaaataattttataaactgggattcaatatgctcaaggataatgtgacttgccttgctcgctttcccaaacgtcggcttcaacctccacgaagagcggatcttccgaagctgcagcgtctacacgaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9558 - DNA, 581 bp, Oryza sativa
cgcccgaatagcgtgggacgggtgggaacttgactgggatgggattggacggatcttgattctcccgctcaatggtagcctcttttcaccaccccccttgttcgcggcaccttgctgcggctatggcgtggcgaagggcgaagtcatggcttgcgcgtgaggttgggccacagtgttcggcggcccgtctccgaacggggacgcttggtgcgccgccatggatgggtcgaacgacggctgggtccatgccatggcgacctggtttggcgcttggtttgctccgaagcctgatgtcggttcctgtggtcgaatggttggtgcttgagcagtgttgatgaagtcgaactgcggtccttgactccaaggcgaaaccctcgaaccaggctggctcgacggcaaccaactgggtgcactttggccggccaggtggtggcgggtgtacttggatagtgaccggctgagcctgcggctgcacataaggggtcgggtgtattgttgcggcgaaggctgcccggcgaagtacactggcgctggcatggcttgtgccggaaggggctgaattaatgcttgtgggtggactt

SEQ ID NO: 9559 - DNA, 781 bp, Oryza sativa
  unsure (1)..(781): unsure at all n locations
ttatatttcatctttcagtcttgtacatacatgttactaaaagcacttttgccaaaacttgcaagggaacttcagaattaatgcataagtacataccaattcatgctacacagcaaatggctataattaaatctatgcaaattgatctcactatgtgtgtggggtcctcctgattggcatttcatcaagcaggatgccggagagggtacctgcataccagggcgtgctggaagtgggtggttgtgttgtcccatagtggacttggaactggaggggggcgcaggtgatggtccccagattcctgggttggcgacgtgtttttctctctcagtttgcagttgttcttcagtaacagagtgggagaatggagtggtcgagctgtgaattccacgaaaccagaagttcaagatttggcctgcacagaaggattcatctcatcacaatgcanattgagagaaaaagaaacatcacaacagattacctgttcacgcaaagatctgatgtttgccatgtttaggcggaaggcataactggcttcgtcaacagaatggacacggtgggcttggagtgcggctgtggaggtctcgacgcttccacctgtgtggaggtggtccgcaacagtttcaggcgatcgatcttattattttatctgccgatgcaactggagagaaagtgatacagcttcagctcgccgatctccttatcccttctatatgagagacagctaacgagcgaggagatatcaaacatatatagaagtgaaaatcacaattagctttca

SEQ ID NO: 9560 - DNA, 766 bp, Oryza sativa
ccggttcttatctaccctattttcccaccaaaatgactgtagcaccatggtacatggagtaaaagtgtttgcattgtccactatggtgaaatcctttcatgccattatttttttcttttaacaaacgatatacggcattattggttaccagcatggcaatcttaccctggcaaataggttcatatttgaaaatatgtttatagagcatttatttttaaaattatagtctgtttgtcctaaaaatttatgccgtgaatttatttgtaacgccccgattttagaattttagaattaaaattccaataagtttatcagtatacaattgtttgtagatgctcttattaatttgtgatttctagaataaactgtatgtttggatgcacttgttgctgacaagtgggagaaattttattaggatcaatgacagctagcagtggacgtggtacaaacgtcccagcgggccgcgagcaggacacacatctatgaaacgcactgttgatagtaaagagtaaattacgtctacagtacacaaacttggtaagtgggtgcgatctagtgcaagaatttaaaaaatgattatatagatgtaacaacttggttagtacgtgcattttggttaaaatatctctcttccacaccatactttttcagctatgtaaagaaaaagcagacagttaggtcatcttgagttccgaataaagttttagatgtattgcatttgcttggttataatactaaaataacctattatttaaaattagaaaaa

SEQ ID NO: 9561 - DNA, 527 bp, Oryza sativa
ctatcatatttgactattctttttctgtggggagatttaccaggggccatatgttgtgcatacaacatttctttgtatgtagaccaactaataaatatcactgaaaattctagaaacaactatacatattcttccaataatattacatatatttctaaagccctcacctcaaattcattatattttagccctaaaaaaatctaatagtttaaagagtataaaattgtcggaattttttctttcttgctccctatgtacgatgaatttgaatatgagacactcacatatatgggtgtaatcgtcagggttttggtcatcgaatacatctatgaagatggttacaacacaaggacacaagttataaccctccaccttgacgctatgcgcacatatgattcctatcaccaagttcctaattgagacatggactccgactcaggtcatgagatgaaggctgttttttttcctggagtgcaagtcttgtgtggagaagaaggataagactgataacgatcagtataaacatg

SEQ ID NO: 9562 - DNA, 384 bp, Oryza sativa
agaatcgatgatcttttcgaccaattgaccggggctcgtatcttctccgaaattgatctgtgattaggattttcaactgaaaatcgaaccggaggacattccaaaaactttgtttacctctcgctacggtttatttgagtataccgaatttcctttggattgaccaatactcgtgctactttcatgaatatgatgaatacaattttcatggagcatcttgtcaaatttgggttggtattcatcgatgacatccttatttactctaaaaatgagtaagagcatgcccatcatctgcgttggtgttaaacaaactccgtgaacatcaactctatgcaaaatactccaaatgtgaattttcgttgaaagaagtttctttccttggcc

SEQ ID NO: 9563 - DNA, 612 bp, Oryza sativa
aaaaccgtgaagtcacaatgtcctgtagcaaaatttcccttttctaaagcacttggaatggtgtggtgtgatgaaggtagggtgctacagtaatttaattagattaatgggagagatagttttgattggaatcatgctatacgtacgacccatcattcaaccggcgtaccactgaaacggagagcaacacattgcgagacggcgtgatgattcgtactgcatgctgctgacgccgcgtacatcgacattgtagtcatctgagagtcggatgttgggtcgtgtgtgtagcattttccttttgattgtaagcactggtatcaaataaatgtcactccaagaaagattggaaaataaattttggtaggttctatttatgtagatggaaaaaaaatctaaattactcctaacctattgcgaagggctgaaattgccaacttaaacaacaaaacaggatatttgatatcccaaactctctaaaccaacgagtaacccctaactcaatctgaagcggttgtgtggcgcatacgtgctaacctagtcaacactaaaaaggtaaaataattaacgacccccctataatataggctttcttccctggtcttccaccctacc

SEQ ID NO: 9564 - DNA, 1148 bp, Oryza sativa
tcccggcgacgagaagcgaaggcgagagtggcgacgggtagcggcgacaccggggatcattttaaggggttggagagcggcggcgaaggcccacgacgaccggcgacgcgaaggaaacctcggggttcggaggaaagagaccgatccgattcgacctcgaatccacgaacttccaaaacgattttgccgatgattccaaaagagaaaaggtagaggagatcccgaagattgttttccctcaattgatttcaccggaaacggaaagacgcggccgaatttggaaggagacggcggcgccgctcggctagggtttcgggcggcggcggcgcgacgaagacgacgactccgacaggcgggccccacctggcagcgagcgagggcacgcgcgcggctgcggcggactgggccgacttgggccgaggagagagagaagggttttgggccgactttcggcccaaagccaaaagagacttttaaaaacctttttcaatttaaattattcatgaaatgcaattccatttattaaaaatacttccttagctcaaataaatcccagaataatctaggaattatagaattaagcaaagtatttaatgaaattttatctggccccattttatattggaatttattaattaaaattagatcttctcttctaggcttttaaaattatttctaaaaattccaattaaacaacaatttatatatttaggattttcagggtgtgacaggtttcacccccacccctcaaaaggcagctggacaaccggacaccccggccgacccaactccatcacgcccaccctcgccaccggtgcctaggaaagggttgagctatacctcagatcaagcagttacccactcccgcttgtggtaagcacggtaagtctcccagggtttcctatgaaccggtccttaattgccatgggtgcgaccagcaaaaccatgcacccacaacccaccattcggtgtattttaaataactaacaccattgcggtggcaccaatccagaactatgctcatagtcaaagtctatgtaataactaagcatggctgagcatttcctaaaccaacatctaatcattttgataccccagttatcaatggcatatggtaaatgatatatggctgagtaataggacccatc

SEQ ID NO: 9565 - DNA, 607 bp, Oryza sativa
tggggattatcctgatttccaaaagttggtgattaaggctattcgtcaggaagacaagtcaccagcatggagcaaaagaaacgccggattgctcaattcaaaacacaacagggaaataatcagaagccgcgtcttactttaggaccgcagtctatgccacagggaggttcttcgtctgttgttcgtccgcagcgtcagttcttcaaccaacaatgctggcaccaacatccgcaatcaagctccacgtcctgttgcagcttctacacagcaacaacctgccaaaagggagcaaggcagcaagcccgtggtgtgtttcaactgtggagacccaggacattacgcggacaagtgccccaaacctcgacgcgtgaaggttgtccctgcccagagcaactctaccgtaccagcatcaaaggctcgtgtcaatcatgtcgctgctgcagaagctcaagatgctccagatgtgattttgggtacatttcttgttaacttagttcctgcaacagtgcttttcgattctggtgctacacattcattcttatctatgagttttgcgggaaatcatgggatggaagtagaagatcttagacgtcctttgatggttagt

SEQ ID NO: 9566 - DNA, 420 bp, Oryza sativa
atactccattcaccctggtagtaccaagaggtaccaggatctcaaggaaaaattttggtgggcaagtatgaagcgtgaaatcgcagaataggtagcagtatgtgatgttgtcagcgagcaaggcagaacatcagaaacccgccggtttgctgcagcctttgaagattcctgaatggaaatgggaagaaatcggtatggattttatcactggtttacctagaacatcatcaggccatgactctatttgggtgatagtcgacagacttacaagtaggatatggtctaactaatgacaaatataaaatttggacaactttgtacctaccgagaatattctttaccccttaccatgaataagttcttaaaataaacacatattaaacaacaaatatatgatgcaatatatctgactatctaagt

SEQ ID NO: 9567 - DNA, 668 bp, Oryza sativa
gggaaaaaatcacatgataaattatccagcgcgccaatgggcacgccaataggcgcgccgattttctaatgaatactactactgtccttcagttgggcacaagaaaaagtttacttctcgttttcgctatcaacggtgtgtttcatattcttctcattttcgctatcaacggtgtgtttcataaattgtgtactgtttgcaggccaggaaggacctcgtaccacgtgcagtacagtcatactcctaaggccttgtttagttcctaaaaactttttccaaaaacataatatcgaatctttgggcatatatatgaagcattaaatatatatattagattatgctaaaaacttgaaaaaaatactttgcatttttgaacaactttcaggactgaaaatcaattttaataaaagtgaggttatttgtttgggagaagcaaaaaaacaaagaggagtacagtaagatcttcactttcaatataggtaatttgcctataaagtatttgggtataccgattaataaaaaatgaatcatgaataaagactggaaacagactgaggagaaaatggaaaaaagggtaggatgttggcagggaatttgcaatatataggaggaagagtaactttgataaactcttgttgagcagaacacctctatacatggtggctttt

SEQ ID NO: 9568 - DNA, 633 bp, Oryza sativa
cgtgcacgtcgtcgagcgcgtcggccggcaccaggatctcgtgcagctcgttcgtgtccaggttgaacacgacgatgccgtgcgagatgaggtgccagtagaggatttggccgatgaggacattctgccggccatcgatcaccgatggcatctcggtcgttgccaccttgatcctctggaacgtcgccgagttgtagatgaaggcagtggagcgcttggtggtggcgttgcttgagacgaacaccacgcggaacaggtgcgggtggagctcgtcgtggccccccatggtggagaccacggcggtgttgctgaagtatgacggcctgtactccagatgacgatctttacaaaggcatgatgggcccaaccatcaaggtgataataacgcaaagtgataattttctacaaaaaatctaatatggttccttattagtagtaaagaacatactcccaatcttgttacttccaaaagaaactcatgtagaggcacttttgtagaggtccctctaaaatcaagagtttgaaaagtagagacacattttagagacattttaaaaatgcctagaacacttttactctagagaaacttttgagacatttttagcatattttttaaaattctttctcgtagtg

SEQ ID NO: 9569 - DNA, 306 bp, Oryza sativa
aaaaatgaacttgaaatcagtggtaagtagttataccataagctgagaagatagtggcattaggaaataagtgagaagctccagttatcaattcactcgacaacccgccaccgccattgagaatctttgtcacggtcatcccgtggttcaatatcttctgtttcctgatgtaccaaaacttttaatcagtcaccaacaaattgttcattcctaggcttccagaatcatattgtatcgccgttgtcataccgagcataggatagtaggtcagccatgattgcaggaacagtgatgaacgaagtcact

SEQ ID NO: 9570 - DNA, 1073 bp, Oryza sativa
catttttagaaattattttaaaagcctacaagctaaaccctaattttctaggaaaattttcaatataaaaatgagctagataaaattttattaaatactatacttgctcctctattttctagatttttctgggaattatttgagcaagggaagtatttttattaattgaaacaacatttcacaaattgttttatttgaaaaagttcaaagaaacccctccctaagccgttgggccgaattcggcccaacatcctctctcttccgcgcggcccacgccggcccagccgccgcccgccctcctctctctcgagtcaccgacatgtggggcccacatgtcgggctcgtcttcaacctccggccgagccgcccgagccgccgctttgccgccgccttctacctccaaatccgcctcaatccgaccccgattcctccgggtttttgaggggttttgttcctctcgttctcctctttcttttcccccaagaatcggagcgaatcgttgaggatttgatccgaatcgagttcgttttgattttatccctaaaaccgagtttgaattttttcccgagtcgattcctctcgtttggagtccaatctcttcaatctaatgctttataaagcatcccctcgtcgtcctctcccgtttgccccctttcccgtcctctcccgtgccccatagcgccgccgccacgcgcgccaagctcgccgccgccgccggccgtcttcggcgtcgtcgctgcgccgcctccgccgtcgccgccgcttgccgccgccgctgataggagcgccgtggtgaggagaagctcggccgcccatccttctttgccgccgaccgccgtagcccgccgtcgccgcgcaagccgagccgccgccgttgccctctcgtcgccggccgtcgtcgtgcatcgtttgtcgtcgtggtgagtaccatcgggttcgtctcgatgtcctctacgcgtaggtgtcctccaatcccccggtcgaccgccctagttccggcgagctccgcaaaccctaaccggccgccattgctgacgtcagcatgacgtcatcatctcctttttcttttcttt

SEQ ID NO: 9571 - DNA, 1085 bp, Oryza sativa
accgtgacaatttggtatcagagcaatttcgatcctggagaagccacgatatacttcccgtttgcaacttcaagtcgaagcgatggagaagcagaacattgatttcggcaaggtgttgatggagatctaggagtccttggtgaggctgaatcgtgctcaaggcgaaactcaagcagcggtcgtcaagctagatcgcgaagtgagcagttggagacctcaagtagaagcagcagttcaggagttgcgtgaggaagtcggcgaccttcgtcagcaactggatctcgtcggcaaaatgaagcaggcttctccggcgacgtcttcccctccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctagctcccgtattggaggcggagatcgtcccgcgcctcgttcagcacggcggtggcaatgagggcagcctctcgcttctcctccacctccctggcaatctccgccagctccttccgacgggcctcgagctctcaggtgtgccggcggtgtgccttgcggcccgcctccaccatggcctccaccgagcattgcccctcttcgacacgcgctcacgccgcgtcgagctccgcccgctctgcctgcaggacctccatctgggcatttaacccatccaacaccgtggtgttcgcagtggccaaggcttgcagaaggggctccgcgctcagtggggcagcggaaggcatgggagagagccgcctcggtgagaatgccgcacggctcggcccgccgatcgacgtgccggactcggggacgtcccccgaacctggctcgtcctgagcgtcgcccgaggagtcgggcccgagcggtgcgcctgcggcctagtcgtgggtggcctcggaagtcatcgtcgcctcgggcggagtcgggtcgggggcttggcaggccgcctggcgtgcgcgtgccacctccgcctcccgggcggacttctcggcccggcggagcctggcctcctcccgagc

SEQ ID NO: 9572 - DNA, 1867 bp, Oryza sativa
  unsure (1)..(1867): unsure at all n locations
gccgtttctttttccgctccccctcgggctgcggcgttggcgcggcaccttccgagcgcctgctgntagcacgcaccgccccgccccctcggggaggagatggggaaggggtaccctcctgcttcctcttcccccgggcgtcggcagggcggctgccccccgggcccccgtcgcggggcccagaagcacgaccccctcctggggtagattgttcccccctgcggctcccgcccgcgccatcgtggcctcgaggagcccgctcctccgacgccccgaccgccatcatgatggtcaagatgttggcgcgatctggatcgctgcagagggggaggactccttgggggatgagggacgcctccacggagctgagattcagcacccgttggaccaccatcttgaaatcctcaggggccagtcccatctgcccccctggtgggtcctcatgtagtccttcgacccggtgtactcccaggcgccccgggcgcgccgctggagcggcgcgatccggcgacgaaggtagtcgtcgtacaccatggcccccgtgagcccctaggatcgcaggcccgccaggcggtcaaggacggtgtcgtagccgtctcccagatctaccggcacgcgccagctggaggcctgcgccgggggctggctcggaagtcggaggcgcgcttcgtcggcgaggggggtgtagaaccagtcgctcttccagtcgtcccacttcttgcgcaggacgcagggaatgtagcggctcagcaccggcccccgcggctggaagtagcagccaccgaccaccgacggcggcgacactggctgtacggtgaagaaccaccggaacagccgaagagatgggcgcaccccgataaacatctcgcacaggtgtgcgaagatggccaacgtcattaccgcgttgggggtgaggtgcgccatctggagatcataatgctccagaacatccatgaagaaagaagagaatggcgggactagccctgccattgcaaaagagaggaagaagacggaccgccccgggtaacgtggcgccgggcgtccctcgcccagcgcgaccatctcccggccggtggcagattccggcatgaagcggcgcggtagcccagcctgcctctcgctcacgatgcgggaaggcggcagcacgctaccatcgagcggtgcggagccccgtgccatgacgccggcagaggaggaacttgagaacgagcgagtgcggcgagggtagggcacaggaaacgaagagttagagcgcaagcggcgaaggcaaggggaataatggcgagaggaaggaaacgaatctcttcctcggcgtctttatacccttgccaacgctctgcccggctcctcgcttcccgcgcccactatctcgccccctcgtttcttgcgcccacgcctctgctaatcccactcgcccgtttgcggcgcacgaggccgtggcagtcgagatgggacatatcgtgcgcgcgttaacttcgctcgccgaccgaagcgccatcatcacgtctccaggcgaaacgaactgactcgtcccgattcgcgcgctgctcgagtgatgtggcagtctcgaagaggccgctcattattatcgatcagttttccctgccaatgcgtgcgacttgcgaccgctgagttcctacccgcctgtagagaccggccccacctgtcaccagatctaaagaatggcgtcacgcccgagcgcttccctcgaggggggcgatcgccctggcgtgacgccgggggctactgtcgatgacatggggccgagggtatcatgactagaggttagggtagccgcagtcacccacgtggcccgggtcgggcccgagggtgacgagacctccccgccttttgtctccccgagggg

SEQ ID NO: 9573 - DNA, 969 bp, Oryza sativa
  unsure (1)..(969): unsure at all n locations
cgcaaccattgcaaggaagtcgttgtatgaagaagggcagacatgcagcttgctaaactgacacgtggtggacaacaatgaccggtctgtgactggtctgacgctggtcatgtcataggcagacaaccgcgcacccattttgcacctccttccagcggagtggaggtaggtatgacccatcccatcggagggtcattcggatagcagccattgcaaatctccgcccattaatgaaggaatgacagggtgatcccctatgtcagacgagtgaggacgctgggccacactcaaagacaagctatattttagcttccaagagaaggcgaacggggttttggtcaagagagggtgggtccccacccaaaagaagagtaggtagaagtggagcatgtggtatccccttgagttataaaaggaggaccttgcccaccaaagagagggacggagaagaaaaaaggggaaaggaggagcaaacgagttctagagtctaaacttgttctagctctcgaactctttgtagtttcttcatacacagatccaccagaacacaggagtagggtattacgcttctcagcggcccgaacctgtctacatcgcccgtgtctcgtgcattgcctctctcgcgaatattccacagaccgagggcttagaacctcacttagcgcccccggccgaaccggcaaaggggggcctgcgcggtctcccggtgaggagccccacgctccgtcagtactaataataatttgattgatataatagacaaaagaatccaacttcttcgcaatgtacactccctgcttcctttagtgtttagggaaaaaaagcatgcagaaaacatcaatttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 9574 - DNA, 583 bp, Oryza sativa
ctgctaagtccccgtcgcccgcggccgccccgccgctgcgtgccctcgcatccagctcccttgcccgcgcctcgagctcagcggtccgctgatccagtgcggccctctcggcgcgggcaccttccagattgcggcgcgcttgttcctcccgcgccgcctcgcggagggacaggctgtccgccagcctttgcgccgcggcctcggcctcctcgagagctctctcccgctcggtgagcgcatcctcgcggaggcggagtgtggactcctcttcggcacagccggcctcgtgcgccgccagtgttgtctcccggatggcgacggcggcctcgcggtccgccaggtccctctccttcgcgcgggcgcgctcttccagcaccatggcgcgggcctcaagggcttcttcgcgccgccgggacgccgcctcggtcttcgccgcccgccgttcccgggcagcggcggcgtcaaggaccccccgggcggcgtcgagcttctttcctagctccgccgcctaactcccgtattggaggcggagatcgtcccgcgccttcgtcagcacggcggtggcaattgagggcagcctctc

SEQ ID NO: 9575 - DNA, 674 bp, Oryza sativa
accgggaggtcgatatgacctagcggccaagtgtgccccggcgtcacaccgatgatcggttgggacggtcggagcaccatccccgggaccttgatggcgtcgaaggccgcgggggaaaggatattgagggctgcgcccccatctatgaggactcgccccaacttcacattgcaaatggtgggggaaaccaccatcgcgatctgccctccccgggcaacgcacggcgggtggtcggtctggtcgaaggtgagggtaacctccgaccatcgtgcccgccgcgtcgcctcatgggtaggggcagcggccaaaagctctcgcttcatggccttgaggctccggcgagaagcgtgagtgcacgctcccccatcgacggtggcgatggtggccccaggtcgccatcgtcgatgtcctcggtgggtcccttttgcttggcctcacttcgccggttgccggagggagccgccggggccttgccctcacggcgctcctgcctcctctcctcttcccacttcctcgtccgctcagccaaacttttgaccgcgcggcagtccgcgaggtcgtgaagggaggtgttgtgcacggtgcaccacttgccagtcgggcgctccctgctgggagcgccggcctccttctttttgtcgctcgcaggcctcccctttcgggtggcccgcgaa

SEQ ID NO: 9576 - DNA, 552 bp, Oryza sativa
tatctcctcctctccttttaactctctcctcaaccttatttattcctctccttatctattcttctccttctcctctctacactgcagcggtggggcgaggatgccaggccggggcgaagcggcggcggcgcggcgtgcggcaaggcggcggtggcctggcggccggcgcaagggcggcgaggcggtggtcatcgacggcggcctgtggcggcggggcgcggagggccggccggccggcgcggcgaggcggcgcctacgttttcagtttttttttctttttttttttggagaatctgagctgagattgttgtatgatgtatttgatttgtgtgtgatgtgaatatgtgatgaattttgtagaagttgtgatgtaatttttttttaagattttatgatgtatttgagatgatcgatttgtggatttggaggcaatttgaggatgattgttttgggattttggggacgggatagggtgaaatcaatatattaaaaataatgaagaaaagaaaagaataaagaagccactagatctgcctctttagttccggttgg

SEQ ID NO: 9577 - DNA, 1703 bp, Oryza sativa
cacgacttagtagatcaaacttaactgatgcagcactaggtatgaaaagaaacacaatatctagacaatcaagccgttgactgattttcagggtggtagatgcctaggctaatctaatctagcaacgcgatttagccgataccggcagaaaccctaaagcgagagacagccgatagagctaaattgatatgctaagactagattaacagagacataataaataggtaggcaaatatatcatccaaactagagcaatccaagaggtcgaatgtactgatgcagccttgaacgacgccgacgtaaacgatacaattgcctggggcgacggaacattggacttaccccttcgccggagatcgaacaccgatgcagccccgcatcaggtgtcaagtcccgccggacgataaaataaagtagaaaagataaaaggtggcgatgcgccgaattgtattgatcgtgacgatagattacatagagcccgggtgtacatatttatacccatgggttgatacaagtccttgtcggacaaaaaagaaactaacctaaaggtaaaaggaaaacataaagtccttatcggacactaaacacaccttcctaaagataaaaggaaactaacaaactattcctaattaatagataaactgccatgccgcatcctctttaaactcggtcacttagagataagcttcctttagtagattgatttccttaaccgaatatagcaggaatgcgactattggcgacttgataactctcatcgactgattccgagatgctgcagccgatgatgtctttgccgattaccaaatttcactattaacagaacttcaatgttcgtcccgagcagatgctgcagccgataatgattctaagccaatgacgtctttgtcgattaacaaatttcactgttaacaaacttcaatgttcgtcccgagcgctccgatctctggccggttaacgcttgtcacgcctagatatttagcacaaatttccagactattttgtgtattaaatccctgtacaggaccagccagggtacacaaaacgacaagtaatttacagttccaaatgtaaataaagcgtaaaatacttatagaagaggcacttagtcctcacaccgaaaagaaagcagtagcagcggaaaaagcgatactagcggggcttcagctccactccacaggcaaaactcaactggtgtctgagccttggtcttctaacttcgtcttcggctcagaagctatacacttcttaaaagggggaataatagcaaggctgagtacaaccaccgtactcagcaagccacaccaatgatgcagacgtgcaaggggaacgcaaggatgatttgtggctatttgcataaaggcagttgtaaaacattttgttgagcaaaacagtaaaactgttgaataattaaggtaatattaaatctccactgatcaacactacaccacgttgaacaggcccaaccaacccacatgaactacagtgcattgggttgatttattaagtgtaagactaatcacggtgaatctggtcaatcgcccataaccgcgggcacggctattcgaatagttttactctggccagaggtgcacaactgtacccacaagacacaatctaccggcatgtcaccgcgtccgcgcagatacgtcaccatgtcgagtgattgtgataagaccctccgcataaccctcccctaacca

SEQ ID NO: 9578 - DNA, 390 bp, Oryza sativa
ccccgacttcgtccatctccatctgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcgtaaaaccattttggggattttgaatagagggggaggtgtgaatccaattccacaataatccaacaattccatagtgtccaggtgataagagtattcccaaggtctagagttgtaaaaccacctaatgttgcctaattaaccagtgaagcatctacctaaaatcatactagtggtaccatgagtagagtgtccactagttggggttttgtttaat

SEQ ID NO: 9579 - DNA, 758 bp, Oryza sativa
tctatacactggcatctatacagtggcatctgtctccaccaatccatttcctaaccacctaaaccaaagctatacccatgagtcgaaacataccacaaaaacaaatggattcaaacccaatcaagcattgcaattagaggtggctgcaactggtcaataccttcaccgcacggcgacttgcgggtggtgatgtggagcaccttggtggggatcctgacggggcccttgacgcgcagctgcttgtccttggcgcccttcaccagatcagcgcaaactgcaaccataaacacacgaatcagcttcgcgctctcagcaaaaaaaaatccgatctaatctaatcctctctgaacgacaacgaactgaaactatagaagaaaaagagaaagaatggattacccttctcgaggttcttgacgttcttggaggagagggtgatgcggatgcggttgagctgcagctcccgcgcctcctccatgccgagcttcccgcccttcatcgcgccgccggcgccgtacaccgcagccgccgccatgtttgcttcgcctcgcctcgcgttctccgctccgctcgctcggggggtggggttggtggtgctcggggatggcggcgcgggtggcgttagggtttcggagggggcggaggttcgctcggaagggccatttatataggagatgatatgggctcggcccaactctaactaacctctgaatgggctgtctctcaaactctcactctctcttcttttggctgtctgaaat

SEQ ID NO: 9580 - DNA, 631 bp, Oryza sativa
tgcacaggataacaaaggatggcataatatagctcatttgcagaaacagcatttaataaatatttaagagaatagtaaaacggttgtataattaatcaatattaaataaacaccacacaacacacccatgttgcataggcccaaccacatttgaacaaccaaccccagttgaacaaattaaacctcctaaccaggaattatccattccaaactaggaattaaattaattaccacattattaccattaatgagtagtgtgagactaatcacgaaaaacattgctcaactcacccataaccgcgggtacggctattcgaatagtttaaactctgaccagaggtgtaccactgtacccacaagacacaaccccacatcatgtcaccatgtgcctcaataccaccacggtacctcggaaaggagttgtgacaataccccttgcacaacataacccattacagcgcacctttcctggatcataatcacccccttataaacaaggtatggactccccagcgacccccatggacttctcgccacttctcagtctggcgcactataatgaatcacgctatacaaaagataaagccgtgcccacgctggcttgtggttggcacgataaatgtatcacaac

SEQ ID NO: 9581 - DNA, 704 bp, Oryza sativa
cgctacgtgctggtggaagagaccctctatcggcgcgcggctaacggagtcctcctgaagtgcattcctcgggaataaggcgtcgagcttcttgccgatatccatgaaggcgagtgcggagcccactccgcctcacgcaccttggttggcaaggcctttcgccagggtttctattggccgacggctctcaacgatgcggtcgacctggtccggcagtgcaaggcgtgccaattccacgccaagcagactcatcagctggcccaggccctgcagaccatacctctttcatggccatttgctgtctgggggctcgatatcctaggtccgttcaggcgggccccgggcgggttcgagtatctgtatgtcgctgtcgacaagttcactaagtggcccgaggcttatccggtcgtcaagatcgataagcactccgcgcttaaattcatcaagggcatcactgctcggtttggggtgcctaaccgtatcattacggataacagcacccagttcactagtgaactcttcggtgactattgtgaagacatgggcatcaagctttgcttcgcctcccccgcccaccccagaagcaatagccaagtggagcgcgccaacgcggaaatcctcaagggccttaaaaccaagaccttcaacatcctcaagaagcacggcgactcgtggatctaggagttgccagcggtgctctgggc

SEQ ID NO: 9582 - DNA, 607 bp, Oryza sativa
cccagtcagcgaataaaataaaaaattccctgggtcccacctgtcattccctaggggttatctctcgcgcacaggccacccactataaatggccaaaaggcccgaggcccgaaggcccggcccacggcacgaccttttggcccggcccaagcatagcacggcccgactgggtcgagcccgtgctagcccagcccgaccgccgtgccgtgcttgggcctccccaccggcatgctgggctggcctggcacgatcaggccggcccggcacgatgggccggcaggctaggcccggcacacaaagtatagggactaaaaatagacatataaatgtcatggtccaaagaaaagggacctaaaatagacttattttatctatttatatcacaacccaaagaagagggaggttaaatagactttttgagctatatatgtcacagcccaagaggagggaggaaaattagacttattctgagaaaaagcacgatggaccgtcgtgccttcaggccggcccggcacagcccgagtcatgttgggccatgtgtgcggcccgtgggccggcacggcacggcccggtgcgtccgtcgggccgtgccggcccgacaagcctt

SEQ ID NO: 9583 - DNA, 34186 bp, Oryza sativa
  unsure (1)..(34186): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcgtttaattaacaggagataaagacctatagtgggactgccttgtgtctgcacaaatgaatgaacaaatctagctaacaacaaaatgttaatcggtaaaaattgaatgttaaagaatatatgtgtaacttcaatgaatgtctacttattatgaataaacacacctagaaaacaaaacagagaaacactcgtggaaatgtagtttagttgtagaagttatacgacgaatttataaggcttcagttgtaaaaactgcatgacaaatttaggattataatcatccttaatggcatatattctaataagtgctgacatattatagtttgtgtataataaaatgttgcttcatttttaaaataccatgcagttagttctggtgtgatgatccaccatagctaaattttagtgctagatctgccattgacacaacatattaaagtccatgctacaaatctgtagtcctctcatcttttattttttttccgcatgtgtttatatttgacttatttttttccgcatatatttataagtgacttgcagcctactatgatacttgctctaatacacttccctgattgatggttacaactagcacttgcatacggcccacggccctaggctgtcactgccaagaaattcgagtcaccaatgggccgtattgcagtgtaatatctccgtctcaaattatttactccctccatccacaaaagttacacctatttcacatttgatttttttcaaataagttgttcctatttgtagtctttatgcattcaagacttaaatgaagagataaattaaatgttttattagaacccaaggagtcatctaaatactcattggttgcatgcttgtattcactccttgattttacaacatccgaggtgatttaatttctccttggtcttggtgttaaaagtaatatgtataactattgtggatggagggagtattttttaaggttgtttggcatatcctaaagtttaaaacaaatgactataatacccttataaaataatttatggttaagaacaaattactataaactttataaaataatttatggttgatgatagaaaggtggttgagaggtataacagtgaaaattttgaatggaatgtggatggcgccggcggcgtccgtcaccgcctccaccgcacgtcgcgcctggtactgcgcatccacaaacctcacaccaccaccatcactagctcaacaacaataaaaaaaaagtgcagtaatcaatcaaaacgatgatatataattcacctcgccctcggcgtgtgccttcccggactcgaaggatcgctggatgttgctccacacgcctgctgccgatagatgatttgttgattgattactttctttctgctagcagtgtaaatctagacgaaaaacaatcttcttgcctgctttgttatatcctgattcgatttgtcaggattttgggtggcgatccgtgaatcaatctccgctagctagctcattcttaagttagatggcccataaataggagctgtaatcttttcctttacatcccatggttttaatcttataatttttcttctgctctatcaataaaatttcgcaccgtcttatgcgagtcgttaaaaaaataagaaaaaagtacgaattatccctccccctgaacaattgcggtagtacgatttaccccctaaactacaataccggacatttgacaccccaaactcttaaaaccggataaattataaccctaacttgattcaaagcggttttaagcctacgtggcacacacgtggcgatacacacagcaaaaaccgctgggacccacctgtcagtgttttttttcctctccttctctgcctttctctctcggtgaacagaggaggcggccgcgggcggcgggcgaggagctgaggccggcgcggagcgagtgcgcggaggcggccgcgaccagcaggcgaggagtcgaggccggcggcaggcgggtgtggaggcggctgcgggtggcgggtgaggagccgatgatggcagccggtcgaggcggaggcgggtgcgggtggcgggtgaggagccgaggacggcagccggagggggcgaaggcagggtgacgggcaaggaaccgaggacggcggtgggacgtggagtgaggcggtggcgggatcctccttcccctctatcgcagcggcgcgggctcctccttcctcctcgtctcgtgccgccgcccactgaccgcctgctgtggacagttcgtccgtctcggcttcctctctgcggtgtgggcgcgaacggcaacgactcggtggtggcggcggtagtgggggaaaggcccatgggggcggcgagggtcgtcgctgccctgtacgacggtggcgctcgcgctgtggctgggtggcatccgaggagaggggggggggtatgataggtgggcccaagaagggttttttttggctgactggattgctatgttggcgccacgtgtgcaagctcaattcaaaaccgctcaaaacagtattgaggagggtaattcgtccggtattaaaagtttagagtgagtaatatctggttttcggatttagaggggtaattcggtcgaccgcaatagttcagggggggcgataattcgtactttttccaaaaaataaataaataggagctgcaatattggattggagaatatgaatattcacatggccctttcgaaagcttggttttaatcctgttcatctttttcattcttaattttcctactcggataaataaataagagtaattaaccgagtgggctgtttattcacatgctttcaaattgcttacattaatctacattatctatgtctaatccttacagaaaatggttggttggttggtttgttacaagctcaaaattcttacattttttagaataatctacatacatgaacaaatcattaacatgcagcagggccgggtcctcaggctcaggcctagcccaatacggaaggccgtaggcccgaaggcgaacagatgcgccaccagaacgcgcaccggcgcacgcgccatgccgcgattgccaccgcctgccgcccacgtcttctgatctcctcctcctcacggcgccgaaatcgcgtgcaatccccaggtccagaggccacgcatcggcgccgactccgcggctcacggcttcccgttttccgctgctccgcgcgacggcagtagccagtaggccacgaggtgctggtgcagccgctgccggttgcctgccgccggctcccggctgccccctcgagattggacaaggaggattctattcaggtgagtgcaacaccaatacatcaatacatcatcactaattttgtaacattgtgattatatctgttaacatgtaaatagctatatatgtgcccgtgtactgatgtatagtcctatattagggcaattcagttgtcccgatagttggacaaactgacgaaggcactagttgtgtttccggctcatttgcggtgcgcatctggacgctcgcgataaactatttggtaagattctaaatttagatttgtaattttgtagtgtaatttatatgagttaaagtactataataacttttgaggtaacatatgttttttatataaatattatttctaaatgcaatttaaatgttaacattaataattcagtatatgtatctattgattattattatatagtatgaaagggcctctatatttactttcgcgctagggccctgaaaagttaggaccggccgtgttaacatgcaccgcagaaaaaaagaaagaagaaagaaaattaaaagaaagaagaaagaaaatggacacagctagcttgctctttttttttaatggaaccaacacgagagtgtgccttttcattgaatatagtgggagaaaaatacagcccctaggggcaaagaaaaggcaaaaaccaaaaactgtacactatacaaggtgcgggataagctcgcgcaatctcttagcacccgctaacgcccacatgccagcttattcttttatttttgcaatgaggtacattaatgttgtggcctctttgtgctcaaagattcgccggttgcgcacattccatatttcccaaacaatgtggaggatcagggtgcgtaaccccttcttggggatgcccgccgaagcggctagcatttcccaccaatctttgattgtctgggtcatctcccaatgccagagattgagctgaacccagtccgctaccagtctccaaatccttttggaatatcgacattccgcaacgaggtgaaacgccgtttcatcctctcccctatagagggggcgctgcccgttgttctgccatcccctgtttgtgagccggtcagaggtccatactctattctagatgatgagcatgcatgaagcttacattttccagacacccaagctctccaaattaatgggtcaaaggtcgtgtcaagcgtgccaatgcactgtgctttgtaggctgacgaagccgagtactacccgtgagttgtgaacttccatgtgatttggtctggttctccttcatccagatgcatgccatggactgcgatccatagtgccacgagctattccacaaaagtcgccgtgatttgcgggtttgtctccgagaccaaatctccgatccagtcatcgtttttcttcttggagattgcatagaggcatgacgtcttttgggcctgcggccgtccagctagcttgctcctagctaagcgtacgtagtcggagactcggagtccggcgtcgtgctgaacaccggcttgtccttgtccacaaccaccgccgccgccggagtgggggcttgggcggcggctggtcgccatagcttcttcacggcgatcacggcgcgcgtgcgggggagctgatcggcctttttagactacaccggtggcgcccatgcccaccatggagcacaacccgaagcacggcgggagcacgccgccgcacagcccggcattgccgtcgagctcgtcggggttgatcgacagtgggcagtagctgctgctgttactgctcccttctgacaaggggattattggttctttgtttggcacatgtccccagtagaatgtcactgctattaccacatcagattgaagacaacaaaagcaagtaattaaatgggttaatacaactaaggctgccaaaactgtcaagaggataaactgctagtggttagcgattagaagtaaatttggactgctgggttgccatatgtctacaagctacaacaggcgcacaagggaaaggagcactttattctatatttcatcaagcaaaaaacccttgcatgttcaatattctaaaaatcggcgcagtcatcacctcggtggtttttaggtgcctgatggtgagtccctgctgccctaatttttctcaccgtcgagcacctagctaacagccaccgatgcagcaagggctctcaacggcgagagatatgtaaggagaaaaattaggccctaatcggcgtgctaggcagggtagccgcatttacctctaaccactactacaaaatcctaataggggacgtgtgcagatttctaaaaaaccatcacatttaacctcttcacaatcttcacatgagtctaagattaaaaaacgatactgacatgcctttataggtgcaagtttaattaaaaaaaccagcacatataaatacatgtgctattttttttaaaaaaaatcagcacctagaagaatatatgagtaccggttttctaaaaaccgacacgtttgtgaaagccgagccgatgaaaaccgagctgacctaatttttcttctcgccctcctcacatatctctcaccattctcactgctctccgatccccttttctgtcctcgttgcctccgccactcctccccctctcttttgctacctccttgcctccgccgaccctccccctctcctccacctcccttcccctgtcttccgtcgccccttctcctctcctcctctctgctcggggacggccagatccgccgccgcgtgcttagggacagccagatccgccgccgcacgctcgggggtatccggatccgccaccacaagcacggggcagcccatttaacgactactgtggctccctcaactccctcaaccaccgtgtgcttgggggcggccgaatctaccaccgtgcacacgaggacggcctactcacaacagcggcttcctcaactccctcaatcgccacaggcacaggggtggctgctcaacgacgacggtggctccctcaactccctctttgtgttctcctctgtgttgttaattttgctcttgaatgttgattttataattgtgttcttggatgttgatcgattttagggatgatggagagttgcttgatgcatcggctcgaatcgagcaacctttgttttggattcgggactctcaaagatgtcggttcctaaactggcacctaagattcctcctcatcagtgccacctatgaggtgccggttggaaaatctggcacctacgtaggattcccaactggcacccattagggtttatgtagtagtgaatgtttaattattagtatatatcttggtttgaaagtaaataattgtatgtaaattatgtttatgcaaaagttttcaaaattgaatttgttgaaactcctacctttctcaccaacgaacaataggttggcacttccaaatgatgttttgcatggacaagattggttgtgaatgattgatctacgaatgctaaaaggaaattgtgcctaattaggagtttgtaaggctgttttagcaagagataaattcttataatcgcaagaaaaaatctgcacctgatttcttactcttcttgccatatagtacctttacatgtttgactgattccaaattaattcccaagacgcataagctttccaattaatctatactactactacaaagataaaatatatataaaaaatgtcctccgtcccataatatatgtgcttttgggtggatgtgacacattctaaaacacattcaanagagnatgtgtcacatccaccaaaaaatccctgagtactttcttagtgtttctatattatctaaaaaaaatatgctatttgttaatctgcactatatattaactgcagggtcatcgatcatcattggacaccaattaagcaacagcaatggcgtcgaggagcatatcaagctgcacaactgagacggcaaaaggcatccacaggttcgagatcttcagttacagcatgatgaacaccgaagccgaagacgactccatccggtccggcgtcttcaacgtaggaggattcgattgggcgttgctttactaccctgacggcatcgacgacgacagcaagggctacatcggcgtctacctcgagctgatcagcaagaacggcgagccatgggcactcgtcgacgtgaatctgatcaaccagctgcaacccgggcaacctcgtcagctgttcaccaagaccgatgtgcctaccccgttcagatcttcaagctttcaggagtctaccttggggtctctcaagtgcatgaagaggagcgatattgagagcactccagggttcatcgtcaatgactgcatcgtgatcgaatgcaatgttactgtcatctatgagccaaaagtgtctaaaaccagggcattgtgtgacgctgaaactagttcggcattgcgcgagatcgaggtgcctcctatggagatatcgtcggatttcgccaagatgttgaaggacggtgtaggagcagatgtgacattcagagttggagaagacacattccgtgcccacagggcggtgctagctgcgaggtctccagtatttcatgctcagctctgtggaccgatgaaggagaagaaggagacacaaatgcaggagataaccatccaagacatgcagccatctgtcttcgaggctttcctctatttcatctacaccgattgtgttccaagaatggatgatcttggcaatggtgagaagatgcatttgatgatgcatttgcttaaggccggtgaccggtatggattggagaggctcaggatcatgtgcgagagatttctagctacgaacctcgacacggagcatgtatctgcgatactgggtctagctgacttgctagatctcaagaagctcaaggaagcttgcatggagttcatggtcccatctgagagaatggatgccgtggctgcaagtcaagggtaccagcagctgaagagagcatttccctctctggcgtttgaagtgtgggagaggaggagccgtgttcgcaggaattaattaacatcttcttgattcagaagatatatgtgcgcgatgtctggagatttcctttttggttatgtttgttttggtacatttgatgatctgacgaatgttctctcaacaatgtgatgactgatacggtgcacgcgtggttgcaccttaatgtaatgtggctatctggatcatgcaaatggttttacctttagatcgagttgttttttaaaccttactctcttaccaactctcttaagtttttatgctagaaatttgccccatcactcctttttatcttaaattgcccatgagttgctactcgtgttttgatatcttgtgtgttcactttgatactatttttaaccttgctaaattttgtcattattaaaattcggcaatgtagcaaaccaaacacactatcaccaacatattcctcccaaactgtagtagttttattaattttcgctataaaaactctaaataaatttggtaatgtgcctcaaacatttttttttaaaaaaaatgtgtctcagaaaatgtgctcaaacatttagtttgtctttagcactaccagagtgagacacacacacacacacattttggttttccatcgaattattatccaattccatatgaatatcgatctgatcgaacttgtttgattaatctattgcaaaatacttggagtcctccgtgtcgaatggaccaaatctccatatatatagccgcatctacaaaccacttttttatgagaaaatgtgacacacacacacactttgctttcccgtcaaattcttatccaattccatctgaatatcgatctgatcgaacttttttgattaatctgttgcaaaatacttggagtcctccatgtcgaatgtgacacacacactttgctttcccatcaaattcttatccaattccatctgaatatcgatctgattaaacttgttcgattaatctgttgaaaaatacttggagtcctccatgctgaatggaccaaaactctccatatatagccacatctacaaaccacttttttacgagaaaatgtgacaaacacactttgctttcccgtcaaattcttatccagatccatctgaatatcgatctgatcgaacttgtttgattaatctattgaaaaatacttaggagtcctcagtgtcgaatggaccaaatctccatatatatagccacatctacaaaccactttttcttatccaattccatgatcgaacttgttcggttaatctgttgcaagatacatggagccctccgtgtcgaatggaccaaatctctttatatataaccacatctacaaaccacacgtagattgaattggtaacaatggagacggcgccgtcatcgtccatgtcaccggccagcggcacgtacgtcttggacgtccacggcttcagcggcctgaggaggcagcactgcggcggcggcggctgcatcgtctcgccgacgttcaccgtcgccggcctcgagtgggccatccggtaccacccggagggcgacgccgacgaggtgaccgacgacgtggccgtgttcgtcgtgctggtcaccaaggacgccacggcgtgggcgcacgtcgaattccggctgctcgaccaggccgccggcgagatggtcaccttcttcggggagaaggatccgatcttgttcgactccggcagcgaggacctgtccacctggggcaccggcgagctcgccgccaggagcttcctcgacggctcgccctacgtcgccggcgactgcctcaagatcgagtgcgccgtcgacgtctgccgcgaccgcctcacgttccaccacgacacgccgccctccggcgagccgttccgccagtaccccgccgacgacgagccggccgacgtcaccttcaagatcgccggtgagaccttccccgcccatgtctccgtgctcgccgcccgtgctcccggcctgctcaacaacacgacgtcgcaggcggcaaccatcaccatcgacgacgacgacgacgacacgccggcggcggcggcggcattcggagcgctcctccacttcgcctacaccgacacgctccccgtggcgagcggcctcgacggcgccggccacacggcgctgctggggcgcctcctcgtcgcggcggggcggtacggcatggcgaggctgggggcgatctgcgagcgcgccatgtgcaggagcctcgacgcggggacggcggcggacacgctggccatggccgacggcacggcttcgacgcgctgaggcggcggtgcgccgagttcatggcgtcgccggacaactactacttcgtggcgggaagcgtcagccatgggcgcctctccccttcactccggcgagaggtttggaacaagtactatgacacgtgttgcagcagatacgaggagggggcccacattctgacagcaacaaagattaagctaagcaaaaaaaataatacagcagacaatgtggttgatatatgattcagaaattgtaaatatgtagaaagtagtagaatttcttatttacgatatagcgttattaggacaaccaaaatattgtttttattggtcaaggacttttttatccaccactttcaatggtgagttactaataggcaatgcttaatgtgttttttttttttgctttagtacaccatgctagtatatttctatttagtagagtatacattgtttgcttagagggtgtttagatcgcgcggggggggggggtggtgttaaagttttgagcgtgtcacatcggtcatcgagtattatttagggtgttgcatagggtgtttgggcactaataaaaaacaaacaaatttattaatcctaattaatccgtcattagcaaatttttactgtcgcgtaccacattgtcaaatcatagagcaattaggcttaaaaaattcatctcacaaattagtcataatttgtgtaattagttaccccctccatttcacaatgtaaggcattctagcatttcccacattcatattaattttaatgaatctaacatatatatctatctagattcattaatatcaatatgaatgtagtaaatgctagaatgacttacattatgaaacggaggaagtatttttttagcctatatttaatactacatgcaggtgttaatcttacttaagatgaatttggccgattacagaactacctaagatgaattttactgtcttggttttttttccctttgaaatgtggctattgagtaatactaatcaatataagtttggcaattaccgcttgcaaagtctgctttgtttttgtagctgacttgtaaaaattatgggcagtagtatttttttttccttgatgaattgcaccgcacaatctatagactcttcgtgcacctcaatgtcgtgtaaaaatgatggccaaactagaagaaagagagggaaaaaaaagagagaaaagaatggacgcttcggcttcgatgtctgacaaatacagttaaattctctcgacccctcttgttcttcaattttaaaaaaattcaaaaaatcttcacatcttgagattccaaacttgctactagtatataaattcctccatggtcatcagctcgatcggtcactctcagcaagctcgatcagattcagagatggcatcgtctcgccccatctcggagagcaccatcacgaggtcgacgtgcgcgacgcggacggcgcgcgccacgcaccagttcgagatcgtcgggtacagcctcaagaggtgcctcgccgccggcgagttcgtccggtcctccgccttcgccgcctgcggctacaggtggtccgtccgcgtctaccccggcgggttcgggccggcgcaccgggagttcgtgtcggtgttcgtcaagatgatgaccaacaggggcaaggcggcggcgcggttcgacctccggctgatcgaccgcgccaccgggctgccccgctcggtgttccgggcggcgcagccagtggtgttcgactactccgtcaagcacaagaagtgcaagggcaagcggggcacccgcgcgttcatgcggcggcgcgacctcgagtcgtcggcgttcgtccgcgacgaccgcctcatcgtcgagtgcgtcatcgacgtcgtcgtcgccaacggcggcgacgacgacacggcggccgcggcgtcccccctcgccggcgtgccggcgccggacctgtcgaggcacctcggcgagctgctggagcgggcggacggcgtgggcgcggacgtcacgttcgacgtcagggggcaacccttcgccgcccaccggatcgtgctcgccatgcgctcgccggtgttcatggcatcgctgtacgggtcgatgagggagcaccgcgcgccgcggatcgccgtcgacgacatggagccggaggtgttcgacgcgctcctccgcttcgtctacagcgacacgctggcgctccccggcgacctcggggaaggcgagtacaaggagatggtgcggcagctgctggaggcggccgaccggtacgccatggacaggctcagggtgatctgcgagctcatcctctccaggagcctcgacgccaagaccgtcgcggcgacgctcgccatggctgaccagcacagcactactgcgacgcgctcaaggatgtttgtgttcagttcatggccgttgggttggatgaccacaattaatgattgatatttgaatatgatactagttgagtgcccgtgccttgctacggggcaaaaagtatgcatccattttaagttacattgaataaaataatgttaagtaatcattaagtgtaaattataacaaaaccttaatatagccccacattcaaagagaccactcaatctccacacgcttaacctacaaaattcatgtttatgtaacgttgcaaaattgataagaaatgtatacattaccaaattggatcatctagccataaatgacaaaaacaatgtatacctttcatattgcccttccattatatcgatcacaataccttttaagaactatcaaccatctgaaaccaatgaaaatttaaagctcctcgcaacactaagaacctctatccaaaatagtgctacaaggggatagaacggcatataaccttataggtttcccttattggaaggaagtgtattttttgcaactcaaggtgatggttatttgcaagtgcttcaaattactgcgcctaagttgatctagatcggctatggcactcgagcttgtcaatgaagaaacctttaggctgagttcgtttcaaagggttcccaacccctgtccctcctccgcgcgcacgctttttaaactgctcaacggtgtgttttttttaaaaaagcttttatacgaaagttgtttaaaaaatcatattgatccatttgtttaaaaaaatagctaatacttaattaatcatgtgctaatggaccactccgtttttcgtgcacaggagatttgttcccaacccaccccaacgaacacagccttagaatggtatcgaccaactatgggcttctcaatgatttgtataactgctagacaactcactcataccagggtctttattctagatgctcagcaagaaattattagaacaaagcttaatattacagtccaaaaaggtacttacctgtgtaccataatgatatgaaaatccttgcgctgcaaacataatacagaggaacattgttaaaatctacaataatgcatccattgttaagatatacaaacacaggatgtatcggtgttaaaactaagggactcaaataattgtttaccagataacatatttgtttgaatcatgtacagatgacatcgccagttctcaacaaattaaagtaaagattctagccctagcacttggggaaagcatacacagaacagatcactcctaattaagtctcaactttaaggaagccaatgtttatgtaaatacataatgtattaaagacattttccctgggttacatctagcattctggcaaaagggctataatattcagttgaatgactaataaaaacaaatattttcagtgctgtaagcagaaatcctttggtagtaatatagatatgctggcacgatatcttacttttcaaaaaagtgacaaaagattcaatgtttatgtaaatacataatgtattaaagacattttccctgggttacatctagcattctggcaaaagggctaaaacattcagttggatgactaataaaaacaaacattttcagtgctgtaagcagaaatcctttggtagtaatatagatatgctggcacgatatcttacttctcaaaaaagtgacaaaagatttaatccgagataaggatatactgatatacagagctctaaaacaatcaaagagaaaaaaaaggagatcactcagctaacacctcatttttgccttcaaagaggtggagaaatcaagcaataaaacactgcaggaaaacaagccactacactcttactaccttttttgttcatgtgaagaagggattaggccattagggaaagtcagaaagagataaattggtggcaaataaacttactcagattttaacatgaaaataaaccaaagaaacaattttgccaaaccatatgctattagcaaaattgctctaacatatcagcattacacacgtacgtctcagatgtttaggtaaatatccaaacttatcccctataacatgcagtgatacaggcaaacatgcaggagcaaaatatttccaagccattgacttacagaaaatcagccaaccggtttgcaagcaaatctctgctgctctactgtcactccaatgcatcagttatcaattcaatctgaaatacgtgcagcatgagcataacttgatgaacaatatataggatagataatctgcagcctatcagttgctttccattgtttatttcatatgtagcagatgtagaaaaaggaggtaggggtgacaacagcgcaagaaaattttggagcagtagaacaccatcgaacacaacagcaatgactaataagatggactcacattcatggtgctgactctcttcctgctctatcctctggaactgcctaatttacctgaacaaaagaagaggaattaacaaagagaagtctattaagcataaaagataccgaactgtggtggaggggatggcgaggaacgacacaccggccagcagcccattttcaggcagaggattcagatcgagcgtcagcggtcggacttggagatggatgatttgcctgaatgccaggacacattgcagcctttcaatctagccgcgtgcgcaaaccctagggtcctctccagccgccgcagtggtgcatggacctccgcgtgccagtgtgccacggtgctctagcgaccatactaaaatggtaaaacctcaccgctgcccactcaaggccgcctcctccatcgttaccgaccagatgaatggagcaacggtggcgacggtcagggagatgcggcatggatgccacgagcggtgggttgtggcgtcggcgacgaactccactcgtgagcgtagggcacagcaaaaatggcgacgatgccctgttgcggtggcggcggcggtcgagggcggcgaggagggagcacggggcggcgatgaggcggcgcggtcaagggacgcgtgggagggggcgcgggtcgcgggggcatcgaccctttttacgcttttttccttccggatcgcatgtacccttttttttatttttgtcgctccaaaacgtgtggatgtacgtttctatgttggatcgtgtgtctattttagcttcaccatcatcaatccgaatttttttagtagtagatatttgaatttacttttctactataaagattttgttgctataaatatgatctatgagaaaataatagtttagaagatggtatcaaattaaactgtggccttctatactgtgaaacagcgtaactactcaggaattagagtttgaccgggtcttataatgtctgacaaaggtcctacttagtactccgtatatgaataaaactctagtatatgtttgtcataccgaataaaagtaattagtttctatctatatctctaaacttacttaaaatctaagtcacatatatgctcttatatataccggcctctaagattcaatacaacaagtcaataagtccaatattttcggtataactctctcgatctccctatattattcaacactctttatagtactcacggcgctgctaaaatcaaattgtgataggttgatctagggtttccttaataattaattaattaatctctcccacacctgcatcgcaacgcgtgaatcgatcgatctcacagcagcaagtgatctgattagcaatgcccatggagacgacgacgacgacggcgacggagtcgatgagcaagatggagacagtaagaggaacgcaccggtttacatttcacggctacagcttgtgcaagggcggcggcgccggccggtgcattcgctccggcaccttcaccgtcggcggctacgactggtgcatctgcttctacccggagggccagggcggcggcggcggcgaccgggaacacgtctcggtcaagctcaggctggtcacccgctgcgccacggccaccgcgttctacgagctccgcctgctcgaccaggacaccggccgcgccgccgccgtcgcccgggcctccggcgcgcccagggtgttcgcgtcgagcaatcccggcacagcgtgcttcggccgccgcgcgttcatggagcggagcaagctggaggcgtcgcccgcgtgcctgcgcggcgacagcgtcgtcatcgactgcgccgtccgagtcgtcgtccacgaccccgtcgtcgccgccgtgcggcgccgcgaggcgccggacgacgtcccgccgtcgaacatactccggcagctggtggcgcaggtggagtccgagggcgccgacgtgacgttcgccgtgcagggggagacgttcacggcgcaccgcctgatgctcgccgcgcggtcgccggtgttcaaggcggagctctacggcgccatgaaggagaaggacgccgaccacgtcatcgccatcgtcgacgtgcagccggccgtgttcaaggccctcctccatttcatctacaccgacgacatgccacccgacctcggcctcgccgccgctgacgacgacgacaccgacagaatcgacatggcacgccacctgctcgtcgccgccgaccgatacgccgtcgagaggctgcgggtgatctgcgagcgcgtgctccggcgaagcctcggagtcgagacggtgatcgacacgatggcattggccgaacagcatagctgcggcgagctcaaggaagcttgcctcgagttcatcgattctcatagcaagcgaatcgtggagagtgatggttacaagaacctcaagagggcgtgccctttgctcgtcgcagacatgtgggagaggatcgtcctatcacgtctagagtaaggctgtgtttagatctaggggtgaaaagttttgggtgtcacatcggatatacagacacacatttaaagtattaaacgtaaactaataacaaaacaaattacagatttcgcctataaactgcgatacgaatttattaaatctaattaatccatcattagcaaatgtttactgtagcaccacattgttagatcatggagcaattaatctcaagagggcgtgtccgttggtcgtcgcagacatgtgggaaaggatcgtccgatcacgtcgagagtaaatattaaaacattgctcatgcaatgttgagggtgatatagccatgaacattaattagcgagatttggttcggtccaacaaaaagtatctttaaggtaccggtacctcacggtaccaaatcgtttttgatctttggatctaacaatgcacatcttgcctagctagatctaatgatcggaaacgatttagtaccgtgactccgtgaggtaacagtacctcgagaaactttttgttggactgaagcaaatctcttaattagcgatgggtttatcaagctcttttgatttaattcattttttttctaaaatggattaatttgttcaactgagttagagtaaagtatatatgatggcaaatctgctgcaaattttaagttggtatttgttgtttacttcgtagttcatacggcacactagagtgtgtcgggatggaatcggaactacttgacaaggtgtgacaagctcgataacaataactctcgaatgttctcatcttggtaatgtggcgatgatgacttctatagagttgggaatgatgacttgtgttgactcacatcgcatgcttttttaattttcgcctttctacagagtttatcggttttccctatggttttaatttggtcagctttcctcgttaactgatcgccctttttttctctttagtgggtttttagttctttgggtgtaaaatttttgaagtatatggacgcacatttaaagtattaaacgtagactaataacaaaacaaattacagattccgcctgtaaactgcgaaacgaatttattaagcctaattaatccatcattagctaatatttactatagcatcacactgtcaaatcatggcgtaattaggctcaaaagattcgtctcgcaatttacatgcaaactgtgcaattggttgttttgtttcccacatttaatgctccatacatatatccaaacatttgatatgatgtttttggctaaaattttttgtgatctaaacaaggccttaatacaaaacagaaactctctaagctcctaagtttaacaaatcctcatatggaaccattgttaggatgaaaataagttaaatacacaatgtacttcgattataattgggataaatatacggggacacatttattgaaattccatcagccaaattcaacccaaatcagactaaatgaatcatatccgtgctgaggagaaactattactctcaaggggacatccactcgtttgcatgtcatccaaatagttatgaaaaaaaataataaaatttaacaagatagattaatatgtgataaatctgatcaaatttaacttccacgagttgcaaaaaaatcatacattaactagccaaaaatcattgtttgctagacactccctatacattaactagccgagactaattgggcccaaaacttccgtactcagttcggcccagcccagtaaccaatgcctccaaagtccgatccggcctccctcatcgtgatttgtgacgtgcagggtaccaagacactattccaaattccgttccgacacgtacttaccgtgcgcgaccaatacatacacacatctccgccacacgtgcacccgcacagatcgccgccgccgcaaacctcgccgccggcagcgtcgtagctacgcatcacgtaattaatgatgatgatgtcctccgcggcgccggctggccatcacgccggagaagagccgccgccgccgtcgacgacgaggagcaccatgtcgacgtgcacgatggggacggtggagggccaccaccggttcgcgatccgcgggtacagccgcctgagggcgctcctcgccgccggcgagtacgtccggtcggccgccttcaccgtcggcggctacgactgggccgtcgtcttctacccgcgcggcgccacgcacgccgaccgcgaccacgccgccgtctacgtccagctcctgaccgaccgcgccgccgccgccgccaccttcgacctccgcttcgtccgcgccgactccggccggccgctgtccgtgcacccgccgctcgccgcgccgaggacgttcagcaccgtactccgctcctcctccgccgccatgtacggcgtcaaggtggaggcgatacaggcgctccaggccaactacgtccgccgcgaccgcctcaccatcgactgcgccgtgcgcgtcgtcgggaagccgcgggtgtccgccgccgcgccgctgacggcggccgacgtcccgccgccggacctcgcggcgcacctcggccggctcctcgacctcaagtcccacgccgacgtcacgttcgacgtgcggggagtgcagttcgccgcgcaccgggtggtgctcgccatgcgctccgccgtcttcgccgccgagctgttcggcccgatgcgcaacaacgccggcggcgccatcaaggtcggcgacatgcagcccgccgtgttcaaggtccttctcggcttcatctacaccgacacgctcgccgccatggacgacctcgacgccgacgaggacgacaggcgagagctcgcccgccacctgctcgtcgccgccgaccggtacgacatgggcaggctgaagctcatctgcgcggacatgctcgcgaggagcctgacggcgcagacggtggcgagcacattggcattggccgaccgccatggctgccgcgggctcagggaagcctgcgtcgagttcgtcatcgccatgggtatgaacgatgaggtggtgataagccggcatcctgaccagctcagctgtatctcgctcttcaaatacttcttctaccagatcggcagcttactcaaaatccactaaactgtgtttaattagtgaaagattcagagtgattgtgttatttcaacttctactactgtcgatagactcttaatcttttcttaattagtttgtccactaaactgtgttactagttagactcaagagtgtttgattgttccaacttctgatagagtcaatagacgcttaatcttcttaattactacagtttgtggctaatcttcttaattagtagtttgtggttgtttactgaccaggtagcttttttgcagttttgttgatgttctgatatacctttatcaaaatcctctaaaaactactcctcacgagtagtttgtctccccagtagcttgttgagtatattaattagtcagtgagcttgatttttctaacttctgatgctgccaatggacatttatatattctgaattagtttgtggttttttactaaccagtttagttcatgttctgatatgcctgagtttgtaaataatttatcctacaagaaaaggacgatttttcatacaagagtttctatgtggttttaccagtgaaacaaattaacagcgtgcttattatttttacttctggtactatcaatgaacgcttaatcttcgtaatcagtttttgtttgtttactcaccacttaattattcatagtttgtgaaggtttactgacttgtaggtactcctagctcagttgtagtttagttgatgttcagatacgagtgagtttgtagatattttttcctgcaggaaaagaaataaagctaatgcagttcaggtccaactattcactctgtaattttactagtgaaacagaacaagatttgctctgaaaattctggatgaacaacaggcacttgtcccctctgataattctgaatgaaacaacagacaaacatgcactaaagttctgaatgaacatcataacaaacagactaaaatttctgaatgaacagcagaacaagcagattctgcacaacaagcagaacaaacagactcagaaattctggatgaacaacacaacaaacaagttgtgaacaaaacaacaatcagattctctgaatgaacaagagaaacaacacaacagcaggctctgcacaaaacaacaatcagattgtctgaatgaacaacagaacagacaagagtactctgaacaagagaacaattagacacaacccttcaagtctgatcaacaaaaaacaatcaggtaccactaccacatgatgaaatacagtatatcgcccctggtttgtgtaatcagtacaccaagtagtaactgattacttgattagccatctgcaacacaagaataaaactgcatacttgaaaacttcagcaacaagcataaaactgcatacttgattagccatctgaaacacaagcataaaacttcagcaacacaagcataaaactgcatacttgattagccatctgaaacacaagcataaaacttcataaaccatacaggaataccactctacaagtacagcaaaggacataatcaatttctcaggtcaaacaggtgattagtaatctgcaacccaagctgcataaaccatacaggaataccaccctgcaagtacagcagagtacaagaggcatcagatttgaatcaggagacagagacaaaatttcagatcagatctggccaagaaacattcacacaaagtactcatccaaatgctgatgaatattttcttctcggttcataatagatagattcatagatagatcagacagtgcaaatccatggcttgtctctcaaaccgacccaacgaaacaaaaagattaaaccactccaagactcccatcccattacatagaacgacgacgacgacgaaccgatagatccatagctttcctaacgagatctacgactactaataagatagaactgatcacccgctgctcggtgattcagtgagggagggggagcaaaacgcatcatgggagggagctggatctgacgccgcgagcagcgcctagtaggtcttgctggggcactcgcgagcgatgtggccggtctcgccgcagttgtagcacccgccgccgccgccgccaccaccaccgccgcggtagccgccgccaccaccaccgtagccaccaccgccgcctcctccctgggagcagtccctggccatgtggccctcctcgccgcacttgtagcacgcgcggctgcctccgccgccgccgccgccgtacccgccgccgcctccgtagccgcggtcgcccccgccgtagccgccgccaccgccgccgtagccgcggtcaccgccgtagcggccgccgcctccgcccccgccgtagccgcggtccccgccgccgctgggacgggatccgccggtgagcgccccgccccccggcgcggtgacgtccacggccttggtgcggccgtcgttgccggatccgacggagaactcgacgacgtcgccgtcgttgaggctgcggtagccgtcggacttgagcgaggattggtggacgaagagatcctcgccgccgtcgtcgggggnnnnnnnnnnnnnnnnnnnnnnnnnnnnnnnnnncttcaccgtccccttcaccctctccgacgccatctcgacctcgccctcgccctctcgccgccgccgccgccgcaacccaaaaccctagaaaccctagatcggtgtgggagtggaagcgaatgggaggagaagccgccgccgggtgggctatttaacggcccaaaaaaaatctttgcattaaattactacctcgaaaaaaaatcttttcattaattgcctctttattttggaatatttaccgagatattccccgcggcatcggcccatcaaactcttcctctcccgactgacatctcggcccacttaggcggcccaacttcatagtttcggtccgacacgttcaagggaagggaacagagatggattttgtttcggacttgatttgtaaatttgcacgaaatttatacaaaattagcggtggattcggattannnnnnnnnnnnnnnnnnnnncgatggcgacggagtgcacgacgtcgacgagcacgacggcgacggtggaggggcggcacaggttccgcgtcgccgggtacggcgccaccaagggcgccgcgcccggccaccgcgtggcgtcggggaccttcaccgtcggcgggttcgactgggccgtcgtgttctacccggagggcgtcacggccgccgacatggacttcgtctcggtctacctcgagctcaagaacgccgccgccgccgctggcggcggcggaggcggcgcggtggcgcgcgcgttctacgacctcaggctgatccacccggccaccggcgagccgcggtccgtgcgctggcccatggacggctcgacgtcgcgcgtgttctcccaggcgttcccggcgtgggggcacctgaggttcatgcggcggcgcgagctggaggagatggggttcgtccgcgacgaccgcctcaccatcgagtgcgtcgtcaacgtcgtcctggaccccgtcgtcaccgccggcgacgcgccggagctcgaccatccgccgtcgaacatcctcggccacctcgccgggctcctcggcgacaagggcaccgccgacgtgacgctcgtcgtgcggggcgaggagttcgccgcgcaccgggcggtgctcgccatgcgttcgccggtgttcaaggcggcgctctacgggccaatgaaggagtccacggacgcgaacgccggccgcgtcgccatcgacagcgtcgagccggcggtgttccgggctctcctccacttcatctacaccgacacgaccgccgccatggacgacctcgacgacgacgacgacgacaaggcgcagatgatcatgcaccttctcgaggccgccgaccggtacgacgtcgagaggctgaagctgatctgcgagctcatgctctgcaagagcatcgccgtggacaccgtcgcggcgacgctggcaatggcggatcagcaccattgccagaagctcaaggaggcgtgcatcgagttcttggccacctccaagaagatggaaggcgtcatggaaagccaagggtacgagaagatgaagctatcttgcccttctttcatggtggatttgtgggagataataggcaggaagatgacctcttattctgttattcccaatatctatgcaagagacaaggactaattttcttgaatttccttgcaaattcgcatcaaaatgccagcatgtaaccataaaccattgactgattctagtttggagataatgatcacagtcttgctacttcccgcgatcctcaacatcttggcaaaaatctgaaatgtttgaagttaaggataagatttgatcaaaaatttaaaatttcgaccatcaagtttatcagtttatcaaatttaataagtttatgatataatgatattgctttttgatgcaaatatatgtataccattttttttgtttttaagctaattaaccatttaaaaaatattgattagaattataaagttttatccgattcatgacataaacaacaagtatttataaccgaaggaagtattcagtattgacaactaggctagctgagcaacttgaagatacatagccgttcatatgatttgtgttccggagttggtcagccgcaatgttgtaactcatctgctcacatctcgtacgacatttcaagatatggaggcttcttcttgttttggttgacacatttctgttctacgctctgtaaacaacaggatgtacactgcatgcacaccagacgaatgtatatatacgtgagtggccgtgaacagacacgtatatctcatcaaaattttgattgatcactgccataaatccacaaccgatgtttgagtgaattcgacttgcaatctttctgtctgtcttttgtttctttcttgttttgttttgagtttatgtgtaatcattatctaaaaaaacaatctgtttatatttctgtttgtgtttcatgaaacggattagtaatgttctcagggcccaggtctaacccgaatccaggccttcgagagggcctatctaaaacactatattatcgtatgatccaatttcatggcgtacgtgctcgtgctggtcttcttcgtctccccaagttctcatctgctattgcgcaatgggcgcctgcgcctcagcttcgcggccgccgccgtcgccgcgccacggctgctctccgccgacgccgacgatgacatggacggcgtcgacgtgcacgacgccgatagcgcagggcgcgcacgcgttcaccgtctaccagcacggcctcgtcaagaggaccaccgccgccggcgagttcgtccggtcgggaaccttcgccgtcggcggctacgactgggccgtcaggtactaccccaacggcgacagcgccgccgaggcggcgtgccgccagccgtcggtggtcctcgagctcatgaccgccgacgccgcggcgtccgtggtctacgagctcaaggccgtcgaccaggtcaccggcgagcgcctcgtcctccgcgaggacaagacggcggcgttcgacaccaggaacggccagttcagctgctccggcgtgcagttcgtcgagacgccggcgttcctcgccggcgacttcctctcgatcgagtgtatagtcacgatcttcggcgagccacgcgtctcaaagacgaacaagatgccacagccgccgccgccgccgccgccgccgccggcggagacaagcgatgtctcatagacaataaagaaaaacaactatactactgtattgctctcatgtcatggtttaatacaaactggtcaaactactgtgttgctctcatggtttttgtctctgatgaaaacaattacaattgcttacattaaacgaacagtaggttaagcagaaaagaagctgtggttcaaccatgttcttctagtgtagacaagcattgggtctgaacagattaattccaggtttatagctgcattacctctgtcgaagacgaaaattcgccgttgatcttacacatcatggcatcatcaatctccaccctagtccagagctttggaaaagaataaggaatcgtaacagatgcaacagattcttggttgctcaattcattcttctttccaaacagctgcgccgcaataccagagcagatcttcagatcaacctcactctgtgctcttatcatcttagcaaggagctcagtcatctttgcacctctctccatttgctgcttgatggataacttgacaggctttggatggtcatctggattttggtcaggagggttgtcatcctcgtaggtgcttttgctttctagcaattcctttatcttctggtccaaaatagtagcaatcctgtcccggaagccatctgcatttgcagagtccgatttcagcctcacctttgcctcggaaaccaatgtttccatcctctcttctgaagaagttgcttcaggttcaggttcatcagcagcatcttctgtaagaccgaacgtttcctccagtaacccaacattctgtgtatacctttcatacgcttcattttcagcatcgatgtctccttggatatgttcttttagcttctcaaacctccacttgtttatgcccataacatcctgtaatataaatgcttaactccttaatcatggtctcatcatggaagaaaagaaacgaaactaaacaatgaacaatcgcaaacaatggaacagctagaacctttttggcaagggacttctttgttcggagggaattcaggaaatgatggggaagcctttgcagagaagccaaccttgatgaactgcagcagcaaatttcaagcaagcatcagaaataatgacagattttaccataagataaaactcctggttcagaaggttacccggttgaaggtatattagctgatggttgctctgacagaggagctgttgacagaggtggcttatctggcaatgtgttgttctgtttcagaactgtcatgattggtgataagaggtggttagtggctttttcaaaaatattagaaaaatacagagtccagacaaatcacagaaaatatgtagacaggcataacatcatagccataaatcaaaatttcttgtatgtaaccaaatgttgctaatcccttatacaccagagagaataaattttgacagcaacattcagtgccatataatgaagagtatagagagagatgaatataattcgaaagcagatttaagaggtacaatacaacaaataagagcccttcaaggtacacccatgaggccattatccctccaaaacacatttctgaaggtccatttgattttagagaccaaggcaataataatgctatggcaagggtcaatttaattttagaaaccaaggttgtcatgggctcatggcactcaagtgagtcattaccacagtcactagatcatgatacaatactgtcgttcctgaacctgtcccagtttgctggtcacagttgatgcaggtcacctccaggccgtgtttggttattagaggcatccaaatcaggtacagaaacctacctgattttgattggggcaacagtggccaggttcctcgccattcaggtggtgctggcatgtgtgaaggtgtgtggtggcacactgcaggggataatccagcagtagaagatggggaccaagttgctacaccctgtgatctcgtggccctcaaggttctctgtcgccgatgcaagacaagtcagcagaagaggggaggaggtttggagaagactagggcatttgcttataaaagatggtggcaagggtgtctgctgaaagcctgaaactgcatcgatggcgaggatatgagattatgttagaactgaggagatagagcaacagaattgtgtggctggatgggtcacatgtctgatgtctctacaacccaaatatttatttgtctcatttcgtgttcccttccttgtagtgtaaaactgattatcttccttgggtgtttgtgtatgacataccataaagtagtagtaatttattttataccatataatttattttgacagaccaagtagcttgttcatcgacctagattcattggttcaggttcagggtcacatcccacatcctaaactacagtcctgaagaaaactgccgctgtttgatccaacctgacaaacatactgaaattcttctctacaccctttccctcatttccttccctaaaccctacaaaatatgaagatcaaacattctgttgaccaacatcatcccactatttgagcagcctgatggagaagcattaattggttgttaatgttgttcaattgcacgcgacaacattgtcagtactgagaaaaataaaaatccaaaatggaacaaaacgttataataatgcatttctatacctgtagtttcccttttagatgttgaaatgagcatgttcaaatcttatcattataagtttgatcaacggtccataagaaagtgaccgtaccttaaaattcctccataattgaagtatcccactaccccacttacaagcaattgtcctagctttgatgctaagtagctaaacgtgataagcattcccagaataaattgtaaacaataaaacaggtaaatctccaactgccaaacaatgagtaatagtccacagaaaggtaaaactgcaagaccaaatcacgcctgtcaaaaaaattggttggatcaaatgatcgaataagtggatgtacaggtattcagtcagcggcttaatacaactaattacaagcacaattcgttgcacaggagcagatatatactcaaatggtactagcattacacatacataccatgaatgtggcaaggattctgagccttgtagcagcagctcttacaacactggaacgggcacctgaaaggccaagcattacattacacagaatgaattaaaaaaaatatccaggagcgacatgccgatacagcgcatcgatttctcttagaaaaccatcactacaaatccccaaaacaaaaaaaaaaaaatcttaccgcgagcgcgcaacgttgccgcactggatgcacttgggcttgttgaggccgcgcaggttgggcttgggcatgtcgaaggcggacgccgggggcagcttctgcggcgtcgtcccattgccgttggcgaccgcgaccgcgggtgccgacgagtcgctggccgccttcccgctggatgccggcgacgacgcggccatagcgaacccgccgtgaaccaccccgcaactccgcacaggaccagcggttgggattccggggaaccggaggcctcgacggcggcggtgctccggcgagctagggtttcttcttttttttttcttttgtgtctctcctgcttttcttttcttgagtcgagtcgaatccaatccaatcgtgcggtggcttcccgagacgaacggtttgatgtgggctgacaaggtgggcccggtggtgtaattgggctgggcccaattgaccaagtctattctaccaaggcgatgacgccggcgagttcgtccgtatcgacgccttctcacttcgcagccgccgccgccgccggcgccaccgaattcaaccccaacggcgacggcggaagaagaggattttcgccggcgacggaggtgacggaagtgtgccctttttttaagtaaatttttcatctacacaaaccgttggccccattatttcgcttatcttgtgcttattgtccagcttactagtagcaaacaaaaaataatttgtacgtaaaatttttatatgtgtgtgtctttactgatataaaggccaatgttgtaaaataaatcacgatgaaaaaatccacaaaatcaacttcataattaagtcttaaaattaacttgacttatggtataaacataagtgaaacaatggagacacattttttaaaaaataatggttaatgatttcatacagaaacagttccaaagtatctctgaaatctaagttcaaatgcttcgattataaagtggcttggctcatttttgagtcatcaacaagcatacagaaaagttccatgcattttttttcttttttcctcttttttcagtcatggtagctacaaaaatcataggcaaacaccagctggtgttcttcagcctagcacacactgaaacacatagatacagtcatacacacactaatcatcaatcacacaatcacataaaccaaaacaaagctctctgctatgcttactgagagagtaagctagaattatccccttctccacatttttttaacttcctactgggtgctgtttctgacatgcacaagattcctcagctcttcaaatgcatccatggtctctggatcgaatcccccagcaaactgcaaaaatgagcggcaatttagaatatgcagctgacattaaggtttaaataacacatcttaatatgtcataacaagagttaacagcagaaaatagcacaaacgtaatgcagaaataaccataatgtttctgaaggacataaaacatatacaagcacctgtggaaaataaatatgtgcaattatatacggaatgggaatcaggaggcagatgaaacaattatgagatgtggtataacataattgcccaagtatacatctaatcagaatggagtatgcagtatgcacaggggaattttctttttgtggagttcctgctagaaatgtgttacctgatgcattctgaaggcaaatctcacagcctgaagtagcatatactccaaagctggatctttgttcagaggtcccatgtattgaagttccatagcaactcttttcatgtacatctttgctaatttgacagaagaaaattttatctgcagttatcaaggaaatagaaagacaacgattactccagttaatagaaaggcaatgattaatccaacaggatgtaaacgatggtctaggtgatcgttgcaaactgcttctgttttacaacctttttgtggtatcaacataatctgcaaaatgttcacaagcaaacaacagtggtacctatgcaaagcgtaccacattcctaagtttcagtagatgaaaataaccttagatactatataacaagcacctcaagttaaccaataggtacttgaaaacttatcctggtagtctccatgctatctattctgaatactggtaaccaacaaattttactttttgcaggccaagcatcataattctgactaggtcatttcctgtatcatatgctgacaacaatgtagcactaagaaatcaaaccttcaaatacggaaaattatagaacatataccttgccaataagattgttgtcgagcatccagtcagtaggaatattaaactctttacactgtctcatcgtagcatcccttgtcctcagaagattgtagacactccgctcagtcctgaattaagaatgcaaatgaaaatatcagtattcccatttaagtttaccactatttctgttaaatgtatgtaatctgtatacttatagtaaatttagtcgtacttttctgatattgtaaccattttcttcagtgcaatgtcacatggaaggcgaggatcatctttatagtttgaaacttcagattccaattttttcaggtcttggtagccaaaagctgcctctcgtagagtatctgccttcctttctggccaatcaaaatgcttcagcactgctctctcatccaccttcaagtaatgcaattacatgagtgaaaaaacaaagtaaattgctcagagtatagtgctactgaacattcataccaggaaaccaagctcatcatcaagccatttcacaaatgcaaccacatcttctatatctttgtaagctgcattggtcacctccttgatcaatgatttcacaaattcaccttgagtctcaacatcagccttgatctgaaaatgaacaaagagtaaagtaaatagccatacatcagtgcgagaaccagctagcttttcattggtatctacaattctacatatgtccaataatctgagcagaatattctacttacagcctgcaaatgcgaagaacggttctcaatttcaccaatcatgctactccgcacatttgctgagttagcagtttcacagattccactcccagaagtatccttttttgagtcccttctcataagtgaatggtaaagctctgcaacttgtggtgccctcttcatgaccccagcgtttcttgtggagaactttggaggcggtggcggtggcggaggctttggtggattcgcagctgatccatttgatggaccagaatgtggcacagaaactgaaggtctaggaggagggtttggaatacgcaaggcacgcttttcaacatccatactttgagacttgcatacttctgacttgccaagaagaaatcttgagctttcagatcgaccaaaatcatacttatccacaagaagttcacgcttctccctgattgtctcatccttattacaggagattgcctcatctgttgcttcaggcaggcagataaaggtatcagattggcgcctcttcacaatgctaaactcctgagcacatccttttggtccacctagtgagtgcctgcgtgtcgggcttctgcattctgcagcttcaatccatgctctgtcaagaagggcctcctttttagatgcttcacaattcttatcattctgagaccattgtttgatacgctcagcaatgctgaacttcttgtgatcagaactgttctgatcaagtcttgcatcaccatcacaatcatcaacatgacaagcaatttcatcattataatctgcatctgtcattgctctagctgcttgatctgagttactgagctcatgacgtagacaagaattgatccaccgaagataggcaagctcctcaacttcagttagccgactcatttgcagaccctcaacctgcttgctcaagtttgcatttgtgtgccgcaataatgaagcctcagcttgaacctttgcaactatctcactctggtgacaataagcatggtatagaaaaggttagctggaaacaaactacgactcaacccacctgaaaaataatttagtttaagtaatgttacctcggcattcttttcaatgacagccaatttggactctgctgaagagagtttaattgcgaggtttcgtttctgaaattgaagctctttgtttaaacgtcgcagttcaacaacttcaatctccaagttttctgaagaagatgcattgcccccattcatactagaaacccgattgccatgcccatccaaccttgcattttcttcatgctgctctaccatacaagatagagctgatagctgttcagaaaggcttgttttctcaacttctagtgaagttttaagtcgcacaagcctgtcaatttcattcttccttgaatcaagatccttttcaagttccgaaactctaggattttctctgcattgccgcaactctgact

SEQ ID NO: 9584 - DNA, 4055 bp, Oryza sativa
tttttgtcagctgtgaaccctttgacaatttgggaaccccaagaggatccaaattttggcttgagcacatttatattgcttttggagtcaacccttgatctgcatggctttgtttggttgtcaaacataatatcttctttcatcttgtagcgattttgcctgacccagaacactaaccatgcagaggtgactcgacttgattaaaatgttccagtacctgtactaacacctgcaaataagtgagaaaaacatgaattgagctagcaaccaaacatcaataacacagatgaaaacaagaataaagaaaaaaaatgaagaaccagatatgaatgccttttaaaatggatgccttcaaaaattgtccataaataaggaaataaagcatcaattcaggagtactagactaaatgaattctttattgcaatgctacccagaaccatatcaaaccacatctttaactacttccatggagtccatttgtgtactactctgaagagagcaacatttaagcagcattacaactgcctttatctctctctttagaagcatttgtatgaagcaaataaataacatcaaggtctgagcaaatcaagcttaatacttttttgagattatcgtttccaaaggctaaaaagaagcactgcctttcaatttttttgtggccgtacagtacacatttgtagcatcgaccatcaatgcatcgtcgacgaagatgaaatctcccgaaacctaatcaccaaaaagcagaaaactgctaactgcaaacaagcatcctcttgaactaactaaaacacgaaggagaaggagcaaaatgccccaagatccaactccctagaaccaaaatcgaatgagaacagcaaatgggaccaaccgattttggcgaagatgataaacacaatgccaatcaaaacccaaaagcttccacaaaaatcaagcatttgaacacagcgagtagactgaacccacattgggctcatcatcaagaaggacacaacaagtaaagcgcgactcttacctcccaccacccaccatcgatttgtacagatcgaggtgaaagcaaactcccccgtccacaaaagaacccagccgttctgcacaccgagcgagctcaagacgatcgccaatcctgaaatcccccactaatcaaagccttctccctccttttgacctcctcctgaccgcaagtccgcaacctatcatcccccgctccagcaagaacccccccaaatcagctcgatttcaacttaagaagacgaaaaagaaaaaaaaatcaaaaaccccgcagtgccgtgccactcccgacgacactaccaccactactcctactagtagtagagccaacatcagccagtggcagtaaacaaagaagaataggaggatgaagacaagtgcggtggagcttcggatgctttcaccttcggcctcgctcgccttcgatcgccgcgccccgcgcccacgcgcggatttttctacgagctcgtcgcggcgagttcgaggattcggttgctctctctctctcctctcctctctcttgcgctctgcttcttctcgggagaggagaagagtggagtggagagtggaggggggtgggtgtgtggtttgaattttgaaatggggataggggttttggacgagacgagtagccgtagcgcctagggggggacaagacattggcagagcaggtactgacaggtgggtcccactgagcagtttctcgcctttttctttttctctctccctggtttcttgtcgcttttgtgagaccgagcgtactgggccgccagcaggctactgggccgggtacttctctctaaaagtctgagtgttaggtgtgggctgtcttgttatgctggaaataaaaaatggaataagttcaattgaggtccctagatttgttgactgagtctgaaatttatccctaaactgaaatactagatataatggataccccaatttgcaaaactagatcactcgaggttctaggcagtttatgcccggttttggttgatgtggcaagctgggtcaacgtgggacccacgtgggcccccgtatgtcagtagctagcactttcttccttctcttctcctctcttcccaatcccctctagggcgacgaccaacgggaaggacggcgcgatgggtgagattttgttggcgctgtctcctctccccatcccctgatgctgaggagacgtcaccaacagagcgactgagggggtgattgatggtgacgagcagtttacacagctctcggatcaaccgcgagtagtgctctctgttgtcgttgttgtcgtcgctgctggccccaccatggcaatggaaactcgagcaacgaagtgaatcaaaggtcggaggtggaagatggtggtcgtcgacgtagaagatgatggtggccgttgacgtagaagatgacggtgccgtccacgtagaagatgacggtggcaggggtccaggtgatggcataggagtgggcggcgactatggggtcatcgaaggagaggaggtagcgctcctcatggcacgggtggtgctatcgttgcctccatcttcgccccttccccagccaacgatggggcatggaggaaatagatgggagatggggaatagatggagagagaggggaggctagaggtggagagaggccttacatgtgagccccactcgccacgtcagctaaaaccgtgtgtatactgcttgagacctctggcataccacttttccaagttgaggaacttgttatatttggtattatggtttgatgacgaaattcaaactcggccacaagttgagtgaacttattccataaaaatttaggaccatctgagtatatatcattggacggatttttttcccacgaaaatcagatgaatgtaactacagtacaattatgctcgtaactagcatgtaaagtgtcatatagatacacaaaaatgctcgtagcttagtgggataggcgtgtgttggggattgcgggatcgagtcctttgccttgtgattttaaatttgtgtgattttaactaatttcaactagtaaatttgatgacaggtgtatatattatgccttgaagaggactcgaacctccacactctttagcaggccgaatcgggccaccacttgggatgggaatggctctttcggataatgcaaatcgaagctattttgatgtgtgagcctatatgacatagaaaaaggttaaaaaaaaacgtttgattctcttttccctattcaattacacggaagacataactgtaagtgtatctcataacattagcttataagctgtagataaattcatattttggagcctaattttaagctgggttgagccaattaagagcatctattaaagcatggctaaattatgttcccaaaatgcccatacgtctagctagccaaaagattatattttttaaatttttatatttgaaacggactctccaattccaactctacatatggtacagcaaagagcaatacttcttccgtttcacaatgtaagtcattctattatttcccatattcatattgatattaatgaatctaaatagatatatatatctagattcattaacatcaatataaatatgagaaatgctagaatgacttacattgtaaaacggagggagtacatccttgatcgagaggcgaacttggaaaaaccaaacacaaaatccaaaaatcatgggtcagatttggggggcttttaactatttgcccctcttacgagtggggcttaacgatttaccactagacctacatgtcatagacacatgaggggccatatgttataaacagggtgtggcaaatggttaattgccatgtcacaagagtggcaaatagttaaatttccccagatttggggtattcaattttctattctacaatgttttggagtgacaaacgatcacccaaaaaatcacaatcacaaatctctgaagagcaatcactgaaacaaccatagatgtgtgtatttgtgtttgtggttgaggagtggagcttcaggaggccaacaattgcgtcgccttcaggcttcttctccatgccacacatgaca

SEQ ID NO: 9585 - DNA, 6640 bp, Oryza sativa
tgacccctttaaccatttgaaaataggagttagcattttttttaaattatgaaatgtcacttatgttatactcctatactccataacacctcatgcagttagagctgcttggacatacaatgattaccttatagctatgattatttgtcgaattagttgatgcatgcatgtggtgtgcatgcacacatgaagtcatgaacaatttgtcaatcagatgcagggtactagtagaaaccaacatgtgtcgtgcgccctggtttttttgtttcttcttttttttaaagcttttcttttcttctttggtgccatcgaaatgatttttaaatatttccaacatcttgtaggagctcaaaaaaataatccaaatttataaaatttatatccttccaactgttttcaaaatcctgcatttcaatccttgcaaaagaaaccctgcatttcatcgctttctccgtgtataaatataaaatattttttgaacgactataaatttaaaagatgtttgtctataagttgaaatttgtggtttcaagacatgtttttaccattcctcatctaccaactttatactaccccttcccaaactaaagtttgtagtttattcctcacctgccaatttatgtgcaaatttatttttctaactacatgtcttatgttataacttgttgtgtcaataatttctcattttttttaaaaaataatactatgatttcctaggattcgttcttatagcaaagcaaagatagaaaatatgtcgttttgtacgcatatgcttccaaaacagctaaatgatatgttttttttggcaaaaatatccattaagaaagttgcttgaaaaaaccatattaatccattttaagttgaaagtaataaatacttaattaatcatgtattgatggctcaactcattttgcgcatcttcttaatcttatttttttatttcaaacacaaccttagggcccctttgatttggaggaaaaacatagaaattttgaaggatttcaattctataggaaaaattctatgaatgcctttgaaatagaggattgaatcctatccaatttttgaaattcatatggaatagaaaatcctatagagattttgaaagaaacttagcaatagcttaaagctcttagaaaatttcctttagtctatctctcgcatccgattcttgtgtttttttacggtcattcttgtattttttctatgttttgaatcatttgttttacactttcattcctgttagaaccatatgtttttcttatttctttgttttttttcattcctacgattccaggagcccttatactactccgtatttaaggaagaatagtagagtaagggcaagtgctataatgctagatgtattgcccctaaacatgccacataagattgaatgatgaggtggaagaaataagtgatcaaagagaaggtgagccacccctcatgcgaggggcaacctccacacaaacccgaaggaaaaggagatgaaaggaagagtagattagacaaacaaataaaataaaattatttgggttagtatgctagaggtagttgtagatgtgatgtattgtactccctctgtcccataatataagggattttggatggatgtgacacattatagtacaatgattatagagagacagtttgtccagattccctacaatctcttatattatgggacgaagagagtatatatcatctcttattttaaatagataaaatagatatggcagccaccccttctataagatttgccctaactctttggttaagttaaaaaggacatctactcataaacaactgttaatcaccatttgattgggatcatcaattacatctgtcaggagggtgtctcctcgtcagaaaatgcagattggattcgacgccgacctgccttccgctgctgcttttcgagattgtcgacatgaccacatgtaaacaaaggctgtggccttgtttagattcttcgggttattaaatagcccttcgaaatcttgctatttaagattattaaacgtagattatcgataaaactgattccataatcccttggctattttgtgagacgaatctaattatgtatattaattcatgattagcagctgattactgtagcaaatcatggattaatatatctcgttagattcgtctcgcaaaatagcctagtggttatggaataggttttgtcagtaatctacgtttaatactcttaaataacgagattccagagggctatttaataaccctccggatccaaatagggcctgtgtttagttggatccaaagtttagattttggttgaaattggagatggtgtgactaaaaaattgtgtgtgtatgacatgttgatgtgatggaaaaggactgaagtttggatccaaactttgaatctaaacacagctaaaatcgatgcttgtgcattatacaagctcataaatgcaagaaaaagaaagatgagagatgcaatgcaagatgctgcggacagcagcaagaaaaaaaacaggttttccggtgacgacagattcccaacaaactccgataatcaattcagaaaacatcggcccgtgtgggagaagctcaagtgagtaggtagagggtgaggacctaaaaaaaactggattttctacttattaatttatttttaaatgtagaaatctatagttgaagatttttttaaaaaaactgcagcagccagagttcaccaaatatggccgtcctttcaacggaaggagataaatttaaattttaaaactaaatttgacatttattttagggtattgttattatactttattttacttattgtctttaaaagctaaggacatatttataaaagttttactaacataaccaatatatctatatcttctatatatagttacagcttctaaacatctaaaactcaacatacaaatatagtaattattagtatcttaaaacttaacatgcaagaataccacgccaacccaccaaatatctaaagtttaatgtataaatatagcaattataaccataatttattatattataaaactcaacatacttacatgctaaatcatcattttgatgcttgataaaaaccgtctcatgtttgcttggtctctaaatttcttccaaatggaattattctaagttgaattcatattagttgtacttcacagcagtaagatatgcgttaaatattgatcatgcggttaagtagattttacatttatatgctcccacatatacattgatagaattcgtatgtacgagttctagaatcaaatccatcgattcatggtataccacaacaaaccgcagagtataactactgccaaacgatgtgatcagaaagcactgacggaggccgccaccgagcaggtaggggtagggcgaccatccaggctccgccgctgccaccgctaccctttttactaataaatattattaatatatagtataaaacttgatcgatcaccgtgaaacaccgtgctggctccaccaggaccatcactgccaagaagaagaggagagtgatagaaagagaaagcgagggaggagagagagagacatgaaggaagctcagagagagagaggccctgtttggcacagctccagagctcagccaaacagtttcagctccaccaaaactgggagtggagttgggtggagctctctcacaaaatgtactagagttgtggagctgggtttaggcagctccacaactccactccaaacttaactcctggagttatatttaggagttggagttataccaaactggcccagagagagagagagttttgcatttgcaactctctcctgtacttctctctctatacaacaactactcctcgactggactcggtccaagagaccacatacccccaacgaccctcctcccctcccccctcctctccccctcgccgagatatattttcccctcggcggcgactcctcctccacctcgtgagctcgccttcggccgccgcctctgcgcctcgcagatccccacccgcgaccgagcgagctggtgccgcatcggtatcgcatcccggtgagcagcgtccacctgacacgattttcctccagttttgctcgcgttaatttctcttctagaccttggatgggagccctttttctcttaatttgtgacagccttgttccacccccaaaaggcgcttggcatgttagatccgtcgtccctggctgactatatgattctttctgtgattcttgattggaactgtgattagtgtaaaatatgccattcttggcttgtttgaattgcctgttctttgcattgaatgatgattctaatcattgtgattgattgatgcatgatggttcattgattctgctgcagttcatcttctggctggacgaattcaattcacggacggtggtggtggtggtgttgactagggatttatttttttaccattggcggctcggctgcatccccaagtgaagaagagaattcgtacatgattccgctaaacaggagggcgagtcagactaggggtggtagatctcgatgccctttctttctctttggttatttactgttgctttagatatatgtatatgcgtctaaataatgttgttgcctttttgatcccctttggcccttgagcatgtgtaccaaccaatagtggcattttttttaatgtttagtttgtccatctaatctatgtgccccatgaaggaaactgttttttttttaagaattgctccacctgaaaaagctgtccttttttctttgccatgggattcacttggtgtacaagcacatgaacacctttcagaggtcatttcacatgcatatgtatgggctagatatttcatatggcaagcagtagtgtgtcttttgatggtatgcactattgccagcagtgaagaatttcttagcaaaaattccttttcagtagatgatcccagcccatttcttctgccttaagtaatgcttgttatgtgcacattaagatttcagtcactacacagataggcaagttgaactaaagctattaggtgcaatatttcaactgaagtcaactaagacatgcaaccatatcgatcttgtttttggtagataaatctttaagcaagcagttgccactttgctgatatcgcatttcaagtcaaagccagagtttgcttgctgtgtagtttcattatcaatgaggactggttcatttgtttgtgcggaacaggggatccatatatctgacattaattaggttgctcttttgtttgaccatgggtatgctttaatttattcaactgttgtaatggttaaatgtttggtcattccctttatgttgtaagttcatcatgttgatagggatggagtacttcgatgctaggcggaaccctcataatgttgggaaagttattgcagctctggtcctcacaacactatgtatatttattttgaagcaatctcctggttttggtggcagtagtgtggtaagatgtctatatttctttttttctcttcttcttctttcatccttattcctttaaatctgcttttaagatcagcctttcctcacgttttcatgttttgatttgtaagtcactttctgctacctataggtttaacttttggacttttctcaacttactttctcttatgtttttcttgttacacaaaaagcaattttaattttgagtatcacctgtattatagaatatgtccttgtataactagcataaaacaaaatgatgactgctattgtagttgtttcaatacacatatcttcatttctgctctcagtgctaacaagcaggtgaggaaagtgacatctctccatccaattgcctttgttattgcaatgtctattacattagttcatgttccaacttgatatttcaatacacatatcttcattagttgtttgccacttctcgttgcggcaagttgatgcctaaatggcatcctaacaaactgtagctttcagccacgagaccttctgacagctaatcaatctgcataataattttgacatgttcctgttcaagaaaactacgatatgatttgcagatgtaaatatatcacatctctaaaactacaggctaactatccagttctttagaataaaatgttaagagactgttgcagagtgaaggtcaaacatagcacattacttttgttgtctagaaacatgtataagctgcgatgcagacctagtatgtgtatggctaaacttggatatgttccatctgttttgacttctgttgcttaatctttcaactcttcatgcaaatccgcctgttatgtttcttatgctgcaattattattatgccattcttatatttcccctatttttaattcaactgtataactgattgtggggttatgtatcttgcagttttctcgccatgaacctggtgttactcatgtcttagtaacaggaggagctggctatattgggtcacatgcttcattacgcctgttaaaggacaattatcgagttaccattgtggtaattaagttttcctttgtactgaatttctgaactggtttgttcttcaaatgccacccttgatggttaattgtgatttttaggacaatctttctagaggaaacatgggagcagtaaaggttctccaagagttttcccccagccaggaagacttcagtttatc

SEQ ID NO: 9586 - DNA, 2399 bp, Oryza sativa
ttccatgagcttgggggacctcttattctactaacccctacagacgttaccattgtacacacccttgtctaatggcctaattgtagtgctaggggaaaaggtccttatgataaaaaacagttttcactattaatccatggtacttggtatgctacaatgttaactccataatcaagtgctttctgatttttagttctcagatatttatattatctgctatcacagatatgatgaactgtataatatatctgaaacatgtctagtatatctctgataatcttaagtatttaacaggtactatcacaatattacatcgaacaccttattgattttggaggctatggcgtctcatggagtcaagacccttatttactctagtacatgtgccacctatggagaaccagagaagatgcctattgtagaaaccacacgtcaggtaattaatttatgatggcctcaaaactgcagtgtttggattgtgctgtgctatttcatcttgttgctggaaaggcaaactcaaggctgatgtgtaaatattatgtacctaattggttaataatttactctgttacagttaccaattaatccctatggaaaagctaagaaaatggcggaggacatcatactagatttcacgaaggggagaaaggacatggctgtgatgattttaaggtatgttgtttttccatggatataggcttgcaatttctgaacacaaaattggtatgtactaacatgtcaccttttgcattagatatttcaatgttattggatcagacccagagggaagactaggtgaagctcctagacctgaactacgagagcatggaaggatatccggggcatgctttgatgctgcgttaggaatcattccagggctgaaggtattttctcttatactttgactgtacagtacccctggtgtaaagcataatttagtgtattactaccatatatcagctttggatgttgataatagcaatatgatatacccatctagaagatacttgttttttgaagtattatacctgtatccagagactgaaactacagaagataatttagatttgaagctgatacttcatgaatcaattgcaggttaaaggaacagattatcctacaactgatggaacctgcataagaaactacattgatgtcacagatcttgttgatgctcatgtgaaagcactcaacaaggcagagccaagtaaagttggcatttacaatgttggcactggaagaggtttgacaatatgagctttctttatttactttgattaaatgcagttcgctcatgctaggacagaatcagattttaattaaatgctgcatttgttggttattttacatcaaatttttacgctggaatacacacagatggttattctggtagaataattttttattgtatgcttatgaaaaattgacttctcttgtcaaattatctccattctgcatttttactcatgcatttcttgtgctgtcaatagtatattctaatatatgtatgattgctttcaggtcgttcagtcaaggagtttgtggatgcctgcaaaaaggcaactggagtcaacattaaaattgagtacctcagcaggaggccaggggactatgctgaagtatacagtgacccaacaaagatcaacacggagctcaactggactgctcaatataccgacctcaaggagagcctgtcagtcgcttggagatggcaaaagtcacatccacgcggatatgggtcaaactaaatatagcttgctgatcaataattctgctgaatcgtcgatatattgatttttttagttagtggtataggatcttggtgcgataccgcttccacagtcactcatttgttatttttttctctttttattttcaaaggtttgttgttattttctagcaaaaccataagcagtgatcttgatatgctggaaatcctggaagccttcctgtaagggcaaatttcattgttttttgacacaaattgctgataaaaagaagtgtacattgtctcttaccattctgagatgcaagcttgtgaactgaactatagactacaaatatccctgtgttttgttatctatggaatgctcatcaccatttcgtgccaactgttgggtacacgtgtattgttaagcagtatcaaatcaggcgttgttcttgtgcagcctcacctgctacgcattttcaggcaaccggtttgacatgctcatgttgttttgtcagatcaggcatgcttaggttgtcattaacaaactttcagtaccaacttgatttcccatgaatgagcctgggggttgttttcaaattttgtttggtctacatttgacttctgtttgaaggtggcagcatggcagagttatactgttacaaatcatataatccctccgttttttaat

SEQ ID NO: 9587 - DNA, 7933 bp, Oryza sativa
gtcatctattaaaaaacggagatagtacatgaatagtgatcgctgactcactcctgtcaaacatgttacacaagtcctgggaataacattcaagatcttgttatgaattttggagggagagatcccctaacaacaaatcagatgtttttcaattgaaacctgaaaatgttgccacctgtccatttttattcaataaaaaggtactaatccaaagtgcctaatcaaagtttaaatgaagatggctccacaaatcaacaatcccaaaaaggacccatcatttataagctgcctaatctcagctactaccatttgactaaaatgctcaattaggcctaccagattgcatcttttttgtcttggccatagtctccaatcaagctggagaaacagagaggccatcatagataggagtagcaccatgaactctccaatgctcatgcttaaattctgccggttcatgcgtctctttgcaggttggtgagcagtgcgttttgcctcctctctctttcagtttttggcagcagatcagttaatatggtatgctggggtttgcatgaagtggtagttagcaacttgcaaggctgcagcaacaggtgaccaaacctaacgcacatgcacaagcaaccaggatttcttttggagagagagtgatggatttggatcatattggtgtatgcaagtgcccacaacatgtctctttttttagttgccacgccaagtctcccccattggtttacacaaaagaaattcctcccattttgttcggcatggtgaattttgaatagatatgatttctcggtttatcagcagcatccacaattttagtgttgattttaccttttttattatagtctattttttagtattggtttttaaattgtgaataatatagatataaaagttttattaataaattatgtttagcttttcgttcatatttctataagcttatcagtcgcatcttaaccaatgctattataaagacgcaaatgttaggaaaggatctaatatcaaataattagaaggggcgaggtttcgaacccaggtcatctagcccaccaccttatggagctagccggaagacccccgggtatttctcaccaatgctattatacatctcgatgcagaggctggactgatttctattataaaaagaaatagatatagttatcatgtagatggtgaatgtttatggtactaccacatagaacggctaaaattgtcacatgataaggatgagatgagagtgtgcttctggtaggatgaaccgggagcaaattaagctttgttggtcatcggttagctgacaacatttatgtgaatagtatccagagtactaaccaaagtatggtactccaaaaagtacagactatcataacttttagtagtacgtcactattattattatttgtctggaattttagtagtatgcgagacaaatacggagtactatgatacatgcatgattcaggctgtaaatctcagtgtaaatctcttccattatcttaaaacggcaatgcttccatttatctaaaaaaataactatcattagttataatataatattgtgctaacaatttgcatgatgaatttacccacagctttcttttcatcacagaaagatccttcttttcccacaactaatttggctttttgctaaaatttatacagcctatagtaagcctctgttcgctagttctggttgggaaccgatgccccatgcacggaaaacggagcggtcaattagcatgtgattaattaagtattagtatttttttcaaaaatagattaatttgattttttaaagcaattttcatatagaatatttttttttaaaaaaaacgcaccgtttagcagtttgaaaaacgtgcgcgcggaaaacgagagagaagagttggtaacctgggggaagaacttagcctaagctgtactctctccatatgcatagagagtttcagcagtgaattcaacatttcacattggaggcttggatagcaggtcatatttagatttaaattttatgttatcccttggttaattgttctaattttatttccaggtttactgatccaaattccacaacagagcctaaaattgctgtggtaatgtctaatacaactggcacatattaaaaaaaacatgactaataactctatacaaagtgcttatggtaataaaattttgaccaaattttattacaactttcttataatctaactaacttgaatttccatgcaaaccagaatcactccaaattttgacaggaaaaaaagggaagagtttatacttctcggggttttggcccaagttatcgcagcctaggcccaacaacacgggctgttctcactgggccaagacgggccgaagcggcccaagcccacgttcccgaagcctctccaccatcctagggtttgcttcccccgaagcacctatatataccaccacgcgccgcctctctcccacttcctccctttcccaccgccgccgccgccgccgaaaaagaagaagaagccgacgaggaggcgaccatgagggccaaggtaaccaacctccccgccgtctcctcctcctccctaggctgtctacgcccatgtgttgttgcgtcgtcgccgtgcttgttcttggttggtcgggggctgtgattacaaagagagaggctcgagtggtgaattttcacgggaaaccctagcgaggcggcggatctcgccgtgtgcccccctcctccccacgagcaccccgtgtgttcacggcggtggagtggatggaacccgaggtgccgccccatcgcgatgttggcttgggtatctcggtagttgcatccatggctcaccatgctagtactactccctccccgtccaaaatgttattgctacttcctccgtttcataaggttataagttcatttctgggggaggaatggatggcgcgtggtggtgggttgctgtctcgtgagggggtttcctgccacgatgaaggcttcgtttttaacgcatacacttgatatgagccccctttatgatggtattttttatgatggtatttggttggcgagctgaattcctgttcttgcaacatctgatggatggtgcgtgatatttgcttggattacccgtttgtcagttagcataggaaattaggtttatccattagatgctgaagatgctcattaattttgtggtgctcactgtttaaataatactccgtagtactgtctgtaggaaattataactattatatactaatagtagctgttaagttgatcagtaattatgtgatgctcactgtctatatgctattcctgctgtagtttcagtaggaaattatgaatgctttcaattccctgtgaacatgaaattcagttacataactgcattatcggtgattacctaagttaccatttcatagtagttatttttgtggtgcaaagcttatccagggaagtacatcttaatcattcattcatgatttgatagactttgtaatatgaaattgtcattctgtattttgtcaatctgtattgccattttgccatccatgatgcccctacttcagttggtttgttcaacaatgtctatgctggcattcttgaatcacccaagcaatgaatttaaatcaactaaatttgctgtgatgctatgttgcttcttgcttctgcgttccagtttctgttcacccttgtgttctttgagagaaggctactgtgttgtgatcttttgcagtttcttagctatgctaccatgcttatcggctaattttcatcagttaactttctgtgatctgatacttctgtttgtattgtattcagtggaagaagaagcgcatgaggaggctgaagaggaagcgccgaaagatgaggcagagatctaagtaggcgaaggagatgggcgatcatggtgatggcgtgtcgcagtgatccatgtcttcggctgccaagctcgttgatatgtcaagctgcttggcgtggtgccaccattcgactgttgaatggcttatttacctgtgctgttatcatcttatatccctagttttaccaagagttttgcaccaagacatgtcggttcagttatgtgaacttgttatggagccgtatttgctgctaatgtttacctaccgttgagtaattgctttgttggctctgtggtaacatctattgattgctgctttatctgttagcattggtgtgttgatctctgcgttattgcttgcttgatggtttcagtgtaggaatttccctggagacgctgatgctcagcctggacaggccttactttttctttagaagcttaacattgttttgcatgtctgcagttcttcggctggttcttgcttcctgtggtagcttgtttgttgttctacttagggcctgttttgcagggtttaacttccaaatttaactcaagagttggctttggagagcagcctgaaccctgctctctagtctatggctgtgtttagtttcatgctaaaattggaagcttgactaaaaattggaagtttgaagaaaaaagttggaagtttattagccctatcgtttggcctaaacagctaaagaataaaccaaaatttgattttgaaatgcttttaacataatttttttttaatgttggcttttaagttttgaaatgcttatgtgtgcatgtgatggaaaagtaaagttaggaactaaacaaagcatatgatttgagagcataccagtctgttctgatcccttttaaggcgaagctgaaacatcttggttctctagtttattttctgagaggtgcagctcaaaacagtttgatttaaataagccctaggagtatgtagtttggagatattttgcaaattttgaatttgctgttcattgcggttaagtaattttgcgtttatttcatatcgtgagcaatggtgtgacattggataggttgtttaaatctgttttagatgtagcgtggaaagattagatggaagccgtctaaatcatgttcatgaacgtatatttttcgtttatttcgctgctttcacggtgtttcgacctctgtgttctggtagcttttcttggtacgctgcgttggaaggatcagttctagctactcattgcatactgttcaatgttaacgatgcatattattgtggttgattgatgaattttaaactcagcgataatttgagggatataaagtgaacttattcatagactgaattaggcccaaatataaccgcacagcccatttcacatccaaatgtgggcccattacatggaggcccatcaccgtctcgcactttctcgcttctagtccccaatctgaagcccccctcgatggcatcgccgctccaatggacggctccgatccacccgccgccgcctccccatccgccgcagctgccgccggcgacgacgacgacgagcgagccgccgcgcccgcggcccagccggagcggtgcgaggctctggccggggccatcgcgggggtgctgggcggcgcgctgcaggaacacgaggcgtgcgcggcggccaccgctcggagccagggcgagctcgccgccgccgtcgaccggctcaacggaggtgagtgcgtgcctgtctctccgagccttccccccgcgacttccgttgctttgcttcctactgctgctgtgtaggctcgtcgactcctagggttttgtgtgccttttatggtgtaggaatcgtcgttcgagttgcgttgacgattttctgctatgtgattgattcgtagaaatgttctgatgcactaaggcgttagcttgcggcatacgtgaaccaataattaacgaattatgcttatagttcacgcattttgtgaattgtgctagtatcgagtacaatcttctttacaagctatgcaatatggacaagtacgtctctaattgtctggatattttgatactgaattactgatatagtcttcttgtttccagcattaggtagatattttcgtgtccgttcccgctgaacttttatctgtttgctacatggatgattggatattcatgttagttcaagaggatttcttttttggtttagagttgtattcaagtggtttggatgagttgaaattagttctatatttatttcaaaatcgtaacattgctaaagatcgtctccatttttttccttattgcaaaacttgttatgattggcttattgaaatagctgttaaactgatgcagacatgcagtacgatttcttgtgtggagttgaactagttcacggaacatgccattcatcttttgttattaaaccttgtagtatactgtacaataaattagcgaaccaggagatttactgactgtacttgtatggttcttagttccaatcataaattgaatcctcatttggttgtttgatatgtttatgattgggacttagagaggttatttgtatttaatttcaccctaaacatgaatgtatgaacttgtaaatcctagtaagggaattgctattatgaagatcaacatagtcagaaacttttgggatatccatactgtccatgcatgacaaagtacgaattcaattttggttgacctgcctatttttttgatctgtctatattcctcgaggtagtttatctacattttctacatctgattcttcctccggtcctcccttaaaaaaatgttgatatttgctcagtttgcctcacatcaaatatgttatttcaaaatgcggtttctccatggccctttgtacatgcactaatgaattatatgaaattacctttattcttttgcagaactagacaagctattagagaatgcaccctccccggtcataatgcaacaagccacaaggatttgttctattcgcaagagagttttagctctgaacatgctcctgcgctccatacaaagacgtatagataacattgatagaattgtttctactggtgtaacaagtggtattgctcttctacgatgaataatgtattggtctgaatctttctgtcaacactttgatgagtcccttatgattaacatcttgcattttgttcgcagatcattcttctcatgtacagttgcacagacagaattgaagttggattgaggtacagcatatagtccccagatgttggccttaataaaatatgctgacaacagattagtcctgatgaatcgaatagagatgcagagttgtgattttccttatttgctagtataatctagtgctaaaaactcgaacaattttatatctgaaatgttataagcctcaccaagtatcacataagaaatcttctctaccttataattgcatcttttattgacttgcatgctgtatatgacacccctgctatgaattacagggtttagaagatagtttccactgttaccccgtgtacacccgtttctatctgggagagttgccatttgaagttctactgtaagcaacattttcgtacgaagttgtgcctaaaagtgagagtaacatttgcagtttgtcctccaaatgagtctcacttactccatttctttttgccatttaatggagtgggagtaatatattggaccaatcttttttttttgttcgtactgcagactgggaaatgtacttcagatgtatcatttgcatttgtgaactttctttttgtgggtgaggaatcgtcactgcatatatcagatgaatgttgctccatcgacacatcgaagttgccaacaacgtgaatcaatcgattgtgttgttatatgttttctgttgtacctttctggccaaccttgttcccacatttcaaacaaattgtctaaattttgtttaatcgatgaagccgacctgtgccggcttgcgtatattcattgatgcggcaacgttagtgaaaacaagaaaatttagaatagttgttaattgattcatctagtacgttactatgtactcactccctttcaaaatataaggagttttggttagacttgacagtattgagatgtgtctcgtctaatt

SEQ ID NO: 9588 - DNA, 2049 bp, Oryza sativa
tggatagaggaaggaatattatggacaaaaatgaaagatagtacaagcttttgtttatctgctcagattgccagctatctagactagcttgaagtgtagtcaccctattcgttataaatccaagattttccttcagcctcctaagacggcctatcagatcttcaagagcaacaatatcttcactcgcaaaccaactcttgctcgcacatttttcctttacacgggggaatacttggtcaccatgagaaacaacctaggcaagaaatcattaaagcccatgacttctattatgcgttcccgatccagtgaacaataacatactcatacattgaactccattttagcaatttgagataaatctcagaaaatacctgaagcaggcgctgtagatcaagatgcattttggggaatctccttccatccaacaaaagtttcctcataaagtgaccacctgcaagcaagattcacagaaatatcataaataccttcaaagcccattaagagaaagaataacatctgcagaatgctataacaaatttgagcataagtttggctagtagtaaataaactagacttcacattgacttccattgacattaacctatgtagaagtagaacagatatccatagactacgtgagaaatccatctcagaaaatattctgttgcacatactgatcatgtgaaatgaatcccatctggaatcacagctagcaatataatcatggcatttcaggaaatacggttgctgccaacatgacattcagaaatttcattccaccatacataacaaactataaattgatgacctttccttcttctctgaccttacttcaccccaaatttataatttattggctgggtttagttccaaagtttttcttcaaacttccatcttttccatcacatcaaaactttcctacacatacaaacttccaacttttccgtcacatcgttccaatttcaaccaaacttccaattttggtgggaactaaacacacccgaaatcacctctaaaaggaaatacaccgcttcagaatcaatttaagcacgaatatggaattggaacttctccatggaacagtaacaatcaagaatcaattcaatagcatcagcaacctccttccaatcataggagtttttcatcaagttgccgccccaatgcggatggacaatcacaacagaatcgataattttcgacaaattcccaatttttagacttccagtttagtgtaatccaatgagcccatagaacaaagcaaagcacaataaatttctctcgtgcataatcatgaacaacagacgtaacgaagaagctagttcgtcctacctaacaacatcaccagaaaagggaaaaaaagggcaccaactttgtctaacgaatggagatgttcttagaaccctaataatttgatttatgtttatatgcgattactagtcaagaaagcaacctccacctacccttgtcgagatgcagctcgatgctgtcgagctccatctcgaggcgcgtgacgatgtcgtggacgtggtctacgtgcgttcccaggacgtgcacgaggaggttggacacggtccgcggcacggggttgtcggtgtgcgcgccgtcggcgtggttcatggcgagcagcgactcgagcagccgctcctcgatcaccaccccgccctcgacggcgcgcccgccgccgtggccctcgtcggagagcgacgcggtcaccccgagcggcacctcggagaggagcgacgcctgcgtggtcccgaacgcgaggcgcgggacgccgcccacggacacggtcaccacggagctgtccgtgacgcgcgcggcgaggcggagcgcgaacgcgctccccaccggccccggcgagctcacgcggagaaggagcgcgcccgccccgccgccgccgccgccgtccacgacgccgcagtgcgggcccgtggcgacgaacgcgaggatctcctgcagcgtgagcggcgggcagagcagctcgatcagcgcctgcgcgtggtggagcggcttcgcggcggcgcccccgggctgctgccgcgggagctc

SEQ ID NO: 9589 - DNA, 5929 bp, Oryza sativa
cgtgaaatttagcttaattaattaaggttggtcaggtgattataatgcggaggataatgagggtggtaatcttggcattggggttgactaatttgggaatctctctctgatgatgcatggatctcacgatgtgtaggtgttatataatgttagtttaattcgttttgccttgatttgttcatcaggtttgattaaaatttgtcggtttaataggtttttttattaccttgtagtttgagctataatagatcacgagctgattttttattttttattggggctaagatcgaggatttgttttgctgtatttttattttaaattcctatatatgaacatgggttttgccttcgatcggtgctccatatatgtgtattttcatttaattgaatagaatatgcgcacatgcatacaccaaagcacaccacacatacacatcctacttttacaatttgttggtacacataaatattaagcacactcgattacgttataagatacttccccgtcccaaaatatagctaactagtacatgatgagacattacctagtactacgaatctggacagcctcctgtactaggtccagattcgtagtacttggtaatgtcacattagctacattttaggacagaggaattaagagatttacgctttcgtctcttggagcgtaggatgaggatttatagggtatactcttcttcttgtgcatgtatgtgtaggctgtccagattcgtagtactaggtaatgtcacatcctatattaggtagctatattttgggacagatgaattaagggatttacgctttcgtctcttggagcataggatgaggatttatgaagtatattcttctgcttgtgcgtgtatgtgtgcgtcttctgagctatgttctttttcccttcctgaattaagataagtccttgaattttacacgtattcatgactcattcttacatttgttttacgcacgttaagtagttttagttttggtcaatccttggaacgaggactgatgatacatgaagccaatcacatcagacatgggtatatgaaggttctaatcttgttgtttcagtatggaagcttcgcatgaaggcgatatgatgtcacctatagtgcttaatttgtcaatgaaaaataaaatgatatggactatggcacttaatttatgaccgaaaaataaaactggtacggaaaatggtgcctaatatatcaacgaaaatttaaactgatgtggacaatactacttaatctgtcaatgaaaaaaaatattgatatggacatgtaaggtcaaacaagtgccatcttatactccaacctttgctagcatctcgtactgtttttgaccaagctggttggggatttcttaatttacaaggtccagaaaatttgctttgtgtatttcttttagtccttattttttaaaaaaaacattatgatatttcttaaaagtgtttactgctacaaaagacttattcctgcattttttctatgagaaaaaactacgaatcaaaatgtccttaaattattttttcataaatactaatatttgatttttcaatatagaaaaggcatattttatcagctccatgaaagcaacccatgccatgtctttatatacccttttctctagagcttaaactggataatcctaaacagtcaaatcttattaagaagtctttctgaagaagcttattttgcctggaaagatcaatctgtctatccacagtaaaagaacaaggcatgattcctcatctcctgtggccatcactatcttttttctcaacagtggtttcaagtttttttttcaactgcatgaagaatcaaaaactcccagagagcaagtgcaatgttgactcagcttgtccaaggcagaaataaaaagaggatgaggataaaaattccaggacacaatgctgctcatctcatttccattcctttttgctaaaaagcacataggctagcaccatagccagcatatttacatttttttttctcacaaaagaagcacaaacatggcacatttcggatatatttttttcttcattttttgccctattgtttttctcttgtttatatcaagcttcaaaacacacttgatttaacaatagctttgtagtaatgatacaaatccaccaagggtatcaatcatccatagacccttgggattaaaccctagatgagcccctgttcatcatcttttccatgaggtgacaccaacaaccacattgctcacctataccataacaaaacagaacagtcaatcaactggacatttcagagctgaaatacatgtactcttcagctatcatttcagaagtgaaactttctgctattccaagaaaaaaattcagaaggaaattttggttttagggtactactagttaaatgtctaggcgttgcaatggacccataaaaacaactatcatatttttgtctgatactgaaactcggtttttctagcgagaagacgacatggaagtcggacgtgcactttttttttctctcacgcggtgcgggaaggagggtgcggtgggtgggccggttcggtttattacaagattttctcgtgctgcgtgcggtagggtgggatgggaggactgcgtcttttaaagtagtagatagtagagatatatagcctagagatgaggcttaccagcttgcccttatcatccagtgtcttaggattctctacaaggacagtttgaggccgagcatcctgcaagtaggagaaagaaaaggaaattcagagaacaaagctagcatcgtcatcatggaacatttgacatcacataagattcagattgtttcatttgtcccaatggaccatcatcatttagtttcattgtcctgataacggaattggaagataaaaatcttggccgaggcatcgagttctgctggctaatcataggtacatgcctactttgagaactgattccatgaaaaaccatggagcaagctgaacctaccaaagttgtcatcttttttaagaagaggagaaccatatgcatcccctagttgatgcaaaattaaagataaaagcaagtgctggtttgttcagtcaatggtcccatgaaattttgttcacagaaatgagaaaatctaattgaaaattccatattttcagcttcagaaaaacctgtgccgactactgatattctaggcaaagttaaaaggttattccatctttccagttgatcaactcaggttgctgttcagttgtggaaagatcattcaagaacacactaactatttatcaccagggttaaacctttcggtttagccgatttgatcggtcctcatggaaatgccaaattttttgaaatttcggtctgaaatttccgaaattttgaataaaatttagttgaatttgaacaaatattaccaaagttcacgaaaaaattaaaaaaataaaaaaatttggccgaaataatatcatatcagagaggtctaaaatgtccgaaatttcggaaatttcgtttcggaatttccaaccctggttatcaccgagccgatgagccgacgatgattactaccagagagcgaaaccggagagcgaatgcgcgatgcgagaaatatagagggtagaaacattcagagatgagaacataccctgacatggttaacatatctgcaggttgcacactgcacagttgaggctccaggtgggtgcatcagagtcgtccggcactgcccgcatgtcaggtgtgcaatctggttggctgaaccaccaaataaaaccatccatgatcagctcagatttcagtagattaatttcatcccaatttgcagctctgaatcagctgcaaatatgatcttttcagagaaagatatagtatgtgcaaaaatatgatcattcacctgatctggtggagttgagcctgttgcagctggggcagcggatgttggaggcgccgcggttgtagaacagcagcgtggggcagccgctgcagatgagctccgacatgtcggccaccgctgacgggttgacggcggtgagcgtgttgcagcccgggcagcagacgccggcgacccctctcctgtactggacgacgcgcctgcagccgctgcagatcagctggtcctgcatatgcctgcaaattcaccaaattcacagctcattcgattcagagccacaacaagaagatgatcacactgaactgaaccacattcttctccattcatccaacccatatatcattttgttttctcgacgaacaattactactaaacctgacacactaaactacagaaagatgagataaaccccaagaactgcatgctagctaacccaagattacatctaagaagagatcaagagcattaccaaggcaagaacagcaggaagaacaagcacctgactcaaaaagccaagtgtgatgaactgtgagagagaggaagaagctgaagcaagaagagctagatgagcttggagatcgagtgctccacggtggcaggagacgaagctgggagggaggtggatttaaagggagagggggatgatggccggattcgtttgggataaattctcggaatctgcaaagaaatcaatcgttcgctcgctcgctcgcggcgacgacgacgatggtggatggatggatgaatcatcagcatcatcatcatcaccatggatgggtggatggatggatggagagatgatgcctttcggatatgggcgaattactctcctctcctctccaacgacagaatcttttctcttctttctttctttcctacgcgccaataattctcacagctttctttgcggctgcttgcgaaagattaatactagagaagtgcaagttaatttgattcgattctgagctcaattctcaaggcaagtttgttagttttttgctgcagctgcggattagaaggagtagctttgcttaatcagtcgtgtttgcatgcatgcagggtgatacgtttgttgagctgagcttggccttttttggggtggtggttttcggttataagccgtacgttttgtacctgtaactgtcaggaggtctactccgtattgcagtagcagtcttgcagagatcggattgaagatttgcaggggaagcgtgatccaaatctgtgctgaataaaatataaatcgatctgtgctcatcaagacaagagggggaagtggcaagccaaacgtccaagtccaacgtgctggtaaaggagcttgtttgcaacttaaattaaaaataaataaaatttcacaaaactatagatactcgatcaaactatcgcaaaactataaaatatatttatagtgtgtgttgtatcacaaaactgcagatttagcatggaatttctcatgaaactatatatatttaaaatgacgtgtcacaaaaataaatattaatagcaaatttatcacaaaactaaatgttttagtgccaatttaatcataaaactgcaacgtttatagctccaacataaccgcggtgctagggatttaaactctataatctgtagttttgtgataatttcaatattaaatatgtaattttgtgatacttggccttaattaaatttgtaattttgtgataaatttatcaataaatctatagttttgtgatatagttcctctatcccagtttgatcatcacctaagatttttaaagttttctcaaaattatcatcatctaacaaagtgtcccagtttatggtgttatgtgaaatttactcctaaaattcatcatactccttatgataagataggcttaacttaacacacttcattatcacaatgagaaggatataaattagataactatgtcatcgtcaattccaacttgatcgacttctctggtagctatggccatatatatcccgtacagaaaatatctactgatatttgaagctccatgtacaatcaggaatgctcactccgttctaccctctatcacaaaagataagatataaccatc

SEQ ID NO: 9590 - DNA, 2254 bp, Oryza sativa
tctctcattctccgaacataatttaaatgcacagcatctagaagtccttttcacttattcttaatttcattaaaaagcttagaaatgcttatattttagtaaaacataggcagtatatatgctcattaattcacctgaccttgatggtttatttttgatgattatatatattggaggagagaatttttcagaaaaaaaaaattgcagtgagagaattggaaaagatctgcaccaataatgggtaaagtatatattatatcagtagttcgttagagattctcgatggagagagatcgaaaggcgacgttggtccagaggaccagagaacaattttttccctcctagtcagcgtagaccatcttctactgtagcctacataattccattgcccagccagtggcgtgccgccacgtaggcgtctgttcatggtcattttctgctgaaattccattccgttactgataattttgtgacacgtcagcgtttgttcctcgcgtcaaaatcagaccatttgtcaaagggaatacttccacggatgggcgacacgtggatggctcccatcggtgatagggtgctcgatcccttttgcttaggagtatcagttcattatctgtgatgaaatccatcaccatgtgtcgatgcattgcatcctgcagtcagcaatcatatgtatgtttcagagaaactgtgaaaaagtcaaatttatattgctactcctatatgatcaggctggtcgattataaccaagggtcattttaagaaaaggaaattcgatcctgacaacgatggtggttggcatttctgtttactatttttgttgtaggttagtggtatttcttaaatttattttgataacgaaatcaaaccaacatccaaaagctcacttgttaaatcacttacttctggcatctacaaaatgaaaaaaaaggttctaacctaattaattaaaatatagggtcttttagggaaaaaactaaacgaaaaaactaacgcaccattatcgcaaaacaggaccaaacatattaaataagagaggagatcgcaaacatattcttgcgataaagagaaatataaaacttgataagcataacaaagacattgcatatcttggatggttacaaaagatatgagcagataagtgcagccataacattgaccaactccaacgcaagtgaaagcatatgaatgagcatcagccaccattttagtttctttgatagtcagcaaacaagcattaccgaacaagttggcaacccaaacccaaaatttgatgtcaccggttggatcatcagtaaccccgttacacaagaatcctaaatctggcatcattggttggatcatcggtaacctagcaaacaagacctaggtcttccccgtgatcctaacaaagggagaagtcattgataaagagatagaaaaagcaagatgctaaatatatttaacccatagacgaaagactaaccctagactatctaatacatttaaaacctgaaagacttttgagaaaacccaacaacttacttcacaacgacgagagacagagccttttcaacggatccccttatccctcgtgccaaccagaactcgagaaggcctgagaagttttatctacatgttgttttccttttcttttgagttaaaaatttacacggtataacactacaagaaaatttgacatttgatggtgatctcaaaatgtcaaagtgaagtcctagctttgtcatagaacaagttatgtgacaaaattctagcgtcataaggctcgtcacggatgacacgtcggcaaaagtatctcgtgacaataataatgtgcatcgccatatatagaagcccagaacccataatgatgatatatggtcacaacaaagttgatttaattttttttacatatcatgtgcatgaagtttaattaggttatccgcagaccgcaaatacgtttaggcgattgacactaagaaaagtttaggcaatgatatatcgatcgactaatagcaaagctgttttctcaaccctatttaatttaagggagtatctaaaaaattgttgtaagatttttgaatgtaaaactttcaaatgtaactatagtataattgaagtgtaattacattgtaactgcactgtaactgcattgtaactacaatataacttatactcctataatatttgtattcaactatgatttgattggcttagcaccggggtcttacgcatgacatgtgtgaaatattcttaatctctagcaattttttttctt

SEQ ID NO: 9591 - DNA, 2876 bp, Oryza sativa
  unsure (1)..(2876): unsure at all n locations
ccattgccaagaaatggtcaagaatcttgtggacacaatccacatcatagagcgtttcaacagactcagagatgtttggaatcagaagatcttccagggtagccttatcaagctgcatacctatccgtctctccaagtttgacacgcaagaagggctggcttttaggatgattgctgtccgcagaagaccaaataacagcttgcaagatgtgacccccctttggaaaggtaacagtctatcaatttcctcaagtaggtacttttgttcctcttcagaagggattgatgttaaagatgatattgaaaggcaactgctgacatcactgatgcttttacgccgattcaggccaggtaaacgccttttggcatagtggttcaaggatccaacaataatatcctgattgattcctcggtattccatagctgagattacttttttgtataatggaaggcttaagcatgaaacatcatcataccaccaatcagggctgctatgtcttggccttgctccggtgctaatgccattccacaagacgcttcctcctggactctgcatggggcctccgtactggacaactggccacccaaataaatcaggatcagtacatgatctagttgcaactgagtcgatgcacctctttacgatttgcaatttttcagcaagatcaatgatgtcatcacaggtatggagggccttgattgaatctttccaactcctaaggactgtttgggtaaggaagttctctgtctgcgcaatcaaattcccctcagcaatctcttcagtcatctcgagatattcagcagcacagcgaagatgcacaacattggaggcagtcatttcgaacttaacaccatagcagaacttagcagttagttcaaaagcctttgctcccccaggaatatccgataggtcaatgacacaactgttgtctccattctcaatcttctctcggatacaacgctccaaaaggccactctttgataatagaggaaactgcaaaatagaaaaagaacttgctttttacaaagtaattatcttcacaagattgtatctatttttccctccctaatacaaattatctactccccccgtcccaaatataagcatttttaggctctgacactgtcttcgagatgctactttgaccaacaatatctataaaagtaagatgttttaaataaaaatagttgcatattatgatggtttgtttaatgataaatctagtaatatgaatatcaattttacatgattgatcttttttgtttttttgctattaatagtcaaagttaaaaatgtttgacttctcactatactaaaaatgcttatattttgggacagagggagtagtatgttttggtacaaaggtttcccaggctgaaagcaaagcgtaagccagttgcataaatgctaaaagaaacatattgcaaaagaaaggaactcttgaatgaactagtgatgaaaatcttaccttgtgaagatgaaaagattgctccccaactgtgacggttatatcactaggaagaccggttgtgcaatacctatataatgaacatgctcgtcatcaatacttttcagtttggacaatatttttccagcaaaaaattcatatgtaaaaagctagaagtttagggactggaatagacacaagagccactctacaagtgtggggcacctaaccagatccttctaggtttctgccaccccacggtcaattgctatagatgatactccctccgtttcgaaatgtttgacgccgttgactttttagcacatgtttgactgttcntnttattcnnaaaatttaagtaattattaattttttttcaatcatttgatttattgttaaatatacttttatgtatacatatagttttacacatttcactaaagtttttgaattaagacaaacgatcaaacatgtttaaaaaagtcaacggcgtcaaacatttagggaaggagggagtatataggagtatattgccacatgtatacacacacataaagttgcatatgcatgcctgcttacctggttgttgagatatatgcatgatatatataggctgtgatggctttgggagttgaacaccacgtagcaattcttatccccaatgttatccgtcttcattcccatcactcattcacaagctagctagcaaacctgcagatatatcactactagctagtagtatccggcaaactacctgatcgatcaataggattactactatgccttaatggaaagacatccttgtaaatatgcaattatcacttttttatttgactggaaattaatatataggatacacacatatgtagttactccgctcattaatatataaaattcttacactaaaactagtaacaccatggagggactaacaatctatatactaggtgaaaccccgcgtgttactacggaagttcagtatgatgacaatagctaaacaacatgaacttacataagttaatatggtttatgataatttaaatttaaatagtatataaaatgatgattcaaatgtaaaagtaagatgatgcggttttatgagaaaggaaagggagtgagatactttggaccatagattaatcatctaaggttaaagtaattgatgtgatatgatttaatgggagaagagagaaatagcactaagtgaggatgaatcatataggtatatatgatattataaaaaatgatgaagaaatatattgaaatattatgtgaattatgtgggatgatgatttaacatgtttatattgaaaaactctaaaatttaacaaattataaaattgttagtggatgatgatgtggcatcttgttaatgcatgatgatgtgtcatctttacatgttgagctttaaaatttagtgtgttataa

SEQ ID NO: 9592 - DNA, 2004 bp, Oryza sativa
ccccagatgaagccaacagcaagaggtttggccatgggtgtgtacagaagcttctagtgatatatagtactacatttttattagtagtatgaccaatagcacacaggcaaaacactcttatgggctgataattatactactaacgataccaacaaataaagcaattgagaattgcatgatagtggtactactgtcatttaaagaaaaaagataaaaagctgaactaattatgcagattaggcctgacagagaaacatgttgtggaaagcaagctgctgttcataccagtcttgtccttgctttctgaagacatcagctcttgatcctagcttcaggcaggccatggtggagctcctccaaaatggtcaggacgatggataccactacatcaatgaaccaccagcccaccagagtttcttcagatcaaaggctgaatggttcgagctttccacacactcttacaccaaaccctaataaggaaattgagaaaaaagtaacaagaacaccactttcccccgaggaaaaaaaactcaatccactctaaaatcgccaaagtgaagaacacggactgaataccatcagagggcgaagctgaagatcgtgcagattacacggagcagccagacgaagttgcacatctacagaacaagagattacttcaacccccaaaaggaaaaacaaatcctcccaaaactcctgaaattcccacacccacgcaaggaaagcagatgcctttcgaagccaaaaaaaactctgatctacaccaacctaaaccccccaacagaaaaatccctcgctaaaccatcaacaccgacacccccaagaacccccccaaaatcgaaactttgagacaggaactcgagccccccaaatcagaactccaagagaagaaaccaccaaccaaagaatcaacccaagaaaccagcaatccctgctcctgcagtggtagaagaactgggagagagagagagtaaagtgaagtgcaggccgaaacaggggggtggttcttgggtttgtttgggtctttgggtgcggatgtggtcctaggaatgtttatggcagggggcatacaagaacattcttttttgtggcctcatcacagtttcccatggagaagaggacagaggaggagaatggaatggaaattggaagggggaagaggagaggagatgtgatgactgatgaaggaaggaggaggaggtggaggaaaggtggtgatggtcagggtgtggggcccactgccagcaggctctcgatccactttgggtgtactgtactgtggctccctgatttctgattctctgtcccagatggaccgtttaggctgagtttatttccaaactttttcttcgaaatataaattttttcatcacatcaaaacttgtttacacatataaacttttaacttttctgtcacatcaattcaatttcaaccaaatttttaattttaacgtgaactaaatacacccttaatggaagatcatgtcacttgcaacttaacttcctctcaatagtgtagttattttttttcagatttcgagaaattatagttatagaaattaaaaaataaattagaagtcacaaactagaaaagtacagtttttctatatttttgtaaattgatctgtttctcataattttaaacttcctcaaacagatgtgtcttctttcaaccattattgacagccatggaagaaggtggtggtagaataatcctccttgaacagtagtaggagtacactggttaggctcagatcaattcatcagtcagttggtaggttattggctttttgcatcaggtcatacctgtgggccctccagattgaggtctagatgattctcactttggcatctactcctacagtcatactccactttgatgtccattcaggttaggttttggaaaaggacagttttatatgattcatgccggccatactttggcatattgggccattttagagcttgtttattttaatacgaaaataaatgttaccatttggt

SEQ ID NO: 9593 - DNA, 1208 bp, Oryza sativa
tcaatgtaaaggagactaaataagataagactcaagtaaacattagtctcacacttatataacaataacatggaaatcatatatatgaacctatcaaaaagtaggtgataagaagtgatacatatcgctttatctccatgaatttcatccttgtcatgattaaggtccatcatcaaagaatgcatatctaccacatctcattatcgggaaataaccttgttgaaaacttatgtaaaagagaggttaatcccataaacatcggtttatcatctatcaccaaagtaacaattacacaaattgtttaatccaagatttttcaatcttttctctcttttgtgatagataataatccgatataaacaatacaaagagatgggatgaaagataatttcaaatcaaagtagagatcttataatgaacaaaatatagaataagctccccctaaagatgtgcatacatatggatatgaaggaatgcatatgcacataatcaatcaagatcaatgagggagctcacactatattttggatctacaagagagaccaagttagaatatgtgaagtttaatacatacctcccatcatttttgctttcatatccaaataagactagtcaaagaaaggctcataaaaacgttagtctcatataattagatttatcattaatcaccgaaaccaaattaagtcacttgaacttacagttgcttagttaacgtcatctgtacatcatgaactatggagtacttgataagattgatcatggatggaattttcgacttttaagtattattagataatggcaaagtttatcactcataaatgagggcatatacattttttaccaaatcatgaagaggtatatgctctcccacgtaatatggttggctacatgcatgcatgcatatatgcgtgaataattgcatgtatacatgcatcatatcgagagcagtgtgacacgtaggtttattatcatggtatatatatatatatatatatatatatatatatatatatatatatatatatatatatatatatatatatatataaatttatacatgttagatcctctaaaaaatattatatatattatctatgtgtgtatatatgcgtgggaatatatatatacatgtaatgcacacgtcgatgaagaatatcgtaatgttccaaaaccgaaatttgagtggtgcttattaatttgctcgcaat

SEQ ID NO: 9594 - DNA, 635 bp, Oryza sativa
  unsure (1)..(635): unsure at all n locations
cggccgtgacgccctccgggtagaacacgacggcccagtcgaacccgccgacggtgaaggtccccgacgccacgcggtggccgggcgcggcgcccttggtggcgccgtacccggcgacgcggaacctgtgccgcccctccaccgtcgccgtcgtgctcgtcgacgtcgtgcactccgtcgccatcgnnnnnnnnnnnnnnnnnnnnntaatccgaatccaccgctaattttgtataaatttcgtgcaaatttacaaatcaagtccgaaacaaaatccatctctgttcccttcccttgaacgtgtcggaccgaaactatgaagttgggccgcctaagtgggccgagatgtcagtcgggagaggaagagtttgatgggccgatgccgcggggaatatctcggtaaatattccaaaataaagaggcaattaatgaaaagattttttttcgaggtagtaatttaatgcaaagattttttttgggccgttaaatagcccacccggcggcggcttctcctcccattcgcttccactcccacaccgatctagggtttctagggttttgggttgcggcggcggcggcggcgagagggcgagggcgaggtcgagatggcgtcggagagggtgaaggggacggtg

SEQ ID NO: 9595 - DNA, 2334 bp, Oryza sativa
  unsure (1)..(2334): unsure at all n locations
ccccaaagtgtaataatataggagttagcaaagaagccccaaagtgtaataatatacatctcatcggtcattttgaatttccggttacttgaatcgatattgtacattggtaggaaaattggagtaaaacatacctataagtttattcatgtctaaagatattcaagatatatggtggagataatcccttgtataccgctaaaattttaactgatcctttctatgcttctgaattttgtttacttccttgtatacctccaatatttgattttgatcctttccatgcccctccattcaattgaccattagttgaccgtttaatttctataaaaataaccattttacactttgaatgaacatagaagtttatgaattacattattgaaaatataaaagtttgtcacgtgagattattaatagttatgattgctatgcgatacattatttatgataaaatttacttttagataatgaaataaaaatatatatatttattttattttttgaaaatcataaaaatgaggagcattcatacaaatataggactactaatgctcacgatatttttttaagaatgctcccgatcaaaaaaaatctattgtcctattaaatttcaaataaaaaaataatttattacatttgttttattttcaaaattttatgaactaattatttagtctcattagttacttaaaatgcacacactctgcacacaaacaaaattttcaattgtttttcaagcttatatttaaacctaaatcatcaagggcattaaagacatttgccaccaaacttaacggtgaaatgaagaaaaatgtaacgggaggggtatggaaaggatcaaattgaaattttagggatatagaagtgaacgggtaaattttaagggtatatagggaatttactctatatggtgtctgaaacaaaccgtagatatataaccacatgttgatctagctagtagaaaggtaccgtaaaagcancccaaatttgggcggggggaaaaatgcttcaattgcccccttcggtacacttagttttacttaatttaaattaattaagagttttgtaatgaacggtcattctataggtattaactgatagaccgcaaaaaaaaaaccaaaattaataggaaaaaataattaaattggtgtcaaattactagttttcagggtttattctaagttaattatagttggtggtatactttttcaacaatagtattaattaaaaaaattctgaaatgtatgtgttgtgatattatatatatatatatatatatatatatatatatatatatatatatatatatatataatatcactgtctatcgattactaataattattaagggtagcaggagctcgatgcggttcatgaattggcaggacttatgtcttcaaggtaagctaattcttgcttttagcttggatttgattgatttatacgcactcatgcacagaagcttagctttgcatatatgaattgatgtctttctcctaaaatataatataacgtgtagataaagatatttggctacaatgttttcttaactgtcttgttaataaattgaatttcatgggatgaatcacagaatctgtacatgcttcgagtaaagaaaaagataagcagtgtagtgttaaaatgattttgtgatatacggttaatcagatcaaagatttgagcaaactctctacccattcagttgttcggtcagtttagagagagagagagtagtgctaggctcatctcaccttataaattaaatttgataggtggacttgcgagatctacgaatctggacatctttatatctaaattttgtactataatgtatcacatcgtagtacgaggttgaccttttttggacggagggagtatattatatcgcggcatatgtgtgttgctgtaggatcaaggaggtcgactagagggggtgaataggcggtttttcaaacttttggctaaaaccgagttttgtatgcggaagcgtaaatcaaaatggttttgcacaattcaaaacctaaatcaactagtctcaagtaagtgcacaaagaagctagcctatgttgaggtttgcaagcctagggtgataatagcacaaataaactctagtatgtaaacttgctcaaagtaaatttgcacaaaataaaggagacaagagacaaggaattttcaccgaggttcggaaactcgccggtttcctaatccccgttgaggcgagcccaactccaccgctcaaccacgaagccatcgcacgcccccttcgtcaagagatgggcaaggcgggagtcggcccacggagaggactaccaaagcctcaatcactagggt

SEQ ID NO: 9596 - DNA, 7709 bp, Oryza sativa
aaatgaccacatatactatattgtacatattaatttcaaatgtaatgcaattttaaaaatttgtgtgcaattttaatacaatgtcatattttttaaatttgtgtacaatcgtatctattggtttgatcaactagtttatttgcatgtagattttgaatcaaggaaggacaattatatgtgagccttggtttacggtcttcttttcattcgatccattagtaaatcaattgaaatgaacaaagcatatatgttttcttaggaataatataatgcataacaatcagccatctataactctatatgtattttatttgttggtaagaaaggatcaccttaaaattattttctcaatcaagtaatggtaaaaaagaaaatgcaatgcagtagattaagaaaaagaaaaccagcaggtcattatatgcatataaatacggattactgagccaaaatttatatacgtgttcttaactatctaaaaataaatgctgaaaactaaactttgataaaaaaaaactcaaaatcaacttcaaatttaagagtgaaaatttaaattttgactaataagtgtaagtataagcgaaaagatgaggttgtcttatttgtataggttgggaacttattataggtgctgatttttttagctggtaagcgacacctttcctcaatcgaataggtgccagtttcaaaactggcacctatacgaatgcaagggatcctgtactaaagttagcgcatagctcatagtgacaggttgcagataaaagtgcaaatcaatcagctagctgcttgcagatctcctttatttctccatggaaatatctatctagcttgatcttctcaagatccaaatattgacatatgtactctcacacgacacaatatatactttacgtacattctagcctgtttggctggtctcacacgcttggccgaccagctgattagtatacaaacacagacgcgtacgtacgtgtttttcatgtagaataattcattgctatatccaaatatatagaatttccctcgtgtttaattcatgtagcatatctaattaaataagcccacaaggatatatgatgtggtcgtgttcgatcagtatgcgagctctagcacgtgtccattgaatttaatgtgtcaatacatatactctccaagctctctctgcggtcaaaggtagttaattcttttttctaaaaaaatgaaattcaaagtcgaaagcatatttgtgaaacaagtgtgttgatactccctccgtttttaatatatgatgctattgactttttcagataagtttgatcatttgtcttctttgaaaaatttatataattatcattcattttatttgtgacttgatttatcgtcaaatattctttaaacataacttattttttatatttacataagaaatttgaataagaaatgtttgtcaaaagatcaatgatgtcatatattaaaaaaaaaacagatgtagtatataggacgttagggccgccaatcaaaatttttaacattcgtgtgagaaggctattgttatatattttgtgtcaaatatatgtacaaaaccaattaatatataggatttggagttgtaatatgtataagatataaatatataaagttaaaattttatcttaggttctctgttaatagtcccacctaagataaccgaatgactacaatagcttagacgaggaaacaattggccggtcatttagctagtcgaggttgttgataccctgatatgatataattatatatggtggtttaggggtgagcgctcgtaatcagctgcccatcgaatattctatatatatcattaatctttcgtggatgtctattatgattgatggaaaaaatggtgcattccataatagggcgtgtttttcattacatataactacaagcaaatggattagaacagattttaggacacctatatatatagttacatcatatattgcttttaaccggtcgaatcacattatctgagcatggctacctctatgaacttccaagaagccacaattcgattcgtgtatatatactaactttatttatagttacaaattataccttttagggaatcaaatagctgactgtgctttgcattagtttgatgtgtaaaaacaagctctcaactaattaatccatgccaagaaagcaatgcagcttttgcttatccggtatcaacttaccaaaattcgacacaaaggactccgaaggattaattaatgaagcaagcaatggtataagatcgatcagtattggtctaataaatttattgaaatccaaattaatttaaagatgtgaagtggagaatcgtcgactcacctttgcacttttccaccaatattcgatcaaattggaatgtaaactactgtcggaagggtaattaaactttggtgatgatcgatcgagccaagtgcagaaaagaagagagaacacttgtaaacaaatggcaagaaagagaaagggatgagcctggttacgtggcaaggataactttacattcaaatcaaatattcttccagataatcttgtagaaaagaaaggacaaaaattatttagtttgtggttactgtactacactgttcgttggaatttggcttgtaaggggttattttttttttactaattcacacatgtaactctacaagtttgaaaacaggaaaggtatcacagtctgtgtacatcaattaacaaatgccaccatctattttttttaaaaaaacatgtgcttctaatagtattgcacatatctataaaatattaactttaaatttattatattctcaccataaaaaagaaaatctgttataattttattttttttcacgactaaaaatataatgaatctaaagatgatactttgcataaattattagaagtatgtgtgtaattttctctaaaaattttgtgaaatttgttggtgtacacagaatgtgcatcgtaaatttttgggcatatatgatatgattcccagaaagcagggactcaatccttccatttttttttattgtcatatagatcgtgacacaaacttatccgtccattcctttatttttaacttatcatctaggcatttatcttttacgactatatgtttatgaaaattatataaaaataaaactatatgaaattatttttttatggcaactctatgaatatcattattacatatcaaattttcacaactttgcagttgcagatattagtgagttaatattttgatgtttgacaccatatatacatatttaaacgatatatatttataaacgaaagggagtatcacattaagttcttagacccggctgaattcaggagaaaaaactctgggcgtccgactagtaagctacatgcaaacatatatattgtaccagccgaattcaggtatatggcttatatgcactgggtgaagaatcatacattagtcaaatcttatcctcctaaatatagttggatacttggatatatacagaatgttcttgccatagagacatgtaaaaataaatgaatgatgcatacatgttatgttttttttgacagagtggggcttgcaagaggcctttacaggctaatgttatgttaatggtattttatatttttcaaaagtgatttttgaatatatttaaaatacagattgacatttgtctatttgtctatataagctttttgtaacataaagtttttaacagaatgttttatctgaagaatttgttagtgtccatgtgaaagttttttttaatatcgacggtaagtatatttagcaattattcttaatgaaatatgttactacttttaatatttctacccacaattttttattctttaattcctaacaagtacatacgtccagatttgtaaccatgatttgattttttatgagacggatgaagcatatggctatgttcggttcatattgctgcagtcacatcacagctaaaatgcccccacgcaaaagaaaacatagcagctgcactgtacaaccgcaacaaatatatatcgaacacaccctctatggcaaatctttcaattgtcaagaaaaccaaaattttcgaacaaactccggcgctcaaaaagtggtgaatttaactatttgccactctagtcaagtagccactctcgcgccatctcgcttagacttcaatgccccacggtgatagaacacggcccactgtctcctgcatgcgcagcgtgggccgaagctaacgtgatggcccaaaccatagacccagtcacaagtacaaaagctcaaatatatatgacgttgtgtattgcgaactaatccataaccatgtaaaacatgtcattttattagcagattaatcaagtattcattaaaaaattttaaaaatatatattaatataattttttaaatcactttcttatagaattttttgaaaaaaaaatataccatttagtagtggggaaagtatgcgcgtggaaaaccaacaagtagaagaacacatgttgcaagtgaaaatatgaaggtagcgttagccatgttgcaagtaaggtcaaaataaattgaaatttgcattaatagttaaatattggcagtgaaatttactcaataaaaagttttcaaacaaactcgcccaaaattaatggggcgggacggcggtggcagccgtcggcgcctcccgaggccgtcaccggcggtgggtcccagcgcgatgcatcgccggacccgtgcagcgacctcgacctcatgtctttctcccgccgccgccgccgccactgctactccgtcgccgctagcttctcctccttcgtcggcgcagtggcgccctcgccggcgacttccctcttcgaccaggaatttcgaggggcttgctgacaagtacaatctagcactcggagagtataaaaaaaatattatcatggtttcacagagcatgctcagagtctttctagcttcagatttttttttatcattatttttttctaggttcagatttgaaagagagaaaacttgttgatatattatagggtgcataaattcatttaaatttagcccagcccaacctagctttgggagttgggtgagacagaaatttggcctagcaatgcattcggcccagcttgtcaagatggaattgcactactcatgtagtagtaatcattcatgctctgcacttctgcaaaaatcaaaaagcaagtaaatagttgttaacttttaggtactccagctactagtgcaacatcatgagcagaatgtacagtagtgtggcaattaataaaaacagcaatctggctacagtcgaaattatatgtttttgtacgaaaatggtgataaaataatcaatgcaggctaagaattgttcctgcttattaacactgttttatgctggcagtggtgagaacagtgatttaattggttggagatcaccgttttttttctttaccacgagtaaattactgcagagccagctcggttttcatggagctattttttactttgtgagttgtcttcttttcatagcttgtatgtgtgcacggaatattcttcctctctcacacatcatcacccccctatatatagagtatcctctcccattcaccttgcacatcaccacatcatttctctctctctctctagttcttcctagctatctctctctctctctagatcttgtcgtcctcgtcaacaatccatggagaaattgtgtagtagtagttcaggagatggtgattgttcatattgcaacatgtattgtggtagcaaatccatgcataagcaatggcattgacatgcatggagatatatgtgtagcaaagatgagagatctaggtgacaagagaaggagatgatggagatcaatgcatggataattgatctaaagcaaaggtgatgatattgggaatgtgcctggctccctgtatgccactcatctagagcaacaaacttctgcgagaggttgcctatgatggatggcgtgcacggagccaagcatattccctcctattttccaaccttctcctaattaatcctttcctttctccgaattggcttggttgcttattgttttcttacatatattatccacgcatgtttttgattttatgtttatgcatggtccttcgacttctacatggttaattacacgataattcgataaatatatgtatatcaagtaggacaaacgtttgtgcatttgttgaagtttgagggaggttcgtaaagccatatatatgtcgattttaaattctttttgcaagctaatattatgtttgttgataaatatctgtccttgatgtcatctcattatctcttatatatgtatacctttttattctgttgtggagaaatatatggatttggactattcttttgggataattgcctgcaggcagctattccacggacgactggatcttgatcttgatcagtattattcaatgtgatttgcaaaacagtataaatgcaatgcattcattgcgtacagtatttgtatatcctgcagctaatgcgtggtaaatgaaatgcattgtttttctccattttttatagatatattatacgtactcctccaggtattaattgtcataataactagttaccatttccccctttcttctctaatatgaatggaaataagttttcccttggaagattttcatgcagatttctatcaaatcctcctttcaaaattgcccacaatgattatataaactgatggttctctccattgttactagtaatgtataagatactagtaatgtacatatctttgtgacattttgaaacaacatgatactagctactaccatatcctgcgagatgttctatgtaaatctcatattagcttaatttccctctttgaaatggattttgggataacaatggaaagcatttaggttctgaaaaatcatctaaatgagcatcattaacactcttgtgcataaatgttcaaaaggattgcacgatatcagttaaccattgatttcaaatatatgttttcaggccactttgatttgaaaatagcatattcactccatgcttatccggaattttctccttcataaagttacctcatgtagatatgcctgtttataaccatgcaaggcttgactaatcgaaaatttgaagcagggctcagaattctaaccagtttgatttatatgttttttttaatgaagtttgatttatatgttgtcgtctgagtgatcatataggagtgaattctagagatttttttccccaaattatgaccaagtctagccagcatgcagctgctctcgagtggttggggatttgaagacccattttgatcaatagctttgaatcttccatgtaccagctctatgaatcttcaatgtatcaatttttttttaatgaagtcaatgaatcatatttcatgttgtttaaatctggttgttccaggttttgttattggaataaatcgaaacttcgacatcttgagcacccagtgtcaatgttacatcgattcaacaaaaaaaaatgaattcgggaacatgcgaagtgtttgtacgcgtttgtatcgagtaataaaaagcatccacatacaggaacaggtacaaataaagctgacgccaaacaagtggctggactgaaggacaatgcagagactgaaaactgtgtgaattgtatactatatattcaaatttgattccagatagattcaagaaatgtccattgatttcattcaagagaatatcaccattgattgatatatctgtcagt

SEQ ID NO: 9597 - DNA, 7348 bp, Oryza sativa
cctgcagccctatgcattgtacctcagatttgttgatggtgatcacatgcccggtgtaaggtagctgctgcatatccaagcaagatgtgtagaacagtacactgcttgctgatgctgactgttcatcacacatgatcaaatagagaagagtcagtcattgacaatggcatcaaattgtctctcctagtatctggctatccatccaaccggaataccagataagggacgcaccatgtatgccatgatacagtcttcacaaacatttgcaatggagaaggccattggtagcagctgatcttggagctaggttgatcatgaatgtatcagcagctagcattcaccagtgtatacatgtgtggccaatcatgcagcaagaattattgtagggacttgtcccttgtcgccggcaaggctcaccggcatgcagctttgtcgcggaagccgaggagcggtgacaaggcgctacacgtcgcggcccctgcttagctggcagcatcacctcggcccctgcaagggaggtgaagctcaaggctgctgccagccagccattgctgtccctgaggacagcaccagcaccaccatgttagcaccctctctcagcttcagtggtggggaatccacctgactccagtgtgtagacaacctacaaaatgacacaggggtgagcactatgcagatgcagataatgcatgcatacattgcttacccagtggctggatgcatttgcattgccatttctgcaaattgcccagaggggggagcaacactcagatcttgcagcccatcatggagcagcagatgtccagccaacagatgaaaacattcaacaaggaaccatgcagtatcatctaaagcagtagtgccaaacaacaacgtggtgtatatggtaagccacagtgctctagtctgctgtgaaatgtagtatatgggggagaaaagattccttcagacactgtaactgaatcacaaccagattgttgctcacatttacatatctcaatggtacaatccatgagtcatgcacaatggcagtgtgttgtgtttgtggactcaatctcagatacagagaggcatatgaactgtgtatgacaatgctcggagagtttgcgcaatacgattacttctttgaaactgttacagttcaagcgctagaagcgcctcttctcaaaacagaactttgtatgaggagctatttctcacctatctcattctagtgcaaacaactacttgctggattacatgtgtatttatactactttttggttgatctcatttgtgatttcttggaagacccagaggcggttctgaggcctccatggtctcgcattcttaggccaacgattggtggcctcaaagtgactggaaccttgaaaatgttcattgtcaccaaatggcacataaccatgtccatatctttcacacttggatttccagtcaggaaaaagcgaacgctgagctgtgctgcttctccaaggtggttgctctgtgccttcagctctatcactgagatggcttgtgtcgagcctttgggagactcggttactgtaatcttgcaccttctgctgtctccattgtggagcagtcctgacaaacttcatgttcacgttctcatctgtggatattttggagtcactgtgtctccatgaatccgctgaagaactctgtgggtgatcatccacgcttgatctttttaaggcgctgctttcttgagagaatgagggtgttctatacatctcctcatttgcatgcttgcagcttacatttcgcttagtagtgtccataccgatcgttgagctgacatcacccaattgacgttcatcttcttccaccatatcagcccatgtttttctaacaccattgacaagagcctttccctctggcctagtattctcaccagcatctgtggagccaccagagtttggcaagcattcaacaaaactaggaatctgaacttggtgctgtatgctgatatttagtgtgtcctctttcaccagccgttttcgtagtttctcaagcaacgactggggtgtagcagcatcattgaacagtcgagaaagatcttggtattcattcaggcatttctcattattctccccactggtagcaatcaaactttctggttcttcacgtttcatctgagtaatgggagatggaaatacttgtgaattgcaatcctcctgcttctctgcatcagcagcaactgaaatatgtggttcttcagatttcagttgagtcaaagcagttgaggatacctgtggctgtaaatgcccaaggttctccgcatcaatagcaagccagattaatgattctttagatttcatctgagttatgggagaatggagtgttggtgactcaagttccataagcatttctctggcccgagcaagagacctcacatggctttcatcactgcagttgtcaggtatagattggagaaggtatttagcttcggctacctttccggtctttatcaggcagatagctaagttgcactctttgttataatcagcttctatagcaagagcttgcctgtgtcaaatgacatacggctagtcagtagtcagtaccagctggattagttgaataacgtaaaccagatatcactcctactagtatcagcattcattagagctgattgttgcttgcagtttcaataaatggtttttattatataattacttctaggattcataagtgctgactgctgagtatagtcatttcaagcccacctagatgattttaactgtgcggccacatgttttgttttcctttttgaatgaaaagggtatgagctctgcctatacatgttttgttttcagttttcacactatggaactattgaaggaatatagtagcgcctattttttcctcttaattttctcaaatgaacaccaaatgtgagcatttctaataaactagaaatcaggataaataaatactgccactttgggagatacaagccatctgatgttgatgaaaactggactcaaaagtatacctgtagagcatttcggcctcatcataattttcagactgcatatgggcccaggcaaggttacccaacaaccttcaagacaaataagagcatcagaatgatgtttactggttgaatagcaatgtacgaaagattttaaataccttgctttttcatccctgagagacaaataaactactcttccatgagatttagacaacttggttttccacctgccagaagctagctcctcatcaacaattctcaacttcaatgtcagcatttcaatctgctcttttgtcctgccgcatttctggttttacataaaaatgactagtatcagaacagaaatggtcgcatcttcatctaaaattaacatgtcatcagtgcagcaatttagatgtctttaggatctactgctataggcctaccaaatcacagaattactttacaacagaaagatttagcttgtaggttcttggtttacaggccaagataccttgtacaggtcaagaagaatattgtcaagagattcctgagcttcatttgggcaacgatcacggaaggatcttattgcctcaatagcctcttcggctcgatttgcttgcttcagtacagtagccatatccttcagtgcgctctcaattcgatcaccactgtttatagccgcccagaacaatggaactgccttgtttgggtccttttcaatcacctgcagaaaacaagacaagaaaacaaaaacctcagatctagcttatgaaaatttctagattcaggttattacatgcatttttgttcacaaaactgaaagagctgtagaaaaagaaacgctgtcactttgcaaaaaagcaagtaacatgtactgaatgatttagcatgaatatgttgaagcaacaattaagggaaaaattagtacccactacagttactagttagaatagcatgcgttagtggcaacacaccatcaaaacttgcccaggtggtgtggctggtgtctattcaatcttttttgagatggtctatcagtcttttagtataatagatttctggtaacaagggagcctagtcatgagaacacaatttctatatcgctttacgattttactctaatactggttttgttaaagaaacatagaagtagttttatctatatcatggaaattaccttcatattctctcttctggttcaattaaaagtgttttttttttttgtgggttgaggggggacagagaagcagagcttcccctttccattactggaaacaaattcagattacagagttctagaaagcagaaactatgaaaaaaagctaatcagcaagaaaagcttcacaccaaaacgatgccatcccattgctttttgtgaagtttttgcccccaggatatcctaaattcaattcaaacatatcatgaaacaatggaaaatactgtaactaaaacaaccacaaaatgcttttgcccttccttctccctcacaaactactcattattgaaattaatatagtacacacagtcaccatattgagcatacttcagcaacctaatttgcaacctctctccagagtaaacgaaattgcatcgcacatgatggtttccgaattccaattacctgagcctgcttcgcccgcacgtagggcgaatccaccgacgacagcggcgccctaggaggccgggaacacccgccgctcgtcggcggcgtgacacggtaaccgtaacacccgccaccaccgctcgccgggggcgtcacgtgcgaggagcacccgccgctcgccggcggcgtggcgtgggcggcgcggcccgaaccgtccgcgcccgcaggcgtgcaggggctccacctcggcgccgcccccctcggcgacgtccacggcggcagccgcctccctccgctcggcattgcggaattccgtcgaacacctggcgcgcagacaccaaaatccccccatcaaaatccatccaccaaaacaaccagatcaaacacaaccaaattaaccaccgcatgcaaaagcgtcccccaacctcgatcgagaagtcgagaacccgccgccttcgccgccgcgccgtgctcgggctcgacgcggatcacgccgccgcggagttgaaagcgagtggagggagacgcgaggacgaagcggcggcgcgttatatatatacccccgcgcgcgcgcggggaaggggatttcaaacggcgctgacgtggacgggggaggtggggcccacggatgcgtacgtggacgtcgcgtcacgggtttccgatgagacggcagcagtaagtgcagctcatgcggctcctgtgaattgtgatgcgagattgcgtgaaccacgcatacaatgtgctcttcctggcttattattgaataactttagtgtgaattttgtgtgtgaaaaaccataaaaatggaactgaatttaccctacttaacttactgcgtgcattttcaaattcgaatttgtttttgtttgaatttgctgtgtacatggtgactgatttgggtgataaaaaggctgacagatgaggcacgatgaaaagaatctgcttttctgttatctaaaaatatactgtggctgtagcttctgttaaaacaaaggctgtttttttggataacaggtagcgctcggcctttgcatccgaaggtagatgcacaccgccaaacaaaatgcaaaggctgggtttaatatccattatctaacaaaaaatctgaaaatatatggttgactaattacattttggggtcgttatgtcatgatgagaaattgagaatcacatattcattagtcatgatgtagatgaatcatctattgctggcatcaggttgcaaaaatgagcatcagctttagctaggggtgaaaatgggtggatactgtcggattatggcatttccatatcctaacccatattttcctttaaattcggagtcggatacgggtagtgccggataagatattactcatcccgtatcttattccatattattttcttcgaattggatttggaaacggacatctatttgtatctctaattatagatattaaatataaaaaggtgattaaagtattaaatgagatacatcaagagaaaaattatacaatattacatgtgagctcgtaaaataatgattaaccattttttatcatgtttgtaggtggatttataatagattttcatacatattttataatatgggacatatgggcggatacatgacttcctgtatccttatccatattttctaacgaattcggattcgaactcggatagtatcgggtatcccattttttgtcccatatttctcccatgagcctcgggtcgggtgggcggtcgggaaatacccgccccattttcaccgctagctttagctgatgaaataatcggatacttgaactcaaattcagtaaataacaagtaggatagcattctgcctgtaaaaatgaaaaagagagaccaaaattgggatattgctgtgatgtgcatgtaccaccagctgaagatgaagaacataatgtgcttttttgtgctgccatggtcactaacaatagcctaagactataaattgctgtgtagtttcatgcttgctaatatctcagcctttaactgttctcttctaattttccctgttgttgtcactggaaatggtttactccactgataatatatccttggcaccttgaatctgtttcagaaaaaaaaaatagtggagtactgatcatttgataagtaaggtaaaaagaaaaaagaactactacctgattacctagagagggtcatttaattctaagattttagagctgagtccatttaaagtttttccatcatgatatcagtggattagctaacactgtactagctgaaaaaattcagttgtaaaagataacatttgcttgttagttgctgcatcattgatccaaagaatcagtggcacaggtagattttctgaatatagtgacacctgatagagcatcaggaagcaaactttccgtcttatctctcatttatttccattgtttaaggactgatctgaaacagttgataatttgactaatgaaacgctatgttgagacagaatacctgctcaatttgtttgtacggcaatggtcttgaagcatctgtgcagagacttctctgccttcccccttgtgcacagctcttgcatcaacccagttccagccatccctgatgctaacacaggcaacaattttctccccgagacgactatccggcatgccaatcaccacggctttagctagacctgggtgctgagacagtacagattctacctgaaaattttgagatgaaaatcacctaaacatggtttcacatttctacatatgcataagcataatgtcaccctatgaacattgcactacagcactaatagt

SEQ ID NO: 9598 - DNA, 6979 bp, Oryza sativa
ttataccataagctgagaagatagtggcattaggaaataagtgagaagctccagttatcaattcactcgacaacccgccaccgccattgagaatctttgtcacggtcatcccgtggttcaatatcttctgtttcctgatgtaccaaaacttttaatcagtcaccaacaaattgttcattcctaggcttccagaatcatattgtatcgccgttgtcataccgagcataggatagtaggtcagccatgattgcaggaacagtgatgaacgaagtcactctgtgttctaggatggcgtcgaaagccgatttcacgtcaaatttaggtatcaggacatgacagcctccagccatcaggattgccaagcatgaagagatccctccaatatggcacaaaggagctgtatgcaggtagatctgcaggccagacaaatgtatgatgaaattccatttatatcacatctagatggttgctaaggaaaataatgtcaacattaagtgaactatatattcaagaaaatcatgtgacaatatttggatcctgaaagcatacatcatcctcaccatagccaacaatggcaatttttgcaagggattgaatgatcaaagatgtatggcttatcgctacaccctttggtcgtcccgtagtgcctaaatccaaatagcttatggttatttagaatcaaactgatcccaattcaacctgtctataacatgcataaaaggccgcagactgaaattccccaaagtgcagatatttcagtgcagaatgagggaagaatcagctcagtgccaggaagagcaatcgcttaccagatgtgaagcatatcagagcaacatcatttggagcagacacaggctctactgctctagtagttcctcctgagctcctcttgatctgctcaactgatacaactgatacaactgaaacaaattttcatgtgtaaatacgagttgcactgagccataattcacagggcaacaatattctcatataaatatacccagcttgttcacaataataaaataacaatctgaagaacttacagtttgcagcttggctgatgctgcagagattccccaggaagaggtaaagattaaccgatgtcaagctgttgctctccttcagccgaagcgcccatgagctgtagctgccatcgaagatgaacactgttggctgcacaagctccagtgcctgtgaggcctcctcaaagctctgaccacccacatggaagatgacacagttcaatgttcagtataaagtatcaacacaggctagaacagcacatggaaattcagacaaaatgtttgaattgcagctcttttttttcccttgaatttgtgatacatgaggtgaaggaattgaattattacccagcggtagttgagaggagcgatgatccctccgatgtaagtgacggctaagaacagctcgatgtactcgatgctgcaaagcagaagggaagccatggatgaacacatgagtgcatcaatcagaagccacaattacgggtttcatttctcaaatcagagaggcaagctgaagagaatgcaaagctagctcccaagtcccaacctgttgaaggcgacgacggcgacgacgtgaccacggcggacgccgaggttggagagggcggcggccagcctacgcgccccgtcggcgaggccagcgccggtcaggcggcgattgccggagacggcgacggtgtctcggccggcgagggcgccgccgaggcagtgggcaatgtggccgcggccgtgctgctgcgacattgcgcatgcaacgcaacagcgtgagcgagcgaggaaggagaagtgtcaacgtgattgcgtgacatctgaatctttttttctttcgattcgagataagaagttcagagcagcagagatggttgtggtcaggataggaggccactgattgctacatatccagacagataacctattttatcgagatgtagaatctgaccatgtgactgacttaaggacttcttgcctggaaaaacctattttaccaagtagtagtattatctgaccaagtgactttagacttcttgccttgctgcaagaaaatagagctgaaatgtacagaaatttctgtgaaaattttgcagcaatttacagaaacatgggaaagttactttctgtgaaaatctgcataaattttccagtaacaagggcaaacttacggcggttaaacgcacggcattagttctttcttcatgatctgatcgctgcgcaattctaggatacatgcattcgaataaagaaaaagatgaaatgcacaggaggatgaagtcgataaccatcgcacaggcacaccaaaaacagcagggggatacgggcacaaccaaaatgcataattaacgataccattgttggatacattcttgtctagtagaaaattaatatgctaaagattaaaaacaaacttcgatgttcagaacttgaaacaaaactttcaactttgcagcgatatggcaagaggcttagtcgaagaggctcatgcccaggtcaccatcggactcctcctcgggctcttccttcttctcttcctccttggcagccgatggagcagcagcaccactgtcggcggcaactggggcagcaacagcgaacttgctggggtcctgagaaatataagccagataaatatgtaagaaaccatgatgcaaccgcttccaaagcagcattaacttattttctagtgtggtaaacagcattttgctaccatggatgaaccaataaaggcacaaacagcctaagtgaaatactccttgctaccataaaaattcaattgctcactagactatgtaataatgctcaacgactaaatcaattatgtagataagtaaaaatgaccagttcaccagctagctgcatgctgctaggcagccgctgcagcagcgctgcaccaagcagccaaacaagatgttaatgtaccgacatggacatgctacattttagtatggtaatctactatctattgattatcttagttagaccaattatcaagcattaagaaaacatcatcataagtgaaatagaaacaagattactttcaaatactccttgatcttatcagcatgtgggtacgagtattcggtctccacagcaacagcaagcacattcttgtacccattgaggaacatgtgtggtgcagcagcaatagttgggtacgagattgccagggagactgaggcaaccatagaaacaccagaagcaaacttctccatcaggtcatcctcagtgaggtcaagcacctcagggctgaagactgacccactgtcatagacattggtaataaccagcccatatgagaaggggcggataccaagcttggcaagcagagcagactcggaggagcccaccttgtcacccttcttaatgagctccacaggggtgataatttccacagtacccttgttaatcttggtggggatgttaagcacctgtaacaagataggaacagtgagaacatgtagttgactacttgactaagcagacaagatagtatttattaacaaatcaacaaatgatcacctggaagaaagaggtctgggatggatccagaccagtgttgccagggggaaccaccacatcaacaggagcaacaagaccaacacgagcaggagctccaacctgttttataacaaaaacaaatcagggttattcattcatcagataacatcacaagtatgcactgagatttcgcaatgaaaagagaagcacaagtcaagcaacaagtcacactgtaaaaacataaattactggctatttaaagaaatctctaaattaaactccaatatgtagtgggatctacaacatgacattgcaatataaccaaagaacttgagacatacactaaaaggtgacgaggtcaaatattgtgatatcacatctaacataacacttaattccatacaaacagatcatctactttgcatatggataaacttaacatgcataagcctagcgataaattgagcatgacattgactataatgtcctaaagttgtacatgcttgcaaaaactagcaatactcatcaggcatcaaactgtcacaacctactaacaattgagattcttcccatgatcactgtaagataacacactaaaacatcaaccaatttcacttaaagaacaagttactattataaaaccaatgcaatatttcagagacaaatcgcattggaaaagttacatgatgatgaatatgtcctttaaaatctaacagaagatctagcatcatacaacaaaaatatcgacatagcatatggataaactgctccacagaaagtttcataataacactaatacagttacaaactagcaaacggatcaagcatcagatttgcaatttttttacataacacgctactaatatcttccacatataatcaactgcgagcgtgcaacccaatgaatcacattcaacaaaaactacagaatcaccacaatacaatctactatccatgcagtctagaacacagattgaatgccagttataccttgtacttggcaacctcctcgcggacctccttgaggtcacccttggtgaagatgaggccaacgtttccctacaaaaaaaaaacagcaagaacatcacatcgatttccagaaacacgcgtaggcaaaaacaaccgcaagaacacggtgagtcggacttacgacgaggaggggcatgagctcgaggaactccttgtgccggtgttgtcggcgtgcaccttgatgcagcggcggatgagggtgttcttccccatgaggacgatggagtcgcccctgaggcccttgcggatctcctgcagctggttggacccgacgttgtcggcgacggcgatgagcaccttggtgtactcgtcgagaagctggcagagcttcttgtcgtacgccaccttcttctccgccttggtcctcttgatcgccatcgctgcgagctacacaaaccctaaccctaggcttagatctgcgcgtggggagaggagacggcgaggaccaagctctcggcgaggaggagcaaggcggacggcttgcggcggcggcgtcgctttaacctagggtttccagggtggggggtgcgggtatttatagtgggagagggatgggtgtggcttcgggttggtgggcctgatgggcttggttttagggtttcgtggcggttgcggtctcaggagatgggccttattgggctctccggcgtatgggccttgccagagtctgcagagggcacggttgcccaaggaaccaaatttctttttcttttacttattggtagagtaattcggatcaggtggagttttatgaaatttaatctaattctggagataaattgtagataaaataaaacaagtcctggtataataataataaattaattaaaggactgtatgtaaaatatgtatgggtctttttatgggtcttacggatagtaacttacattgcggattgtggagagaatattttggctaaaacatagtaacaattttggtagaaaaccattggaaaaaaaaagggaggccaaaatccaaacggacaactctaccaaaattatggcaatgataactcttactgttgcaaaaataagataatgttaggattggcaaagaaccaaacgtgccgatttatctactgtcgacgcacagaagaaacaatccaatgagatgtgatccaaattccaacagatatgctaacaacactttggcaatttttactatgatgatgaaaatgtcaaaaacttagcaccagaaaatgaacaggtaacagctctttcactagattctcctcctgctggatggatggatggatgtaaaacactctaacaacaactcactaagttcgcagttacgacaccaacacggcaacacatctactgagctgatggcactcgattatcaagaattcagagaagaagaaaagtgaaaaggattggtagtgtgagtgatcagcggatcatcatcatcatgcttctatggacagcttcttcttgtgcctgctgagcttcagccgtggcgtggtgtcacccttcaccacggccatcttctcctcgctcgccgtcgccgttgtcgtcgctgtcgtcggaatagcctccttggtgctgcaaatctgtggtttcatgttgagggagaatctgcccttgccggtgctccggctgcggcccagccgctcgatctcatccctcatggtggagcactccttctccaggtcggcgacgcgctgcttcatgttgtccatgccctcccggagggcctggttctcccgggaggccaggggccagccggggcggtattgctcgccggagatggtggggatgagctgcctcgagccgccttcgaggttctcggagaccatgaggcactcggcgatggagctccgtagctggagctgctcgaagaagaggacctgcacgatgacgcgcagcgggagccgctcgttctgagccgcgtgagtgcaggcctcgagagagagcttctggcagtccatcacccggcaaagttcttccttctctgattcagacaggtgaggatgcgcctatggagaaaaaatccagacaaattattaagcatctacaagatcaacatgatacagcaagatgcatgatcaaaactttaatagatataggtattgtttttaagataatagtttttttttaggaaaaggcaatagctattggcaattagcatgacaacttcattgatggaagagaatagccaagctgttctgtacagtttaggcattgtttggatggcctgaaattccatcccatccacatggataggccaggatttcaggagcaggtattgctgcaagcctacctgaatagtaggcttctgaatccattcttcagtttcatcaggaaatcggcttacgcagttaccagtgaaacaatacaaggctaaatccctaattaaactgaaagagaggctttccacaaatcacttgacatacaaacttgattataaattacaatttgaaaggatatatg

SEQ ID NO: 9599 - DNA, 1022 bp, Oryza sativa
tagaaaactaaccgttacagggcaatcattgagcccactcaacctggctggtctgaccgcagtgaagtggccggtcagaccgtccacggctcggtcagaccgccatcggctcggtctgaccggttgcggctctggcagctctgtatcgccaccaaaaaccagaccagtgcaacagaccagtagggccggtcagaccggccttaccacgctggtcagaccggctaacagccccggtcagaccgacctaaggcccacggtcagaccgcaggtcacttttcagcacaaccaaccgttagtaaaacggcgatatctcttgactcgggtctcggaatttggcgttcttggactctatggaaagcttattcaaagggctatccaacccatgaacaatccatccaagaaacacaacttttctcagggagaaagggctcacactccaaagaatactccaccggacataaccacatgaggctaaccaaacctataggatgtgcccacttctctctttgtttgggacttgataaaactcaccacacttggctagacaagcccacaaaatgcacctatatgcatatgaactaatatggcacaaaatcatccacatgctcgcttcatatacccctcttgatagtacggcacatatctagtaaatccggtctacaccaaacaccaagaccgggaaaaagactaagaaaacattcttagctccattatacctttgccttgcgccatccaacttggggtcaatgcttgagccaacatcaacacttgtgaccattcggttgaaccatgtttatgccgagatctttgccatcctttgtcaagactttattctcatcacaagcttgacttcattcttgccaacatgacgatgtccttggcttggtgaccattaacccatggtgtcattcattagcctcatcgcaattagatctattcctttgcacgactcaaaggaaaacattagtcccaacaaatcggttggcaccctccacttggtgaccaaccggttgcttataaag

SEQ ID NO: 9600 - DNA, 7683 bp, Oryza sativa
  unsure (1)..(7683): unsure at all n locations
nnnnnnnnnnnnnnnnnnnnnnnnnnnnnnnnnnnnnnnnnnnatttccacccgacgttcgtactccatccaagcatgaatgaactgtatggtcgattcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacattcatgctcatccttccgccttaggtagtccgatcttgtttcactacgtgggtaagcacgggttccgtcattttgtgggttctccatgtctacccactcgatgaagttgcacattggacgatatgtctgcgtaagatgttacaattgtgtacgaagaagttagtttttttatccatttgaacttcgaatagatgaagcatacctgatcaaagttcgcgcattggaagaatctcctgccccgagtttgtatcatgagggaagacttgagtatgcatccatccccacaatcgcacaaaggacggtcacaccatggtggaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacaatcacgcgtgggcgtgattcactttatgtcaacaggcagcgccgaaagttgatagtgacaactcgagctgccgcttttcatgtgtgctgttgtggactgtgcgcgctactggatctgacactaccgtgaagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagctaaaagaaacggtcacataaggaatgaagaggtagaacactactgacgaggcctcttacccctatccctcctaccctgcgccctaatgtgcccctgggagtacgtgagtcggtccgggggtacggcacggccaacccgtcctgcctgtacaggtgtgatctctggctgctcctgagtgtgctcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaaacgccggtcgtgcctgcgaacgcgctcgaaggcagacgaggtcctgcgatgaggaaacgtgccgttaaaacatggtgacatattcgtgcaaaagctgaaacaaaaatgaactaatctctgggctgaactgtactgtgcgaaaccggtgctgtaggtcgcactgctccgaagccaggggtgctcgaaggcaaacgaggtcctgcgaggatggaacatcaagttatgacggggtgatgttttcgtacaaaaacagaaacaaaacttaagaaacctctgggctgagcagtaccgtgcgaaacaggtaccgtaggtcgaggtcctgctccgacggtaggtgtgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaaattcagtagttgtcctatattatgcaagataaatgaaataattgtaagaactaatacaaatccgacgtacccccacgaagtagtctcggtcacggtgcgtgggatacgcgtccgtcacagcggcaacgtgcggctctagggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggtaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtctgggtaacctcgtctcacctggacgtgagcgtaacgacgctgcaataaacatgatcggaattagacatgttatgtgaaataaaaaaagaagacgactgataaacttataacgcagcgaagttgcactaaccccacgtcgacaccagtaagtccccatcgtgggaccgtcctctggtcactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcataaccccagctccactgcggcacgtcctgtggctgagcatccgcgatggaccgtgcgtagtggaccagccggaagtccacagcgtacccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctaattacaacaataactgcagttacacgatatgagtacttagtccgaacactcatcacaataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatgtaaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgccaaattggttgtcattataccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtacaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcaacacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgttgtacatctcacttgccacgaaagctgaagtgatgtttcggtgatacttctccaccccttgtaagtagcacttgtgctcggtcacaatggtaactttccaataatcattccatttacccttatatgcatggacacgccacggacaatcttccttcatgcacctcacttcatacacataatttgttgacttgaccaccctaaactctctctacaaggaaactgcccaatgcttcaccacctccttcatctcatccttatgagcataccttgcaccgtcaattacctcgttctccttatactcccagggtacatgatcaccctctgatgtaacaagtccagaaaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgccttgataggaccctctacatcttcggtttgcattgaaacatttatatctttctcttgtaccgacacaaatataacgaggggccatgaccgttcaaaagccatttccacataccgtcaccaagcagcagtgctgtccatcggcattagttcccaaaaataaccttctgttgcatgactcactacaactgatactgacattgtgtagacttcttggtctattctaaatcctctcaacaaccaactataaattgactgaaatgttctctccgcaggcctatcgatgcccttagatgttattacaaaatctgacagatcaacaccatctggaccaaatctaatatttccttcaccgggaactatctgaaatgtgaccttatttgacattgtgcctgatgaaaacaataactgcgttaacctcgcatttctgtactacgccctaagttacattctctacntattgttctccaaaattctaaaagtaggttacattctccagatcaaactaaactacatcttacaattaacactactgtctatgtctcaattcatactattatattctatgctctggatctacacatatgtgctgtgtgctacagatatgctaaaatatatagaactaaaactaaaacgcaacatatatactcaaacataacatattagtacaaatgcaaaagatgtatgagagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggcc

SEQ ID NO: 9601 - DNA, 2544 bp, Oryza sativa
cgcccgagagcgaacggccgtctgccacgtcattttcgccgccctctgggatggcgatttttaaaaatcgccctcccagagggcggtaggcgactacttccgtcaattttcaaaatggaaaattatatttgtaaaacttttaataaaaaaaattaaaaataaaaaaaattcatcctgaaagattcatgaacgagctgacggcctagctagggcccattagttcactcatccatagcactgcatcatagcaaggtgggcctaattttggcccaacccacagaaactgtaactaggcaccgcccgcacatagacataacactttggaatgatctcgtgcatttcattttcacaccataaacatttcgacgggtccacagactcatgtaaaaatgaaattttacaaccacccaaaaaatacttttaattgtttcaagggtacactcttataatcggtagccaaaaggtctcttattttactacgtgtggcgtagtttgaattgctagctaaacaaattatgagtttaacgctattcaataataatgggagttggggatttgtcccatcacattatttatcattttgatttatttttatctttaccttttttattactattaaacttatggctgtgtgtcttatgacagaatccggagatgtaatctattttcattatctaaaaattcttccaagggttgatatcatctgtgtgcactgctttggtagaggaagtgtgactgtgaccgtcggattcgaacccaacagtctagattcatcggtagcataagcatagagactatagagaatagaactctctggcttttactgttcgttcgttcatccctttattctcaagcaactattttgggcgtgcgctgagatgacgatgatggacgattattcggctaaaacatataggccgttactatatagataaaaaaagttattagttttaaacatcgattaggctgtgtttagttcacgctgaagtttaaaaatttagttgaaattggtacgatgtgatagaaaaattgtgtgtgtatgaaatgtttgatgtgatggaaaattggacgtttgaaaaaaaaactttggaactaaacaaggccttagtttagtgctaatagtgtatcggtgaaatgggtgtaaagtataccggttccttgtaatggaacctatgcatattgtctatcatattgtctgactagtagaagtaagatgggtatatggttcattgtgatatgatgtatatatgtgcgcccatatgaacgtacgtatacgtctccatatatcgtgtttaaaataacacagagtattaaaaaaaatccaatattataaatttataatattatgtatgtgacactaatgtacctcttctaaatatctaaaacatattgacactgcaaattcttgaagcctgaccacaagcatctctagatatttattgtagcgcgagagagaaaccctttttcagtataaaatacgcggtaaaaatgtaactagtactctacctgagtttatttcacatactcctattcttcttacagttgcaacatccattcttcctttttgttttgcttctctcttgtatgattgggagtgtccatccaagctccagtggaatctagtagaaccatgcatgttgccttcaaacacaaggcaggcatccgattccaagccccaatccaaagcatggcatggaccctaatcatgcgtggctggctgaacagagacagcaccaactttttgtgtgaaaaaaaaaatgccaaaagtacaggtattacaagcttcctaagatattccatctcttcatatctgcctttttttagtgttattccatactgagatgcaaaggtaaatttttgtttcaggcttcccttgaaatgaaggtattttttaaaaaagatcttcgtggtaattgaaaatatttagcattcttattattcccccagtctcataatataagagattttggagtacaattatatcgaattagctgtacatctgaagccaagtgtgcaagtaaaaaagttacttggttctgatcagttgaggtataactgataatcctaaaagaaacaaataaataaactgaaaataatttattagtaaaactgttatatatgaattattagctgtttagaaataaaagttggaaaatatattagcataaattgtttcccctaaaatcaactttcaaaatttaagttttggttgccaatggtaagttaacaaaatgaaagcctgaacatgggaaaggctgttttggatgcaccaaaatgtgccttagggctggtttggtttgggacctaaattgaccttaccaatatttggcaataccaaattttggtaagttttcgcatgactaattttgggaaggcaaagttgtatttggattgaagccaaaatagcctaagttaactattgaaatgatctattttcttaggcatgccaaaatttagcttcaaaccaaatagacactaaacaatattgaaattgtcaaatattgataagccaaatttaggcctcaaaccaaaccaacccttact

SEQ ID NO: 9602 - DNA, 559 bp, Oryza sativa
acagatgtcggcttctacttctattgatgtcagcagctcgttctctctgtcttccccttgtctcttgattgtatgaactccggttgtcaagaccaggctctctgcttttgcttgacgaacgaccgcctaagcggttccaaagagagcgacttctatgcctccttcttgaacgctgctcgtggtcgtcttcatcatcagaccttctctccggcgccggaagggttctgcaggcttgaattgggtgagccatcgacctcatccgggtgacatcatcaggcactccatagtgccacatgaagacccgaccctgtcgagagaagaggtcctggacagtgtctatgtgaatgatgaccggataagtgaggcctttctttgtatcagttggagccggctgggatggctccaggtcaggaaaagggatctcagtagcccttgcttctctatctggccttgtgattgtgaactgggtggcctttgggatggtgctcaagtctaagctccaaatccaaagatcaaaagtacggttgaagttccggcgacgggagtattcttctatgta

SEQ ID NO: 9603 - DNA, 6677 bp, Oryza sativa
tgtaaaaaaaattgtgtccatatatcatagtacaaagaatattatataggatatatttcatcctccgaattatatcctttcctctcttgatgggttattaattgattctctcctgattttattctataaatactccctctattttataaaaaatcaaccaagttctagatgtgacatatttttaatactggctatattcggctgtcattattttcactgtggtgcagccaacaaacacagtatattgtttctcggctgtgacagtgcggcggtacaaaacagccgacccactatgaatctggatatatctttatccagattcgttgtaagattagatagacatcgagccgatgcgctcgtgttccgtgattaatctgattatatatcgtattgagctatacacgctttcaatgcacactcaccgaagtcaacgaccttcgctgcttaaaggcaccgcaaatgcacataccatttccgtccattcatcacacacaaccagactccgatcgacctcgtctcgtcgagcgccaagtccggctccggcgacgcagcgccgccgccacacgtcgtggaggacttcttcggcgtcatccagctcctcagcgacggctccgtcgtgcgcgccgacgacgccgccctcctcgccatgcccgaactccaggacgtccccggcgttcagtggaaggacgccgtgtacgacgccacgcacggcctcagggtgcgcgtattcaagctggccgccgccgccgccggtgacgatggaggtaagctccccgtgctcgtctacttccacggcggtggctactgcatcggcgccctcgaccagtcccccttccacaccttctgcctccgcgccgccgacgagctccccgccgtcgtgctctccgtccagtaccgcctcgccccggaacaccgtctccccacggccatcgacgacggcgcagctttcttctcctggctgcgcggcgccggcagtgcggatccatggctcgcggagtcggccgaactcgcgcggacgttcatctccggcgtgtcggccggcgccaacctggcccaccacgtcgccgtccgcgtcgcctcggggcgccaacccgtggttgacgacgtcgacccggtggtgcgcgtcgccgggtacgtcctcctcgacgcgttcttcggcggggtggagcgcacggcggcggaggccaacccaccggccgacgtgtccctgctgaccgtcgagatggccgaccagttctggcgcctggcgctgccggcgggggcgaccagggaccacccggtggcgaacccgttcggcccggagagccccagcctggaggcggtggcgctgccgccggcgctcgtcgtggcgtccggcggcgacgtgctctacgaccgcgtggtgggctacgcggcgaggttgaaggagatgggcaaggcggtggagctcgtcgagttcgagggagcgcagcatggcttctcggtgatacaaccatggagcccagaaaccagcgaggtcatccaagtcctgaagcgatttgttcacaaggcgatacgcccagctgagggttgaaaaggacaaggcaaaattgagtgggatactttcaatttcaacatttgtgttttgtttgggttataaaagtgtttgttaaatatccattatctaaaaataaaaaatataaaagtgtttgtttaagactacggtgtgcacggttgccttgttcacttctccaagttattttcttgtttgaatggggatggtttgaacatttcatccaatttcctttttattgtgcttatatagctgggtggacctcatatccaggaatactttttccggcagaaagtagccattgaatgcctctctgtgtgtaacagatgtcctgaatcctgatagcatttttgtgtatgactgtatggtactagtttcatcgtttgacctaataagttttaaaacaatttattaattagaaaaaaaattgtctttcatatatatgtgcatgtgaaaaatgataaaaagcctcaaaatctattctaaattcactttaaaattcaaattttgattgcggctaataaccaataacaaacaatgtggttttagtattgtttaggacatccattttacatgcgacaatattttagtaattcgctacaattttctttcttttttcgagacatctattttttcaaactgctaggtataaaatcacttaaatttgaagtttggattagttatggcaatgtatgcgataagattagctcaagcctgttggtgtagcacagttacaccccttcataatccattagctagattgaacttgcgaaacaataatatgtacaccttgatgcttggtccatttggaacgaaaggaacaaccgtgtattcaacaattgcatacggttatggcctaaggttgttggttttgttgcagccatggtgcaagaaaccaccctttggcggcatgcccatcccttgtcgctcacactccctcagggtagtatactcggtcgctaggtcgtcacattgttagcgagagaatagcctcaagtattttttttaaccaagggcacgcgtaggacactagcttgcttgtgtgggtaagcagagtccaacacccagttattcaagagacatgtagatcgatctagccttcaagcttgcctacctaggaagcaggcttcaggccaatgaaaacgtcagtcaggacagtcttggattgcagggaagccttaagaatcgccagaccctgcagagaatcaacaaatacatgcataccgcctaaaaccaactgatattaagttccaacaatcaagtagagtcatgtgtacggttacgaatgtaatcacctcagtgtagccgagctgcacggtcttctccttgagcgcgcccaagtccttgaccgcgaacctgttgagcagcgtgatgctggagatggacgacatgggcgccacggtgagatcgtccatcaccgtgtacgtcacgatgccctgcacgaaccctcctcctttcgccccttcggcggcggcgttctgcgtgttctgatcttggccgccggcaacataggtgcatgccgttgccatctggttgccgcagttaggacacttcgtgccgctcgcgttcgtcacgaagcttctgcaggcgttgctgctgtagctgcatctgaagaagctcttgcttgactgcgcagaagacggcgccggcaagcggaggacggaggtgttggagctggccgccggcgagagcacgacggggctgagcagcgagtccttggcggtgtcggcctggacgaaggcgtcgtcgagcttctcgaaactggcgtagaggttgccgacgcagccgaccatggagcccttcccgagcagcttgatgcccgaggcgatcggcagcgcgaggagggagaggaggaagtcgacgacgtccttgcgtgcctcggcgtacagcacgcgctgcgccttggtgtcgatcaggagtgtcatgctcatcagatcgctacttgccttttggctggttgtttcagaagccatttttgcagtagttgcagtgtgcagtggcctgcgtctgaactctgaagtcgaagtctcgttttgcctgctgcattctggaatttacagcgtaacagacgagagcatcgaggttcacggggaagaagagagtaatttatttgcaaattaaccgctcattgtgaactttaattcctaatcaatcaatgccgtttactccattgccatgcatcgatcgcactgcttgaggccttgatgctgatcggttcagctccatcatgcacaataccaatcggttcagctccgtaaaattgaacctgaaacacaatgcaggccggatacaccagtccgtccatcatccatgcgcctaaccggctgctatacaagcaagcaagcatattcacgcggacccaaaatataatgatttttagtgtttaaaaacatctctaaaaaatcatccatcatttaatttttatccaattttaccactaaggaaagtacagtaaaccaatatccttcttgtataataaggattgccatgttggatttggatttgagctacgatttgtgaattttcatagctaactattggctataatatcaaacttcttgtaaccatccttataaaatgagggtcattaaattatttttctttataattagttacataaaaaaacaaagattcttattttagcccctccattcaagtttagaaacgtgtttcccttttgcacaaagactaagaacgtagcaaagtggactgaatagcactcaattagttagtgtcttaattagtcatacggtgaatactggtagtacgacgtgcatggatagattctcaatgcaatgagctgttaggaaacgctaagcgaataaacgataaaaaataatagatcaatcgtagaagacacgagatttaacgtgaaaaatccttttaaaataggagagaaaaaaccacgggcgccagccagcaaaatatattcactatatctgaggtgagattacatcgccgcacggcggcttacaagaggtacatatattgtggaaccctgaaagggatcaagcctcccggcgacgggcctccgctccactacggtagaaactggcctttattaaatgcaaatgaatttgtatcaacatgagcaaatgaccgtggtgccaaagcgatcgcgtgaatgtgagatacgatcaactgcactggtagcgataaagagaagattgaacgcactgattctagtcgtccgttcagcgaaaagcccatctggtttaccagttggcacagcctaaattaaatcacaacccattgatagcaattacgggccaggcccatctctccatcaaaagctcaaggccatctgtgattttgttctataactcgtacagaagacatcacataatcaacaccaatgtatcttgcctaactaggtaataagtagcagggctaagtagtaggtctttataaagtgggtcccacgagaaaaaaaatattgctttttaattgctttttgtccaactcagcatgcagtagtagcacatcttgtgttggaaggagagagtgaaagagattttaatgtttttttattcttatgagtgggtcataagcttactacctagcattagttactacccactttcacaatgcttattactaggtcataggaatattatattgcctaatacctgctttttcctaacattgtggatgccctaagagtttcaaatcgactggtcacgcttgcggcttgccagcaagcaaaataaacaacaagagaaggaccaacacaaatggccatttcttccgcttcttgccaaggaaaacatctgtaagcaccgtcttcgactgcagcgacgccttcagcatagccaaaccctgcagtacagtgtaaaacaaaatggttaataaaacacaaatcaaaatgtaccaaaacttcatatgataacaacctcagtgtagccgatctgcacggtcttctcctggagcgacttgatgtgagtgacaccggatttgaccagcgcgatggtggacatgggcgcgaccttgaggtcatccatgacggcgtatgtcaccaacccctgcacaaaccccgtgcctgcgattgcagacggcgcactcgcggtcgccggcacctcgccgccggtggatccagcaatggtggtgctcgacaccatcacatgcttcaccggcaaactcatcttgccgctgcactgcggcaactgacaaggcaagccactcaccgtggagacgtagttgcagcaatcaccgaacctactcgcgctgccccggtaaagctccgtggaggccggcggcggcgccgccgcattgatctccggcaggtggagaaaattatgaaaaaaattaaaaagacaagtcgcgcataaagtattaattatgttttatcatctaacaacaataaaaatactaattataaaaaaatttcatataagacggacagtcaaacgttggcacggaaacctagggtttgctttttttttgggacggagagagtaaagtgctaatgctaacatttcgtcatagataggtgttgttctgagacaaattttttgaacgaacaacgaattttacaaccacacgaggagaacgtccatgtatgtgcacatttctactagtgacacgtgctaaatactgtttctagtatttaaaattagatgcgcagattaacactctcattattatttagtttgttttcattaggaatttactgtttccaataggaaaattaattcgtgagacttgcatatctcttaaacatgtgttgaagggggccaaaaaacttcaaatttttaagacgaatactactggtgcgttacaaaattcgcgtgaagtacgacgttggctactttgctgatctgatcaaattggcctcgattcctcaaaccagcataggaccagcggtgtgcagtccgcctcgcgccgaggaagacatcggtgagcactgtcatagaccgcaacgacgccttcagccacacttaagccaaaatctctaataccgattgcagggttagaacccttgctattgattgggccacgtggcatcacgcatagctcacgaccagattctcggctggagaacatgccacgcattcgaactgtcccatagccgtccgattacatacgaacggtgagaaaaggcctagcggacctaaatataaattgcaagttttaagaagggttttta

SEQ ID NO: 9604 - DNA, 1408 bp, Oryza sativa
gctcaccagctagcgctgcctcatatagacgagtagggacggcggcggaggtccacgccgtcgctacatccgcggggatcagctcggctcaacgccaccctgcttgtcgccggcttccctttaccgcctctgcgatcaaccgctcgcatcgtctcctcgatatcctccttgccgcttctgccaccatggccggtcgcaccgccccctcgacccttccgccaccaccgcgacctcacctcatcgccgagccgctcgtcgccggagatcggaggcggagacaacggagttggtggtggcaggacggccggcagtcaacccgatggcggggcctccggctcactcttaacccgctgccgttcgaccacgccacctccgctgcctccgtgatgcatgcagagctggccagcttgaagccttgaacccagtgaccaaagaagccagttacctcttgcatttgcaagcggcctcacccatcagttctttctcagcgcaaatccatgctggaaagtggaaactgaaaagcacaagccacaacaatagtagcgcagtaggtgcagtacagtggagtacgagagaagaagagtgaactgggattgaaagcagaggtgggttctcaaaaaaaaagaaagcagaggtggacgacggggcatatgcatgcatggagcacgtcactgctcccaattcccaatggccacctgctaacttacacgtgccatcaactcctaacaaattttctttttcacccctaataatatttttttattctatacttcactaaatacaaaatattttaaaaaatgcccctaggttagtactcatgtatttatgtttaggaccttagaagttttgacttttcaagacttgtttgtctgtctgagtctgaatcgtctgatgtacaaagagtaacataaacatattatgactctatattgagttgatgataggagtcatttacttaaaaaaatatgcattctaaattttgtaattttcatgtaatttgataaattttgtaaatcctactaatttaaaagacatatcttccaaagtagtatttgttaaaggcatacagatacacttaaagaagttaattatccgttacaaatcttttttaaaaagttgaaatataattattcaccggacaagtactgctagctaaatacgacacataagaattagccaggcataaactaaccatatttactcttattgttgacaatattgttataattgtattctattttatctatgattagctaatcaacctgacaatctctatattgtgagataaatataggtggagggtatatcatatactgaccatataggtaagtaggtggcactaatagtaaacaaccttaagctttcagtcctctaaccatatctaatcataccaatcagggctgcagga

SEQ ID NO: 9605 - DNA, 1046 bp, Oryza sativa
ttgatgatggtgctcattggtaggcaaaggagactggcgaggaactctacgacatcattaccggcctcggcagagcagactttctgagccttggtatcaatcaagagtttgatcgataatgtcttcatagccatgatttttcccctttaccaaaattctttaaatttattggtagttgattgattgcctctacaatcaccagtgaaagaaaattacacaggcttttaattgattataggtccaaatgttcagttatgagtagcacaatggcacatagtggaaaattatacaggcaattgaattgtccagggaaatttaaggaaggcaaagcaaaagcatgttccagatatatgatcgaaagaaacatctagattggttgacagctgctcaaagtagcaaaagtgatctcctatgtatatacaaaaaatacaacttctcctgtagactaagttaaacaatctatgcatataacacaatttccaaataagtaatagcacagcagtatgttaatcttctccaaatggtaatatggaaaaatggattcagaccaagtaatctggttttctgaatatctcatttggcaaggcatgggaaaaaaacaaaacctagaaaacacaatcttataaatgttcttccagacaaaatcataggttgtagttttgtacaagcagttaagcgctacagacatgcaagtatatgcatgttatgtcaacttgtgaagtgtaagccttcaacagcagcctaatcttactttttttttctgcaattaaatttactattcctaattaaatcaatcactcctttgtattttaggatagaattccgggctattttaggatagaattgactcacaatggatccgtggtccctaaaagtattgaaaacataggttgatgggtatatatatttattctgaaccatatagaaaaagattttacgggtgtgtttactccatactaaaattggaagtttgtttgaaattagaacgatgtgacggaaaagttggaagtttgtgagtgtaggaaagttttgatgtgatggaaaag

SEQ ID NO: 9606 - DNA, 906 bp, Oryza sativa
ttcctgcagcccgggccaggtaggccaacaactatcagagaacaacagcgggagacaaaataatataagggcccggttaacatgccacaggcagtcgactggggaacgagacctagaacaagaccgcactccgatcatcttgttggatacgcaagcgtaccgacaagggcttctcttcaacactctcctaaaagatatatgaatagcaagggtgagtaccaaccgtactcaacaagccaccacaacaacaatgcatatgatagagggtatttcaaggaatggcttcaggttcttttgcataaagctaattttacaattcttttcacaagcctaaaacctagcatagactgatcaaattttagtacagtgttcactttaaacaacgacggttctgtccaccatccattgtgatcccaaggatagcttcccgccattgaatcgtcatggttttctgaggatgtccaccttccctcctctcgggaagtggctccatcagcataaaattcatcatgcaatatcccatcccccacaagttaagaatttagagtctagccaagtgtaatacatgtcctggtgctcaataaccgcgagcacggctattcgaatagatttggtttactcacactgcagtggatgtacactttatccgcactccgcgactgcccaacacatgagcctcgtcccaacacatgagacgcgtcacggcaaagcttttcgataacctcgcattggcagtatccgctccatgaacttaaatcctcatgcactctaggcgtccatgtttctagcagtgagaggagttctggcactcctgggaaagagaagtctcacacacatattaaattatggttcaagttaagttctctctctcacacactcatggcattcctaccaatggtgacaccg

SEQ ID NO: 9607 - DNA, 4726 bp, Oryza sativa
tggatcggggacgacgggcgggtgacgcaggagcgcgcccgcagcctggagcgcgccctggggcatgccgccatcgccatagacgaggcggcgacgcgccccgtctcgccgtcctccgtcgtcgcccgcgggtggcgatgtcgcggatcctccgacctccctgagcgcctccccccgcccaagatttcgacgagagggggacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttcgaaagacacgcgcgccccctatctggcgcgccagatgacggagcgtggggctcctcaccgggagaccgcgcaggcccccctttgccggttcggccgggggcgctaagtgaggttcttcgccctcaatctgaggaacgtcagcgagaagaatcgcacaagacacgggcgacatagacaggtttgggccgctgagaagcgtaataccctactcctgtgttctggtggatctgtgtgtaaaggaatacagagagctcgagagcgagagagagttccagctctagcacccctcctccttttttttctctcccttctctcttaggcctgggcctcctttttatctgatcaggggtcaccacatgggcctctggctgcctaagaaaggaaacatgctttttacaatgagggctagtctacagccggaagtgacttctgacaagcagagcacgcgcctcctgctccgctcgcccgctttttccgtggacgcccatttcaaccttcatttaatggccagcgacttccttgccgtgcttgcgctacagcctggaatgaatctgaccgggactgacataccaactccaggagtcagcacgccagctccggctagggacgagagccgggaagccctcatcattccgacgggacggggcgagacgtgtgacaggccgcctgttgccacctaacccgcgatctgaccggtctatgaccggtcacacaccgcgactggtcacggaccggataagcgtgcgctgcgccgcattaaatgcggcgtggcgcgctcgtccaacctgctataaatgcggttaggtgagccccgctgtgctcacctaaccacacacgtggcgccaaaaccacagggggtcggggcgccccagccctcggggccgaaacgggagcggcccgacccctcggggagacagagggaggggtggccgtgtcaccctcgggcccgacccccccccaagggggtcaagccacgtgggtgaccgcggctgcccaagcctcagtcacgataccctcggccccatgtcaccgacagtagcccccggcgttacgccagggcgatcgcccccctcgagggaagcgctcgggcgtgacgccaccccttaggcctggtgacaggtggggccggtctctacaggcgggcagaaacccagcggtcgcaaatcgcgcgcatcggcaagggaaaaccgaccgacaataatgagcggcctctttaagaccgctacattactcgagcagcgcgcgaatcgagacgagccggttcgtttcgcctagagacatgatgatggcgcttttcgcggttggcgagcgcggttaatgcgcgcacgatctgccccatctcaaccgccacggccgcacatctgctgcgtgcgccgcaaacgggcgggtggggttagtggaggcgtgggagcgagaaacgagggggcaaggtagtgggcgcgggaagcgaggagccgggcatagcgttggcaagggaataaagacgccgaggaagggattcgtttccttcctctcgccattcttccccttgccttcgccacttgcgctctaactcttcgtttcctgtgccctacccttgccatactcgctcgctctcaagctcctcctccaccggcgtcatggcacggggctccgcaccgctcgacggtagcgtgctgccgccttcccgcatcgtgagcgagaggcaggccgggctgccgcgccgattcatgccggaatctgccaccggccgggaggtggtcacgctgggcgagggacgcccggcgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgcgagatgtttatcggggtgagcccatctctccggttgttccggtggttcttcaccgtacagccggtgtcgccgccgacggtagtcggtggctgctacttccagccgcgggggcaggtgttgaaccgctacattccctgcgtcctccgcaaaaagtgggacgactggaagagtgattggttctacacccccctcgtcgacgaagcgcgcctccgacttccgagccagcctccggcgcaggcctccagctggcaggcggcggtagatctgggagacggctacgacgccgttcttgaccgcctggtgggtctgcgatcccaggggctcacgggggccatggtgttcggtgactaccttcgccgccggatcgcgccgctccagcggcgtgcccggggcgcctgggagtacactgggcccgaggactacatgaggacccaccaggggcgcaaatgggactgggaccctgaggacttcaggatggtggtccaacgggtgctgaatctcagctccgtggaggcatccctcatcccccaaggggtcctccccctctgctgcgatccagagcgcgccaacatcctgaccatcatgcaggaggtcggggcgtcgggggagcgggccccccgaggccacgttggcgcgggcgggagccgcaggggagaacaatctaccccgggggggggtcgtgcttctgggccccgcgacggggacccgggggggagccgccctgccgacgcccgggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggaccgagccatgccgggtgaacctcatctcgcccccgaggtggtcgtttagccgacctccccgcaggttcgtccccgcgcccaccgcggccgtgttcattatcccatctcccaaggcgagttttcactcacccgtttctttttgtcttctggtttttcttctgcctcagcgagatcccatcgcaccccccccccccccgccattccatgtccggccggtctgaagccgaggagacggcgaccgcggaagcccggaggcgggaagctgaccggcgagaagccgcggaccgcctccgggaagccgaggaggctgcccaggaggccgtccgggttcgccaggctgaggaggccgctcgggaggaggccagactccgccgggccggggagtccgtccgggaggcagaggcggcacgcgcacgccaggcggcctgccaagcccccgacccgactccacccgaggcgacgatgacttccgaggccacccacgacgaggccgcggacgcgccgctcgggcccgacccctcgggcgatgcttgggacgagccagcttcgggggacgcccccgggtccggcacgtcgatcggcgggccgagccgcgcggcacccacaccgaggcggctctcccctctgccttccgctgccccactgagcgcggagcccctcctgcaggccttagccgccgcgaacaccacggtgctggacgggttaagtgcccagatggaggtcctgcaggcagagagggcggagctcgacgcggcgtgggcgcgcgtagaggaggggcggcgctcggtggaggccatggtggaggcgggccgcaaggcacaccgccggcacgcctccgagctcgaggcccgtcgtagggacctggcggagatcgccagggaggtggaggaggagcgggagactgccctcatcgccaccgccgtgctcgacgaggtgcggaacgacctccgcctccaatacgggagccaggcggcggagctagagaagaagctcgacaccgcccggggagtccttgacgccgccgctgcccgggaacggcgggcggcggagatcgaggcggcgtcccggcagcgcgaagaggcccttgaggctcgcgccacggcgctggaggagcgcgcccgcgccctggacgcgaaggagaaggacctggcggaccgcgaggccgccgtcgccacccgggaggcaacactggcggcgcacgaggccgcctgcgccgaagaggagtccgcactccgcctccgcgaggacgcgctcaccgagcgggagcgagctcttgaggaggccgaggccgcggcgcagcggctagcggacagcctgttcctccgcgaagcagcgcgggaggagcaggcgcgccacaatctggaaggcgcccgtgccgagagggccgcactggatcagcgggccgctgagctcgaggcgcgggcgaaggagctggacgcgagagcgcacagcggcggaacggccgcgggcgacggcgacctgccgcccgcctcgcagccgccgaacacaccatccccgggctgcagggcgcactggactcgttcgccggggagggggctgcaggaa

SEQ ID NO: 9608 - DNA, 3417 bp, Oryza sativa
gccgtctcccgtctagaccgcgccgggcggcaggcgggcctctggggcgggcggaccgcgaagtacgccgccaaccaggggggcctcgcccagcgcctctcagagatggccgggaccctccagcgactccccgaggagctcgaggagacgatcaagtcatcctcgagggacctcgcccggggggcggtggagctcgtactggcaagctaccaggccagggaccctgacttctccccgtgggcagcgctggacgagttccctcccggaaccgaggacggcgcgcgtgcgcaggtccgggacgccgccgaccacatcgtccacagcttcgagggtacggcccctcggctcgcgttcgccctcgactccgacgaggagggcggtgacgacggtgcggacgacagcgacgacgaggccggcgacccgggcgcgtcggagtgagcccccaggcccccgccaatcttaatagctttttcttctttttccgagaccttcgggcccccttcttgtatagactgatttaatctgtaatcaagtaaagaggaaatttctgcgtcagttctgtttgttgtgtgtatgagacgaggatggtctgtgccacggtccttctgtgtcttagcttgaacaagggctcatgcccaggtcccagcctcaagcggcgcgggtcggggctagtgcctggggagatccacgtgtcgagactggccaggctgggagcgcggtgaccgagggttatggatgacccgattgtgggcctttgccgattcccccccggagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcctcaggaaatcgaaaatgcttttattgaaatacggaagagaaaagagataagtatatgcatgtggtagcccccggccaaccctgcacgcccgggggggtgcggggttggcccgagcccgagacatgacacccgacccccactaggggtagaagcgacgaagctgtttgatgttccacgggttaggcagctctgtgccgtcgcccgtggccagccgaacgcagcccggccgggggacgccgatcactcgatacggaccctcccacattggtgagagcttactcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaaatagtcgaggtcgtcttggcgaagctgatcttgatcagcctcgcaataaatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgctgtgcttcttgaggatgttgaaggtcttggttttgaggcccttgaggatttccgcgttggcacgctccacttggccattgcttctggggtgggcgggggaggcgaagcagagcttgatgctcatgtcttcgcagtagtcaccgaagagctcactagtgaactgggtgccgttatccgtaatgatacggttaggcaccccaaaccgagcagtaatgcccctgatgaatttaagcgcggagtgcttatcgatcttgatgaccggataagcctcaggccacttagtgaacttgtcgacagcgacatacagatactcgaacccgcccggggcccgcctgaacggacccaggatatcgagcccccagacagcaaacggctacgaaagaggtatggtctgcaaggcctgggccggctgatgggtttgcttggcgtggaactggcacaccttgcaccgccggaccaggtcgaccgcatcgttgagagccgtcggccaatagaaaccctggcgaaaggccttgccaaccaaggtgcgtgaggcggagtgggctccgcactctccttcatggacatcggcgagaagctcgacgccttgttcccgagggatgcatttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgacggctgggcaagcctttcttcaaaggcgcccggtggggtctgggctcgcgaggaagcgagccttgaaagttcgtcggcgaccgcgttatcccgtctgggcatgtgccgaagctctatcccgtcgaaatggtgctccatacgccgcacctggcgcacgtaagcgtccatctgcgggtcagagcaccggtactccttacagacctggttaacgaccaactgggagttgcctaacaccaggaggcgtcggatccccagtccagccgccactctgagtcccgcaaggagtccctcgtactccgccatattgttggtcgcccgaaagtcgaggcggaccaggtatctgaggacgtctccgctcggcgaggtcaacgtgacccccgccccggcgccctgaagagacagggagccgtcgaactacatcacccagtaggcggtgtgaggcagctgcgaggggcccgaggtggcctcgggggcggagacgggctcgggagctggggtccattccgccacaaagtcggcgagggcctggctcttgatcgcgtggcgtggttcaaagcgcaaatcgaattcagagagttcgattgcccatttcaccacccgtccagtaccctctcggttatgcaagatttggcggggttgacgcttccgtcgtatttttcggtgatggtgggccggaaccttgggggccaacggacgttccgaaggctcgccacaaaggctcgatagccggcaccgccaaccggggacacggggggccggcccccgtgcccggaccgaagtggcgctccggacgaggaagcgccctccgttgcatgggcggcgcgacgaacgtcgcgccggcgctcgatatcgaggcgggcatccggccccccacgcacatcttcttgggtcggaggcgttaacgagggaatggcggacgaacggtgggcaacggccgacgctctccgcgccttccgcctcgactacatggagccggcggcggcattgccataggcctcagtggcgga

SEQ ID NO: 9609 - DNA, 20219 bp, Oryza sativa
catgtcaccgacaacgaacatgcgagggttgtcaattctttgcctgacaaactcacttaccagctcaggagttgcaaaccatcccgctgtcttggccgttcgcggtttgggggcttgatatggtcggtccattcaaaaaggcagtcggcggttatactcatctctttgtagctgtggattagttttccaagtggattgaagccaaaccggtcgttacaatcactgcagacaaagctagagatttcttcatcaatattgtacatcggtttggggtaccgaatcgtatcattactgataacggcactcaatttaccggcggagtatttaaagacttttgtgaaaactttggcattaaaatttgttacgcctccgtggcacaccccatgagtaacggacaagtcgagcgtgctaatggcatgatacttcaagggatcaaagcacgagttttcgaccgactgcgtccctatgctggcaagtgggcagaacagctgtcgtccgtactttggtctttgcgcaccactcccagtcaggctaccggccagacgccgttcttcttggtttatggcgcagaagcaatgctgccgagtgaagtagaatttgaatcgctacgatttcggaacttcaacgaggagcgctatgaacagggccgagtagatgacatcaaccgactagaagaagctcgtgaagcagctttaattcagtcgactcggtatttgcaagggttgcgccgttatcacaatcgcaacgttcgatcacgagctttcttagtcggagaactggttttgaggaaaattcaaactacacgggatcggcacaagttatctcctttatgggaagggccatttataatctctgaagtcacccggccaggttcttattgactaaagcgtgaagacggtacacctatcgacaattcttggaatattgaacaccttcgtcgattttatgcttaggcatttcgtttgtatctttcctctttgactgctaacttcaagtttttccttgaagttttcagtcggggggctactatgataataatagagtgtgatttttgtcaattcaatttgcttacttgatttatcattgccctgcttggtctttcgacttagtcaatgaggactgaaggtttttaatagcttttacgggttttaggctcaataaggcttgacaaaggcttttaagaaatcaaaagctaagtatggaacaccaagcatagcataaattcatcagtattgtacaaattgtgcctccatcatcattaatcatcaaaatcattgttatatcaatcagtatcagttttttcatcatcggaattatcagacccagtcggccgaaagtcgacatcttggaatctctcaaccacgtcagcagcaatcttgtcagcggctttttgcgcatcattgatgaggtcgagggctgattcttcactcgtcccgtctgcaaacccatcaatggtatcgacatcgattttggggtataaagatttggtcatagctaatgccatgcttgctcccatactcccagcttccctgatattcttgaagtaagtatccggagcgactctcagcttgtcgaagatctcggaagcatcaagtgtactcggactggcgttattgaagaacatggcttggatgagtggggtagcggcattagcgactttatccctggccccttcaagcctgttgagcttttcaactaagacatcaaactgtgcctgggacttgatcttgcggtctgcatcaacagattcacattaatgaatcagcatatagaagataatggtttttgaggtattgattattggtatcttcaacctcatttaaagctgagtccctctgtcttgccagttctgccttgtcattttccagagtttgaatctgcttctccaattgagatatcttggcaacttgcactacattgactctggttaatcaagattacaaagataacaacagaagttagttgggcggagtttgtgcgtaccttttgatgagccactcagttcaaaattggattcctggagctcagcaatccgatccctcagatcatgttcattcttcctggcaagttcttttgtctcgtgcagttgattcctgctggctttgagggtcccgagatgagggactaacctctctaaggttgtcgttttagcttcattcctaagatgaatcctctgcaagacagtttaattagcgcttgaactaaatggcaaacgagatggttgagatcaggcgccaaagagcttacatttacaatgcgggttgcctgaccaagtgcctttttcagtaggcataactcttcgtcctctttttgcttatttattacgatcccttgaggttgcatgttgtcatcccaccacttgaccagaatgggagggcgcgaatcctcagctgctcgtatccggaggatctcttcttcatcaccaatcattggccctagtgtacccatgaataaagatgaagcaatcaaataaagtctgttggattgaaatgatttcagatagcgtgtttacctgtgatgattcccggtcggggacgagtggactcttgtgtcttcacaggagatctggtttctgagtcattgccagcatcctttccgggaggactgtttgtttaagcttcaacctcgggaatcttttggcttggccttgtatccgactggtttgcagtcgggggctcctggttaactccgactccagcttcggccgactggcttgcagtcgtgggtttgtcactgggttttacatagtcgctggcctgcggattatcacttgggtgatcttttgcagtcagcccggtttcttttgaggaatccgcttccatgttagtcgggtcagagtctttctcagaaggatctatgtcagatggtttcctacaagttttgctatcagtgttattttcatgatgggagagtattaatacaaggaagattgttatatgatttgtacctagaagactttctgatttttggtacaagacgcctagaggtcttcttcttcggattagttgacttcggaggtcttctggtcactcctttatctctgagctttccggtatcatcgctttcgtcgtcacttagaaccagcttcctcttgcgagaatctgactggccgactggatcagaagcacttggttgggtttcagaccgaattcttggtcctccgcttccctgaccagtttggcggcgaggtgattggtgctgggagattggaggatctaacttcatcaatgcgaactcctgagcataaatgtcaagcaatttaacaagagacgaaatcatgtttttaaggaaggttggaacgttcgaatacataccggtggaggaggattgaatgcattgaacggtacgactggcagcaagtgtgaatagctgacaacgatagcatttgagaagatcttatacatcctttccttcatgactttgaagtcaagagaatctggatcttcacggtttgggtcgtgcttgccgtcaaattcgaaggctgtgcgagatctctctttgattggagctaactgacacttgataaagtgccgggtgatctgttctccttgaaggccttgttcttttagctttatcatcctctccatcagttccactacttgcgcagtttcatctcccattggcagtgagttccaagtatcccgataaactggaggaagacaggagtactcggggagagcaggctcagggttttgaacataaaaccagtttgcgtgccagcctttgtttgaggttttgaagggcatagagaagtatttttggcttaaggttcccctgagttggaaaccagcccccccaacaacacatggtttgctcttgtttggctgtggtttgaggaagaagatgcggcggaacaaggcgaaatgtggcctaatacctaaaaaggcttcgcaggcatgaatgaaattggtgatgtgaactatggagtttgggttcagatgatgcaggctgattccatagaaattcagaattccccgaaaaaatcttgaggttggaagggagaaaccgccatagaagaaatgagcaaataccacgatttcatgcgtatcgggggttgggaatgcttcgccgaatgctggtcgccacccgatgatctccttcgctggaagaacgccgtgcgccaccatctccttcagattatcttccgtcacatcggagggcgcccactgactctcaaagctttctctttctttcgccatgaatgtgaactggatggtttaatttggtctgagatacggctggaaagggatggggaatcggagcggtggacgcggggagaaatttcgtaaggtttttgaagatggattggagcggattgatgaaccctagtttggccggcgcagtttggtactgtagcaggaaatggggaaaatggcgagagtttcggcggggaagacgatgtgacgcttggacttcggtgtttttagggtatcgggagtactaatgggcctggtcctgtacagtacttcagcccaatattataatcagcgtggcccgttgtgatccctagggacttaggcgctttttgctttggcaatttgtgctcacgatgatgtggccagatgctgttaaaatcctttttaacgtgattcaataattctttggaattattatgatgcacataaaaaggtgcccgacagaaaggtgttataccgtttttgtaagctttcttagtctgcaaaagctgtttgggttgatttaagatgactggtttattaatagtcattcttttagcatgttatatgcttattttagttatggtaagggtcatagcctaggctattagactcattgattaccatgattttttatcatgtttggtggatcattttaagagttttttactcggattcctatcaaatatgtctatttttggaccttttgagtgtttatcactcggccctttttgtattttttatccttgatatgttcaagttgagaagcagtcggctgggtattttactaagtaccatgcatgcttcgctataaaaccactcggttcttgactacatgtttagtttttcaactaattacatagtcgggggttacacctaattaggtgcatctactcgatgcaccatgttttattttcgcccttcgcagtttttgattttagcactcggcaagctggagcaagttgaattaaagcactcggattattgttttttgtttcgagaaggctattttgtcaactgcgaaggtctcgggggctactgtggagattatggataccccatatctacatgacattataatttagtcggatatacggtaccaaatatagatagaatatctctatgaggactcgggttagattctaaacttgtatgtcaaggaaatactcgggatcttagtcagttacgattgtattttatctataatcccatattccgttaggatatggactgtattttgtaaagcggacatcttcccctatataaggagaggtctgtgtgcctcttagggcgtgatcttttttccagtttatgcaatcaataacatactcggcggaatcatccccggacaagagttgggtattacttcttgaataagaaggcctgaacctgtataaaattccttgtcttcaaacctatccactttcctaacttgatagccacccctttttattattgccgaaatcttgtttcgacgacgagcattcaaatgccttggtgcacaaaccgtttcaggactcggatttactccttgatcgctgggctcgatggtttggcggccgagaagccaagctgctctccctcgaactcggcgagctccaccgccttgcccatctccttcaacctcgccgcgtagtccaccacgcggtcgtagagcacgtcgccgccggacgccacgacgagcgccgccgggagcgccaccgcctccaggctggggctctccgggccgaacgggttcgccaccgggtggtccctggtcgcgcccaccggcaacgacatacgccacatctggtcggccatctcgacggtcagcgtggagacgtcggccggcgggttggcctccgccgccgtgcgctccaccccggcgaggaacgggtcgacgaggacgtacccggcgaagcgcgccgggtcgacggccgcgagctgccccgaggcgacgcgagccgtgacgtggtgggccaagttggcgccggccgacaagccggagatgaacgtccgcgcgaagtcggccgactccgcgagccacggatcggcgccggcgccgagcgcggcctggccgcgcagccaggagatgaaagctgcgccgtcgtcgatggccgccgggagacggtgctccggggcgaggcggtactggacggagagcacgacggcggggagctcgtaggcggcgcggaggcagaagccgtggcagatggactggtccagggcgcctatgcagtagccaccgccgtggaagtagacgagcacggggagcttacctccatcgtcaccggcagcggcggcggcggccgtgcgcgacgtgtacacgcggaccctgaggccgtgcgtcgcgtcgtacacgacgtctttccactgaacgccgccggggacgtcgtcctggtacggcagctagctctaccgacgggatgaggacggactcgtcgccgcggacgacggagccgtcgctgaggagcttgacgacgccgtagaagtcctccacgacgtgcggcgccgcgttgtcgccggagccggacatggtgctcatcaacgagtacgtactctcgcttcctcgtctgatgaatggacagagcagcctatgcctcctcgacctcggtacgtactccgtctacatgtgcttttgtcgacgtggagttgccaacatcacaggatcagtcaccagcacgtgaccattgacttggaaagtacgtactcactcagtcccataaaacacaaaacttgagccaaaaccgaatgtgacatattctattacgataaatctgaacatatgtatgttcagattcatagtactagaatgtgtcacatccggtactagattgatttttaataagacggagggagtacttggagagtcacgcacgcaaacgaaagaatgagttttaaactatcgggaggttatcgccttgtcgtttgcatttcacttaaataattttaaaaatacttttgagaatatatatttacaggtgatatatatcattccacaaacatacaagttataatttaaacttatcaagttgtaaaaaaacaaattaaactataactaattaacatatacatttaaatttgtttttttagttgtgacatatggaaattaattttgatattgcacgtttgtagggtgatatatcacattttaatatacataatttttttaaaaaattcataactatttaaatcacgtgtaaataacgatagaatattttatcgagtttatagtttgcccgcaaatgctactagtacgattcttggaggtacatccgggtacatgcgccacagcagccacgacaagccatctacattgtatgggggctactagctggcgcgtgcgcaccagcagcgagcactccctctcccctttagtctactcttaactaactaaattagttaatatacttaacactaataatagtaattagaaaaattctggagatttttttactaacagattgaaaattttttaagttagatttgaaaactttcgatttaagttttaaattttaaagtcaaaatttaaaaactttcaacttaaatttgaaaactttcaacttgagatttgaaaactttcaacttaagatttgaaaactttcaactcagattcgaaaactttcaagtccagattgaaaattttgaaaactttcaatttaagatttgaaaactttccactcgagatttgaaaactttcaactcgagattcgaaaaccttcaaatcaagatttgaaaattttgaaaattttcaaaatcgagatttgaaactttcaactcgagatttgaaaactttcaagttcagatttgaaatttttcaactcaaaaattaaaaactttcaaactcaaaacatgctaaagataaaaaaataaaaaaaatggaaaaaaaggaaagaaaatggaaagaaaacgaaaaaaaaagtggagacgcgcgcacgtcggcgcagcggcgctaggcgttctgggtccgaaacgcgcgccggcggcgcgcgcgtattaggtttttcgacattatatgggctgtacacgggccaaatgcagaagcacatggacagtgggctcattccacccagcgattatggacggcccacggtccatagcatcgttgagaagtactacagatttacagctccaaagtacagcaactcgttgtccatcaattcctttgcttcaatttggaagatcattctgttgcttcgttcgttcaatcgataatattatttcatgaatgccatcttattcagatacaggtttctactttgtattttgacaagctacacgcatataaatgacatcgttcatctacttgccaagttttacagaatcgaagttgcacacttacacaaaagatgaaacagaacacagattcagaccacatgagaacaccaaccatgcatctctactgatccaacttaatttacttggatttagaagttattagaaccttcatctttgtggataaatcgcttcatgactcggattaactcgttggctggctcgctccatggctgcagcgacaagaacaggtgcttctcctcctcgaaggtgacgagctccaccggcttctccatctccttcagcctcgccgcgtagtgcacggtgcggtcatggaggatgtcgcgcccggccaccacgacgagcaccggcgggaacgccaccgccgctaggctggggctgtccggtccgaacgggttcgccaccgggtggtccctcgtcgccccctccggcagcgacagacgccacagcttgtcggacatgtcgggcgtgaagaacgcgccggccggtggctctgcctccgacggcgcgcgctcgacgccgccgaagaagggggtgaggagcatgtacccggcgacgcgcaacgggtcgacggtgagttggcccgagccgatcagcaccgcgacgtgatggctcatgttgccgccggccgactcgccggcgacgaacacgcgggcgaagtcggccgattcggcgagccaggaatcggcgcccggtccggacatggcctggtcacgcagccatgacaagacagccgcgccgtcgtcgatggcggcggggaggcggtgctcggggccgaggcggtagtcggcggagagcacgacggcgcggagctccgacgcgaggcgttggcagcagcagtggaagctgggcttctcgaacgtcccgaggcagtagccgccgccgtggaagcagacgagcaccggcagcctctcggcgtcgccggcggtgggcggccggtacacgcgtagcttgagcccgtgcgtagcgtcgtacacgaggtccttccactggacgcccggcacgtcggggaagtcctccggcggcagcagggcgccggcgccggagccggcatcggagcggacgacggtgccgtcgctgaggagctggatgacgccgcgatagtcctcgacgacgtgcggcgccggcgcggcgtgcccggacatggttacttcttcagtgtgccaacgcttagtgcctaattaaacacggttgtttcgtttaagtaagcagatgggctaattaattaattagataattaatcggttgacacgaagcttcctaatcctagtcgttgccttgatcgccaaaccatgactttggctgtcaagacttagtagatatttttctcttttttttttgagaaaaagatggaaggagtgttacttttcagaacgggacataataaaaaaaaagttttataagaaccacttggtacttttctgagtattatagaagaacaacttcactgaacaaaaactatgtagccatgcacctcttggctcttgcaacgaaatttacatgaccgtacttattactagtatagactatagagctatgattttatccggaaatttgagattacagtttgaatgttcgtgtgatgagatcagactcttgagtgatccaaagaagttattgagtccagcatcagtgatgctctgtctcagctttcgacttacgttatgcgtaagcgggtgatacagagtgcaattctgacattcttacgcgcatgaagctctttttctacaattttgctgccatttttacaaacaaaaccatttttacggcatatgaagggtgaggtctggagtcaatacttttgtttgtaagaatttctggagaactaacgagtctggcgttcggatgcacatgcgatacgacacaaccatacaatattttgatttcaatacgtttaaatcatgttattttgcgtttcaaaaggattgagaaatttacctcaaaattgcaaaagtgatggacgaagcctattatgagtactgttcgccgtctagtcctttttcgctgctagctttcctttacatttttggatttgtcccatttccgacgaatgtcagatgtactccttttcctactagtatgacatgataaatttttgtgtgttcgaaaaaagatggccgaagcccatatttccccaatcaatgggccgtgcagccgagagcctgagatggcagttattcctattgggccagaaatatggtccaatacccaattgaaaagcacttagcccaggcccaagcgcatgtactagtactcccgaaaggaataagtctgcattgagtcccttaaatatacatcggatctatccctcaacggcaaaatcaaatataatgactccaactgttaaaaccatattaagagaggaggaaacattgacatgtgggccccacatggtgactcgactattttgaccaagttaactagccacgccaatcgaccaatgaaaaccactgtcaaaacagtccagaaagccaaactacaccagtttttaagtagttggggatcaacatatctagtattgcagtcgaggatacaaattaaatcggacctatattgagggagttagagtcgacttattccttcccgaaaggccaatctgcttccgtccacgtgactatccaacggctgagattccgtgcagccggttttgcttgcaccaaaaggcgttttctgtgatttttcacaatacctttacaagttgtaaaaatgttacctataccttttctaagttgcaatcttttcatatccttgtaaaatactccgtatttcatatgagcaaatggataagtcaaaccataggctaaatagtaaatacatgggcgatagatattaattcggtccaccagtttcaccagactggtaccctcaactctccatcagttgctggccaaatggcaaaatatcattggacacttatagttgcatcatgcctaatccagattccagttaataataaaccttactttctgagttgacttagtctctatccccacaacaaaaagagcactaggtaagtagatataatggggtagtataaactagatacaagtcgctgcaatgatgcatgcaaaatatcaacgccatatcatgttgacctagcataaacaaaactcaaatccggcgaagtacgcttgtttgctatcaataatgcgagcaaacaaatgaatcttaatagcatcacactaaggaagaatggataatacatctcatccacgtctgttaaataatttatattcagccaggaggagaaatcacagccaagacctcgtctcattcactgatcatcaatcaggtccctgaccagtaatttttttttagaaaatagattttcattaatccggtctctatatccacgaaggatatacacatccaaatcatgaccagtaattgatctattcaaatattgatcgcggcaaattaaccattctaatcaattctaagcaaatttcgattggtttggacgttcatattgcaagatctctcaggtaaatcagccactggccggcctgaaccaatttcctttcactatgaacataagatgcccatttttccaggaaaaaaaaagttaacacaagatatcaagggttacttaatttcagggccttatctgcaacacagccagtgcttagcttagcatgctacatactccaaagttcaaaatctgcagaccaaagcattccatctgacagagaccgcaattccaccagacacaccatttttttacgctcatcatgtatgccttctacgtaatgcagcaccaatcatcaatcatttccttcaaaaaagcaaaaccacacacacaatgccaatcaaacactaagtaattctctctttctgagaaagaagcactatataattcagggacagcaagatcgcattcttagcaagggagaagactgaacaaacagagagagagagagagagcggccatggcgatggcgagggggaggaaggagagggcgccgcgagggtacgtgccgatcctgatcggcgggcagggggaggagagggagaggatcctggtgcgcacggagcagctcaagcagccgcacttcctcgcgctgctcgacctcgcggtgcaggagttcggctacgagcagcgggggattctctgcatcccctgcaccaccaaggccttccgttccatcgtcggtgcagccacgcccaccgccgccgccgtcgccggcggcgagatcaagtcatgacacatgctctttctctctccagtgttcttgttttctcctttcctctttgatccgttttagctctgtgctatgcagagttgttgttagcttagctcatgtacgtacacacggatccaagattgtatatgcagatcacgatgagtttatggaaagtcgtgatgtgttatagcagtggatgtaaattgtgatgttatcttgtataattgcacagagatggaacttaaaaaaaaactcgaatattagggaaggacctaatatcaaataattagaaggggtgaggctttgaacccaggtcgtctagcccatcaccttgtggagctagccggaagacccctgcacagatatggaacttgaaaacaagtaccaaatgaatccaagtgctagcataaactactgctctgaaattttccccaaaattatactaactccgattttcaatgtacgacgcagttagcttttgacgtgatttttatcatttgtcttattaaaacaatatataaatattatttattttgttttgacttgttttatcatcaaagaaactataatattaacttatacttttacatatttatattaaatttttaaataagatgaatggacaaacgttatgtacaaagtcaacggcgtcatatattaaaaaattggaggtactagttttttttttctcaactgcatcattaatacaagaatatattgtggtatgtactattgtttcttctcgactgcaaaatctctttccttttcttaaaacaaaatgaatacaggaatatacacactttgatgatcaaattacagtggtataagctgcttgtggtatgtggtgtgatagtacaatacatactacaaaaatgaactaaagtttcagacataacaaccttaaaacaaaagaaaaaagaaaaagagagagacattcagatatactgtacattccaaactgatactgtattctcattggcgttcagggctaccgacaaaaaggaaaactggtgtgctggtgctaactgaagacggcctctcaaagattctctgaagcaacctcggcaacggaggcatgtcgcagtccaagacaccctcaagaatctggaccacttgacccatcgtcggccgatcaacctcatcctcttgaatgcaccagcaaccgatcttgcacactctctcaacctccttcaagtccgcttcaccacacagcttctggtccagcaagctcatcacatctccatctagaagcttccttgaagcttgcacagggaagtagacagaatagttgccatcagtgtcagtggatgtagaagtagtggtagtagtagtgcattcttcttctgatctggctgagttcctcctgcctgacactagctcaagcagcaccattccatagctgtaaacatctactttcggtgtaattgctgttccactaatccattcaggcgcaagataacctatggttcctctcatggtggtgagtgctctgctgaaatctctccctacaaactttgccatcccaaaatccgcgaccttgggaagaaacgatgcgtcgagtagtatgttttgcggtttgatgtcgcagtggatgattcgatcatggcagctctcgtgcaagtagcacaagcctctggcaactccaagagctatctggtagcgagtgttccagtccaagaacttgccattgctttgaaacagatgtgtgtcaagagatcgatttggcatgtgttcgtagacaagaaacctactgtcgccgtcactgcagaagccaatcagattaaccaagttgatgtgttgaatggttccgatcgatctcacttcagctctgaattgcttatctccttgtgatctaccgtcgagtcttttcacagctatgccggtagaatcacgcagttgtcccctgaagacggagccgaatccgccttcgccaatcttttcagaaaagtttttggttgcagaacgcaaatctttgtacctgaaagccacgaggctaccataattttcactcctgttcttgtctttgttcctcctgatgatgaacatcaaaatgaacatcagcacagccaaaccagcagcgcatgcaccaacgacgacaccgattatcactctacgtttcttgcttctctgcatatctcttgctgagagacggagatacatgatttctccattggaattctgctgctgcagttttgcattgagcaattcagtgtgccaaacaaggcaacctttactgccatatgaataagcagtgcaagagcaattattcagacaaaccttcatgcattcatctgaactgtcaacatcctgcatgctttcagctttgtcaggcaagatgatatcagacatggagtagaacttatcagttgaatctgatgaactcgtgttgctacctacacaatccaactgattctttctcacacatccaccagtttgatcgccttgctcccaatccttcactgatccaacagtgaatcccttcatgcagctgcagagtggaagcaaactgaaactgcagaccgagaaagccccacatacaccgtacacatcacactgaaccttcggattggagtacagcgtcagccaagactgcgagctgtccagccaaacctgctgcttgttccggccatcgacgtcgatgaagttgcgtgtcaccacagcttcatttgacacattgaactggagatattcctctctgctgttgtcgaagaacccaaggtgaaagccaggtgaattgccgatcagctcagggatgccagtgaagtactgaccattccatggtccactggaccagtaggtgacagacgaattgcagagcttgagcacgagctgaggcgtgtcttcgtctacctcgaagcagtaggctccgggggacgggccggccatgctcttcttggagacgagacggcggttcaggccggtgagcttgtcgcggccgagcttcgcgccggggaggagcgtgtcggtcgggtggtcgacgctctgccacagcgtacgaggttgggacatgttcgaggtgtcttgcagtacgaggtttccactgttcagaaggacggctgcagtgttgttgctgttgctggtggagttcttggctgaaacgttggttgaccaggctattgacttggtggttgggtgtaaggcaaccaggtcgccgtcgtcgccggagatggtgagctccggcgagccggcgtcggcggcgtccatgattggctctccgccgttggctacccataccgtggtgcggttgggcaccgtgttgaaccatatgcccaggaaccatttctcttggtttggagccggggctttgaagaagccgagcgcgaacttgccgttgttggagacgaccttgtccttgccgccgacgacatggccaggcttgacggtgtccgtcgcggctgaacacgccggagcaccgccgccgaggaagacgacgatgagcacgaagaggttatacagaagaggaggcatgtggatcggatgtgcgtacgtggtacgtgccaacgtacgtatagtgaggtgcacgcgggagaagagacgaggggcattaagtagaggaggcgacggttacggttcgtgcgcggtgagcggtgtgagtttgaccgaaacataagtggtgataaacatgtactataagcggtggcgacggcgacggtcgccgacgtaagatcgccggcggctaagagccctataacagctagccaagtagtagcgagaaggctgcgtatgtgcgccgtttttaacgggtgattttgtaactgctttccttttgccttctcaacttaatttcgacgaccgtggaattaatcccatggcatttgtgatgccacgttatctcacttgcagagatggttctgtaacgagttattacctgttccagacggcggctatgtatccaagatggatccttccggtgctgtgcgcctgccgttccactgacgtcgtgtccggttcagtcacgtcagctccgcggcggccggccgatcgagataaggtcaacagtgatttaccattatttttttaaaacaaactcattattaacagtcatatatttgttatatattctcaagttttagaaaacagatttttacttgtatatttgtatggattgagatcctctaatgtaaagtcagaggaacgtggtgacttacatgtgagttttaccactcacgagcccacctgtcagtgaccacgtcaggagaagttcatgttagaggatccttttcatcttgtaatgatgtattgttgtcattttttttaaaaaaaaagttattttacacccaaatgcaatcgcacccgttagcgttagcgtgaggcaacgccatttgacacgccataaaaaacacccttccatttttttttgtcctcaaaagaaatctccgaagagtgttatgggtattgatatgtaaaactctaaaacaaaaatatacttttataaatattaaataattaaaaagttaaaatatcttgatctttatccgatctgcttcatctgcggcaggccggcctgtctgatcccttgggcctccagcacgacagggaactgggccgcagaaagctgaaatggagcagtttcggcctagtgccaactcgcgccaaaacgaacggacactgccgcgcgcgtgcgaccgcaactaaaccactctcttggttaaacttaaatcactcgctcgagcaagtgagcaactccacaaggccaagctgctaaccacactcagtaaatcacgggttaagtataactacttaatcagcatttgcaaatgtgcatcgctataaatacagcttttttctaaaacccgtaaaaccatcaccatcagatcgagagcataggtcacagaacaacagtaacaagacactaattaaaacgaagcttgatcaaatggagttcaagaagccaacgatcgggatctcctccttcctcctcctgctcctcgtgtccgccgccgccgcggcaaggccgacgcgccagctagtcgccaacgacggcaccgttgccgcgcccgctgtcgcaccggccgcggcggacgtggcggccggtgttgccgatgcgccggtggctgctgccaatgccgacgtcccagctgctgcggcagcaatgggccctgtggctggcgcggcggcggccggagcaccgatcggcgccagcaccatccctgtggcggcgggcgcgggcgcggtggggatgaacggcggcggcggcggcggcgaccaccctatggtgttcttcatgcatgacatcctcggcgggacgaacccgtcggcgcgcatcgtggcgggcatcgtcgacaacacggccgtcaccggccagctccccttcgcgcggcccaacggcgccgtgctgccgctgaacagcggcgtcaacgtcaagagcggcgcggccggcgccatcgacaacaacaacatccccttcctcaccggcctcggcggcgccaccaacgccgccttcacgtcgaacagcaacaacaacaacaacggcgtgcccgtcttcgccggcggcagcctcccgcaggggaccacgctccagaagctcctcttcgggaccatgacggtggtcgacgacgagctgacggaggcgccggggctgggctcgccggcggtgggcagggcgcaggggttctacatcgcgagctccgaggagggcgtgagccagacggtggtggtgacggcgatgttcaaggaaggcgagttcgccgacagcatcagcttgttcggcgtgcaccgcacggcggactcggagtcgcacctcgccgtcgtcggcggcacagggaagttcgccggtgtgaagggattcgccaaggtggccgtcgtgaggcccggaggtgtgacggcgactgccgcggagcacgagacggacggcgtcgagacggtgctccagttcaccgtgttgctcatcatgtactagttaggtaacgtggtcaagctcaggtttaccaaaatgtttggggctgacgttatcgtggtcaccccatggtttaacggttacaatgagatatatcatggtttaaaaaatagaaaaaattatcacaccgttttataaaccctcgctattaactacagttgtgaaaggtgttgtgcttgtccgtgtgtcccggaaatatgttgatctcataattatgtataagtgcctgtattttgaaatatgaacgaaattttgatcccaaaaagatgaagagcaacatccatctggtacaaatagttgtgaacagttttaatatttcgaactgcgatgttactttttgtggtctaattgatctattgcacatgtcaacgtggcactcttaaatggattagatcaaacccaaaaggggaaaaaatacaaagggagaaaggggcgtcctaatgggcgactggtcgcgcccacgcccaggcgcgcgaccacccctcagtcctctagtctctactatagttactagtactactactacactagaactagtgtaatactgtactaatgtagtagtatatgtatatacatgtatataaactatgtgtacgtataaaaaacctaaaaaatacatgtatacaaattttgtaaatatgtatacaaactttatatacgtatgtataaaaatctaaaaaaatacacgtatataagtttatatacgtgtatttttttagatttttatacacatatataaagtttgtatacacgtatacaaagttcgtagacgtgtatacaaagtttgtatatgtgtatacaaactttatatacgtacgtataaaaatctaaaaaattacacatatacaaagtttgtatacacgtatacaaagtttgtatacatgtatataaagtttatatacatacgtattataaaaaccggaaaaatgaaaaagatacgaaaagaaaaaaagaaaatacggaagaaaacagaaaaaaacgaaaaaaaagaaactgtacacgcgcggcagaagaaaacagaaaaaacaaaaaaaaaagggagaaaccgtacgtacgtgcagtgcgcagctcctctccacgtgcgagtcacacgcgggaggatgcgcgcgaccgatcgctgattagtgatttcggaggttttgccatgttggtagagtagttggtttgatatataaaaaggaaaaaaagcaggggtgtcaacgcaaattggaatcgccttgtctacgtaatcagtacagtattcagtagtcaccgccgccgtgccggctgactagcacctggaccaactcgaagtactactccactgatttgtgggccatgatgcctttggccccgtatgtcggtgataggtacaaattaaactggtacggagtagctagtaatctcttcatcctaaaatataagcgattttaggttcgaggatatatcatattcatctaaaatcttttatattttaggatagaggaaatactatttcgtggtaattaaattaataaacatctcgggttaatttatctgcgccaaatcgtgtcgtggactcgtggttgtccctatctcctacctcgagttcgagtggttggacgtgttgtacgtacttcaaaattcaaatacggttctacatgcatgtgcatcacaccaaaccgatatacaactcgcgttcgttagtatataccaaatcgattaggctac

SEQ ID NO: 9610 - DNA, 1852 bp, Oryza sativa
gtatgcgtggtgatttcggcaccttcgatcgaaggccttcgtaacatgcctccaaccgttattatgcatgatttgcttttcgttaattgagcttatattacactatgtgattccaatggcaagtctactgagtaattaatatagttaagttatttatgacagctatacaatagagttaaaataaagtttagggacaaatgtgatatctaattagtaagagtaagtctttaatataacgatctaaatagtaaatagtaagtactacctttgtttcacgttacaagacattttgagtttgaatacatgcatctatgcatgtgcttcatatataagtcaaaacttatatgaatgtcagtgaatttaaatgatggatagaaaggataaaacatatatattataacgtggaatggatggattgctctttatattacatgtttatgaaattgagtgaatttcttatatataccactgaaatttgatctgatccctttatatgtcacacaaaattgactatgaattattggttacttatctattactattcaggagatcaagagacatgtcgaaattcaagattaagcgaaaaagttttaggctttgctaccgtgaccaatatggtacgaccggtgcctgtgatgaatctttcttgctcagaatgacaccattgcacaaggaactatctttgcgcacagaagcgatatatgtttcagctttctacgaaatgttgaaggcaaacggtatgcaccagtgggtggtttttcatgagcataaaaacaccatcaagaaatcactcgataatttaaaacatgcgcttcgtagatataaaaagcaatcgaataaaattggggctattctacttggtgccaaggaaagacggcaagtttggattcatcgtccgtagtcctctactcgataagcccattgaatatcatggaaagagaagaataaagctccaattcaagaagagaagtataagcccgtcaatcacttcagcaaatgtaccagcagcgaatattttcactattgcttgctctttctttagtagtcacttggaggatgcaagtgaggttaaggacattgctaatatacacttgtactcttattttatgttttgttataatacttctataactgtgcataattaaattcatgtggcaatgtattcaagaatgtctatacactatgcatctcttctaattttatattgaaaaaagtggttgtaaacgtgcccaatcagctatggccgtcggccttcatcaggatttttttttcttgtacccgttgaatgaaacaatatttaaatatcaagcttaaatctttttatatgcacattcaaatgtgacgtactgaaatattttctgtacacgttacataaaaccatgacaataacaaacaaatagggaattccttgttaacttgggtgcattcatacagtaacacaatatcaatgaacacaatagaaagttctatacattcaactatacaactgcgggtagagccagaacacggcgaagtgggtaacatgcagtcattattttttattgcgatttggagatgtcagctctcagctcctcttcaagttcgtcaaactcccacccacttatctcttcaggtgagtatttgttaacttgaccaaattctaattctaactttgcaagttcagaatcaagatccagcggctggtcaggtttcgctggagattttggggagaccacagtttcagctttaggtgtagaaggtacctgaactggtgaagggcttgactcagctctctcctttgttggaacctttgctcggcggacttcaatgtctaacgtcggtcgttctacagactcgaatctctctctaagtt

SEQ ID NO: 9611 - DNA, 887 bp, Oryza sativa
tgaaacaatggtttcaaacagtttatatatcaaaccaaataccttgaatgtagaaaggtgatatttagtcaatttcaggaaattgtctgtacatctctcaagctcatcactacataaacaaaagataaagctgaatttagtaaacatatgttttagccacaggccctaatcaggcaataaccactacatacttggttctcttttccttctgttcattatatgatgactgaagctgccacgtatcctcaaggaaattgatccaagtcttgactacgccagcctccacattacatgaggtaatagattttgaaagttcattatcctgattgatgccagggaagagaacaaaatattaagttgatcaatattttgataacaaacagcactaatcaattgcaagaaatataactgaaaaaaaaaattgaaaccagatcaacaaataaagtatcagcaccttcgcttttaaactaaatatcatttgattgtttgcttcatcaaattgatccctctcttcccttgtttgcttgagacgtccaatggcagcattcagtgaaatgttgacctgttggtggagagatatagaaagaacacaaacctaatgtcaaccttaagcagaacaataataattcttatagaaacaattcagcagaaatgtaactccaccagcccactatatattgataaaagtaacgcgattgaatggtgctggagtatatttgtaaagcaaatttccaattttgtcatttttattcatatttttaaaggaatataactctttaaacttatttacaagatggcatatcagttgattaaatatcttacattttttagatttaaaattgatggcacataacaactgcatatccacatcaaacctagcactggaa

SEQ ID NO: 9612 - DNA, 2258 bp, Oryza sativa
cgtagtttttgcatggtcttcttgagtttgttgaactcttgatgtctccttctcatttagtttcttccacaactctacagcttcagcatctattctgaagcgacataaacatattagagtaacaaaagtatttaagtttcaaattgtccacaagaagtatataaattcctaaataaatgcataggaccccccccccctttctcccccaataagagtctagatgcttgttagtagatttataactacctcataatgtcagaattcctctttagtccagaaatggcactttgggtaaactgaagcaactcttcacgtttcaccttcatgtgtacagaaacagagaatcattgacaagtcagattctgcatagtttagcaatttgtgcatcagagttaatttttctcctagtggaaagacattaaaggggggatatactgaatactacattctttctacataaaggaacaatggccttcctgtctagaggagtgaagcagcattccattcagtactccaatcaagtgatgcattgcatgagcatagactcatagtgagtttgtgactgactacatttctaaataatcctatgcaaggaaggggtcaccttctgtcttaataatatcttcccccttttggtaggattactttatatatcgttactgaaataaagaaacttcatgtgcagtaaactcagcaagacccccaaagttatataatttagtcctaaaaaaatgggtagtttacaatatcattaaatgcattttttctaaaaaaaaaaaaaggttatgtgagtttttggaagaaaaatatgcaagctaagtgtttatactaccaagaaatatgtaaaacctaaagaaacaccaatcacctggaaagaagacatcaagaaacatatactacagctgcataccctagttacataacaatcattgaataatcaggaatgaatttttgcaaagagttacatgttatatttatccatccactgattcaatactcagcatagaataaaagtgcaagagacaacccaaaatgtaccaggacttcatcatggtaatttgagaatgattttgccaagtcctgtatactgctcatgatcgcattattgatttctttccctcctgtaagacataggctgcaggaaatgactattagtaataacggtaggttgctaagcttcattcaaacatttcttattcaaggaacagaaaataggattgcaggatgcctgcatacatgatgtggtttctcagaacacatcagtatggagcatctataagtctataactaacttaaacagggtgcagggacatatcaagtgaaaatgcagtttttatgcaaatttcattttcattcgacataaaagcgccaaaagtttctatccggaacagctactagaaaggccatgctatacgtctctacaaaattttatgatcaaactctgcagaattgtatgaacacaggaaactggaaaagacaaactctgcgatgaatagttaattagaattgtccatcaaatattttatatttttgaatcttgtaaatgcaatttgagtttgatcataaacttttgcataaggatgtcaaatccatgtagtgaaatacaggaggcatttacaaatagatcatgtaggcaataagctcacccgaaaatttccaaaagcaggggaacctcttcttcattaggagcttgaagaatctgagaatgataaggattactgtgcttaacttctatgagtgctttagcaaaaaatagcattgccttccaaaaaaaaaaaaaacacaaaggtgcttttatgctctcctgaaggaaaaaaattgcctgagttttaaaacttcagagttaagaagccaacattagtttgtgttattttcattatctttttgaaaccaaatttacaggatgcatgccacccatgctacacatctatgtgaaaaggtaccaaccctgcagttgaaggtgtttatactatgtgtccttcaaatgttgcacaggtgagaagactaatagtatgaacagatcagtttattagctgtggacattgagcgaacacatggaagaattagctgaggtacacttagttttgggcataggcacagatttggatgagttacacaacccacagcaataactaatttaagttgcttagatattggtgaacgctttttctaaaggaacaccaaggcactcctcagtcctcacaatagcagtatataacaaaaggcacaagcaggttcactcaaaaattgaattagtt

SEQ ID NO: 9613 - DNA, 3280 bp, Oryza sativa
tactcttgcaaatggtggttttgaggtgttcggttcacttgaatgggcattctgttcggcagccccatctagacctccaagttgagcctcaacctcttgtagcgccctgagccagtgccttagcacctgaagcctatcctccccgcgtgatgaaaccgcggcctcttccaagcgcttcaccattttcttgacacttttgtagttttgagtgctctgtaatcccaaaaagaacacgttacacaagacgagttaggaggcattttgacccaaaaagtcaagccaccatcagaaacatagcatttggtatctagaaaccacaagactacactctatttacattttacactgcaatagcatcaagctaatctaaagccccttttccttcataacagtacaagacactgtcttactaccgtgcagcagatcatggacatgagatcatcccaacactataagattgcttaaattcatacgaattgaactcgaattatatctaattcgaacacatgtccaagaacaaactcgcatttgactaacttcccacttccaattgcaagtttggcacctcctcaacacaaaacgagagagcacgtcccaggacaaaaatcgaaaggggctttctgagagaagggggcgagggagggaaacggcgggggggcgggggtagaagccgctcaccatccggtcgttgaggatcttcgcgccctcggcgacggcctggccggcgtggtgggcgacggcgtcggcgtagcccagcacggcgcgggcgaggccgctccggccgcccgcctcgacggccttgctcaccgcgctccgcagccacgacgacatcggcggcggtcggcggcgggatcaatcaccacaacaacggcggcggcggaggtaggtgggggtgggatgccgcggcgctgtctcgagtctcgactggactcctctcccgcgaccggggcttcttcaggggagttccaagttctccaacactgaaagtttctgaactgaagagatttcgtgtacttttcgctctctctctctcttcttcttcttcttcttcttttctttttccctttattccttttctctttttttttatctggtaataaaatatttttttcttgtttggattgggagagctatgcggttctgttgtctgttctgaaatctgaatggacatgaaaagggatgaaggtcatgtactcatgtgactgattggtgctcaactattaatcaattagtggatcgttagatttgtcttgtactcgttatttagccattactctttcgagaactttttgtggactataaaacaacaaaataattgcagctaacatttttatctatatttcctggtcatacttatgcatcctatatggaactaaacatttggaattgtttgttgtggaaaagttatctccccaacaaacaatggattcatttatcccggcactaactttggagtaagactagtcaagcctcacattaggctatttgggttagattactcccactcttcagcgctcctttttgaaacacatggttttaaaaaacgcaagaataaaaaaaaacgcataattgaaataaggcacatgaattaaaaaggtgatgtgtctagatatctcaaaggaaaatatcacatgaatttgatagctttctagagagatgatgggaaaatatgcgttgtggaactggactaagggaaagcaatccaaaggaatttatcaacttctaatcctatgttccaaacaatcaagttagaaaatatttctatggatttaaatcctttaaaatcgtatgaaaatgctttaatttaaaggatttattagcccgcgtatctaacataacatttccaaatgaggcatttttcatggtagcccagcttggcccaaatcctctcaagtctaagctgctttctttcttagtaatttatattttctatatagttgatatccattagcaattacttcctccgtttcacaatgtaagtcattataacatttcccacattcatattgatgctaatgaatctagacatatatatatatatatatatatatatatctaaattcattaacatcagtatgaatgtgggaaatgctagaatgacttatattgtgaaacggatggagtatttttttcgagtaagagatacccattagtaattattaaaaactaaacttatcatacaagtatgtcacatcatcgttcactagcaattattatcttagaccattttaaatctcatgcaaatgtgacacatcatctagaatatattatattatagagctcaatatataagtacatatactatttctataatatttaatatatactcatacataaatcccgagcacagtgcaaagtatcacctactagtaaatggttcaaaccactttctaaaaattgttctttttcaatcaatcaaaaaggaaatgcagaggtcgacaagacaactttgcaccccattttcggctgtgtttagttcacgtcaaaattggaggtttggttgaaattgaaacgatgtgacggaaaaattggaagtttgtgcgtgtagaaaagttttgatgtgatggaaaagctagaagtttgaaaaaaaactttgaaactaaacaccgccttccattgacttcaacggattcctcattcctgtgaccagacacttgcttcctattgtatcactgtagttgcatgctaagatccaaatgccacatacttcttttacacaacggggtgagacggtcttcctttccactcccaagaacacgcaaaattgcaaaaatattttctgatataataccagcaactcgctaaacatacaggcgagtgggccgacgaggcattcagttcggtcgcatctgacagcgattttcgcgtccatggcagccgtggaaaacgaaggtctttctctgaacattgtcgtgttgctcctgtaatctgttgctcaggatacgcatgccgaattgccagccatgtgtagatgaccgcactgctgctccaagaaaaatctctgaagtttgtagtatcttgcaataataacacggcatcagtttctgagtgtatcttgtcagtattaattccagtcagccatgaattcccttttgttttcagagtacaggacactgactgcatttcttttcataccctcgagaggaaaaggccaccatgcttccgatttctaacacaaaagtctcaagaaaaaacgagtcttgagagaaaacgagttgtagcacaaggttttctccctttcttctccttgtgtttgtgtgtgagcttctcaaaacacgtg

SEQ ID NO: 9614 - DNA, 6781 bp, Oryza sativa
tttttggtaattttttatggagtttttttggctacttttgatggagcatagctaaatttctgcctaaacctgtgattgtttaagttagattgttcgaaatttgagcgctcggtacatcaatttaaatgcccttgtttttgtgctgaaaaaagagagtaatattctgtgggtttctccagtattgttgtgaaactgaaccctgaattcgtctatggctttgaaactgaactatgaactcgtactgatgtgatcaatctcaatctcatgtggaagtactaactgaagatttatctttctcatgatttgatctttaggtactcatcatcaattgtgccatccaaattgaagttcaaatttccactgccaagatgatcaaactccggtcagctctaggcgttcttgagatcttgtcagttctttgcatcagccttgttgctgcatacactccagtagacaactacctcatcagctgcggctcatcggtcgacacgccggttggccagcggctgttcgtcgccgacgactcgggcacggtcgtcctgacatctccggcgagtgacgcggtgaaagcctcgcccagcgcggtgtccgggttgcgcgacgacgccgccatgtaccagagcgccagggtgttcaaggcgccgtcgtcctactcgttccggatcagggaccccggccgccacttcgtccgcctccacttcttccccttcgtgtacctcggctacgacctcgccacggcgagcttcaaggtgtcgacgcaggacgccgtcctgctcgacggcttcgcgccggcggcggcggcgaggggcaacgcgtcgacgacgacgacgacggcgacggcggcggcggtgtgcgaggagttcctgctggacgtggcgcgcgacacgctcgtcgtcacgttcgtgccgctcgccggcaggctcgcgttcgtcaacgccatcgaggtcgtctcggtccccgacgacctcatcggcgctgctgactcgtcgctgtcgacgtccgactccactggccagcagctcaaccctgccgtgatgccgctgcaaacggtctatcgggtcaatgtgggcggccaagcggtggcgcccgacagcgacacgctctggcgagaatggactagtgaccagcaattattggttggacccgcaatgactaaaggagtttcttacaatcgaacaccgaactacctgcccgggcaagcgacggcgaacgacgcaccggccatcgtctacgccaccggcagggagcttatcatcatgacgaactcgacggacgacggcatgaaacaaatggcgtggcagttcgacgtcggcaggtcggcgagctacctgatcaggttccacttctgtgacatcgtgagcagcgtgcctggccgcctccacatgaacgcctatgtcgacagctccaacgcgattcaagatctcgacctctccgccattggcaatggcacgctggcgttcccgtattacagagacttcgtgctggctgctagcactccatccggcaagctcgccgtctacgttgggtcgacgtcgcagaagatcacgacacctgccgccattctcaatggcctagagatcatgaggatactcacgaccgccggcaacgtcgccgtcgtcgagccaacgatgccgccgggaacgaagaagaagaacaatttggccgtcgttcttggctcagtctgtggagctttcggtttcgtttccgtcgccgctgctcttgtcattgttcttaggaggaaagaggagaaggaggagctgcggacgccgacgacgagccagccgtcgacggcatggatgccgctcctcggccggatcagcttccgcagcgcgccgccgagcgccgtcgggtcacggtcgcccagcttcaccattgacaccaacgccaacactccaggaggaggcgccactcccggcatggccgcggcggcctcgtcttccccgagctaccgcttcccgttcgccgcgctgcaggacgcgacgggcaacttcgacgagggcctcgtcatcggcgagggcgggttcgggaaggtgtacgccgccgtgctccaggacggcaccaaggtcgccgtgaagcgcgcgaacccggagtcgcggcagggcgcgcgggagttccgcacggagatcgagatgctctccggcctgcgccaccgtcacctcgtctccctcatcggctactgcgacgagcaggatgagatgatcctgctctacgagtacatggagcacggctcgctgcggagccgcctgtacggcggcggcgcggcgacggcgacggcgacggcgctcagctgggcgcagcggctggaggcatgcgccggcgcggcgagggggctcctctacctgcacacggccaccgccaagccggtgattcaccgcgacgtcaagtcgtcgaacatcttgctcgacgacggcctcacggcgaaggtcgccgacttcggcctctccaaggccgggccggacatggacgagacgcacgtcagcacggcggtgaaggggagcttcggctacgtggacccggagtacgtgaggacgaggaagctcaccgccaagtccgacgtctactcgttcggcgtcgtgctcctcgaggcgctgtgcgcgcgccccgtcgtcgacccgaggttgcccaagccgatggtgaacctcgtcgagtgggggttgcactggcagcggagggacgagctggagaagatcgtcgaccggcggatcgccgggacggtgaggcccgccgcgctgaggaagtacggcgagacggtggccaggtgcctcgccgaccgcggcgccgaccggccggcgatggaggacgtcgtgtggagcctgcagttcgtggcgcggctgcaggaggtggacggcctcgacgcctccgacgtgagcagcctcaacatggttcatcagctgatgccgccgacgagcttgcacgctcgtcagagaagcgccggcgaaagcgagaccggcaggacggacgccgacgaggacagcagtgtggtagatgatgattacaccgatgcttccatgagaggaatcttctggcaaatggtcaatgtgcgcgggagatgatactgatcagtcatcttcaaacattccagatcatgaattagtcatcttcagactggtcagttcattgttgaacattccaggtcaaaattcacctctccagtatccagtcggaaaaagtgaacaaagacatacttagaatttaaaatatacttaccagtgaaaattttgtactgtccctacaatggagttcaaacatatgcttgaatgaaagacatgcgagtctcataatttatgtttgagcagaaatactacacagttcaaacttttgcctaccttctggaagcaggtactggatggggccggacagcaagactgcaaggcctaattagcatccatacaaaaatattagcaagagcaagcaatagccgatatgttccagaaaccgcggtgggccgcaaattccattttatgcagttcggagtacaaccaacagatggcatggtctatcaacttatgaaaggcgtcaataacaaataggatacagatccactcaaatcccaacaggttcatagatatgactaaaatctccaacaggtttaaattgattcataaactttaagactgatacatcccctaacatctcatttaaggggatgtgcttcctctcattcaaggggatgcgcttcctctaggcgaggcccgatgattgccattgtcttcataatccctggggcttgggctccggccattggcagctgtactcatgtcacggcgctcatggtcagcagggctacggctgtcagctctcattgggctcctgctgtcccttggtgcaggactcctgctggcattaggggtagggctgcggttcctcccgttgggtggtgaagcacttctcctagggctgcggctatcacgagggcttcccctagggctctgggtgtcgcgagggctccccttagggctgcgactgtcacgggggctccccctagggctgcgactgtcacgggggcttcccctagggctccgactgtcacgagggctccttgatctcctttcattacggctatccctccttggagactgggagcggctgtcaaaacaaaatggagaagccatcagtgtttgatacaaattaagcagaacatgaggattagggggagaaattaagcaactgatgaactcagttttataagagtgatctggagactttctggttaacatccaatagattagttttttgcaagtataaatcaattaaccagtcctagcaaaatcaacatgaatcaacatacattcagaactcaataggaagatcatgactgctaaaattaataatgatcacatataagataagtaagagattcccatgttgaaatcaaggaaatgatatcctcctttccatacctgtagctcctgctacggctcctgctgtagctcctaccacggctcctcccacgacgaggggatggggatcttgagtagcttcttccacgcctattatcatcaagatacaatacatttaaaaccttatattcaacaattatgcttataaaaaggaaatctcacaggaactacttgagattcttagggctgttccggcagtccctttctatatggcccctgtctccacaccgatagcatctgtttttccagtctccagctttgcagtcacgggcccagtgcccatcaatcccacagttaaagcagcggccagaaccaggtggtggtcctctgcccatatattcacgtgatcctccagggccacgtggaacctaaaattggcatgaatagcatatttagattgagtaaaattataaagtaggatcatcaaagcatataaacaagatagagacataaaatacatacaatattctgggaataataaaaataaatatgattacccctttagcaaactcaacaatcatgcggcttccatcaaagtcccgaccatccaggttgtaccttgcctcatcagcatcccgagcatcactaaattcctattatccagcaaacaagaggtggcctcgtgtaaacattgtaaatgaagtgtactgataactgattaaataaatattatcggaaacataaggcaagtgttttacttacaacaaatgcaaactcgtgcttcatatccacatatcgcactctgcggaaattgtatcgacaaagagtaacaccatcaagatgcaagtagataaatgtttcaccagtcagaaggaactaaacgccagtcaatgtttgcaatttccattaaaacatcaagataatttatcaaaagaattgccaaagtctgctagaaactttagagggacagccaccaattccacgaagggcaccctcccaccatggacaccgaggttgggaaagcccccaaaaccttcaacaagatcatccgagttaaaacatgaaggtctcgtggatatgtgatggtaagaaaaatatcagagaaagaatgctctgaacagaacagcatgctgctggcctagacctcttgctttgaaaggcatagcatcaagaaaccgtcgggatgactacacaaaaagaatgaagagttgcctctaattatctgtggccaatattattcttaacacagggtgcaagtaaaaacgcgtcgatatgaatactctatagactagactgaacttgtcacttagaacctaaaaaggtctgtcatcggttctataggtaataactttgtattaacttatcacatgcccaaatcaacaaatgaggttagagtgagatactttcaccgaaccaatctagaatctacaaagcaagttacgcttgtcggtagtatcttttgactcaaatgaacaactcagaaattctgccttgaaagactggagtacaacttagacccaatttgcaacatgcttacctcccatatctgccgaaaaggtcttcaaggtcccgggtccgggtgcgcgaggaaagacgacctacgtacagcctcgtgttgccgccgtaacggtcatcgtagcgatcacggtcatcatagcgaggcatcttgaactgtaacacaacagaatagcaaacaagagtgagctagcggatctaacgtaaggcatagggttttcagctgaatccccaaatcttgctggaaacgaattgctactagtactaaggtttaggggttaaagggcaagtaagaaaagcttccggatctacaagagaagctagggttaaggcgaagagaaaagctgtgggtagagaggaacgagaaagaggataagcgtacgtgtgctcaccggcgagggtccgacgggagaagcagcacaccggcgacggcgccgctgctcgcgggtggagatcgcctctgctcggcggcggcggcggcggcggcggccgaggagacgaggagtcgagaccgaagcgacggggagatcgactagggtaaagataggggagcaaggagaccgaggtcaattaattacgctgggctgttggctatatatgggctttctatgggccgagatttctaatcacagtagtactcgttccggactagtcatattgatttggaggcccatctaagacgaaaggcccattagcaattactctgctactgttgaatttttttcgtttttagatttttttttaatatttacagaaataatctatcgaccaaaaaaattgcagaaatagcccctgccgcccaattggtgggcggcaagctgacgtggcagacggtgggtcgaccgcgctgtctgccgccgtcggccaaaattgcgattaggcccgagggcgacaaggggctaattgcaattttggccgcccattca

SEQ ID NO: 9615 - DNA, 1039 bp, Oryza sativa
agatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatattgtgagaaaataaggaatcatgtaatcaaaatatttttaccatgaaatcgtcgtcaagaatatttggacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattggcgttcataagccgcttttctctataagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaa

SEQ ID NO: 9616 - DNA, 5194 bp, Oryza sativa
taaaatgtatgtaaattgattgtggaagtaatgttgtttttttaagtacctgtggggggcacaacagaaggcctagccgaggaaggcggggtgctgaacggtgcacgaaaccctgaagcaatcggcaagtgaaacggctcacttatatgtgcgaggcatgtacagaagtagtaataaaaatacttacctccgtgtggagggggagtcggcctaggaatgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacggttaccggaattcccgcgtctaaacgttggatcgtcgttgaaccgtcaacgacgacccggttgatgtcgtcgacctgcatggttaatttgttcataaatattcgtaaaatttgacgataagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtgactctccctcgtggtccacgacctcctcggttgcgagcaaccagtcctcaacaaaagtcgccaacttggtgggctagtagccagctgaatgctgacccttgcgcgagtacctgcgaattaatgtgtaatattagtgtgaaacgacagatgttacaaattattgtaaacaggcagattttaatgcaacaacggaaagcgtagtgcaagatcttaccggtgaacagcagcttggacggtggtcggaaacggtactggaaagggctgacggaagccgaactgccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaacaccataacaaactcaggatacgaccgcctaacctggacgtgagcccatcggcgctgcaatacgagacgattgatgtgatgtacaatgaacttagcaattaacttaacaatacgttaagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagctacccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtacgagtactcgtcggcgtccgcctgtagctgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtcccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctacgagcgacctgtccacggtccatcgtctggccgggtccgcgtcgccggccgcagcctccaccagccgacacatcggtaggaggccggcctcacgtagcctgcaataacaaattaatatgtcattataaaaaatattgcagtgcaactaacttatagtaaaacactgttcgtacctctcgacaaaggagtcgtgaaccgtgagtagctcaccgcacgtccgtgcccggaacgtcccaagctgagccccatgcaccacagtaaggtgagaccggtgtcggtgatctatcgccgggtccaacaactgaggtgtatcctgacgtgccatctctgaaaaatatagtgtttcgtgttagaacaattcaaaaaatagtaatgtaaaacaaaagataacttgcaaaattatgaaatagtaataaaatcatacgcgttaattatgtacaacaagagtacaggctatttaaatatagcaaacgttactaatggtacataacgatgacgtgcaatttaacatatatgtagagttcaataatataacataacattacgtgtcgaagtccgacatacatcagcatacataaagacgtttggcgccttagtccgacgttacatcacgagacctaaagacatgacatgccgaagtctgacattacacgacgaaacataaacacatcgataagttcgaaacgaattacaagcaaatccacatgccgacatagaacataagaactacaccacgtagccagacgtggcacgacgacgcctaggatgtggtcgagtggaggtagtgctttcacccgtagggcgagctccatctgctgctgatcctgatagtcctgcctccgccgcacttgatttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttactgaagtactatgacacaatattgtatctggtatgccacactccacagcggcagcaatgacatgggtgcatggcctgtggagcagcttcggctttgcacaagagcaatgacatgtgccgtcgtctttgagaacacactcctgcttcactctcttgcagtagatacccctgactgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctccaatctagttcttctaaccaatgttggactatccgttgggagaggtccaagagcttgaggagggtcagcaacggcggtcgatggagccgctgcacgctgatcactgcatttggctgtcaactcatctaatctcttccaaagctcattgaattttttctcctggttctgattgcacagcctcttgaacatgttcatgagctccttgttcttgaattgcttgaagaaattagctcctatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctatcggtattctcactctcaacaaaagcaaatgccaagggcaatacctgattgtttccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcggattattgaccttggttcatatgtgagattatcgatgacatgcgcatacatcttagatgcaacaaatgcacatgtaatgttcctatggtatttctgaacaccaggtagaaaacatgtatgcttggtaacaactgacactgtccaataatccttccatttccccttatatgcgtgcactctccagggacaaccatctttttccttaacacaccgaacttcatattgcgaccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcagccactccacctggttgaatgcccactggagctactacgcccccgtcctctcgtgcgttgacctcctccacagaagtctcgtttacttcagcacttggtccctcgccatcatccatgttcgtctgcacacctggatccttcgggtgaacaaacgggctgcagga

SEQ ID NO: 9617 - DNA, 3563 bp, Oryza sativa
  unsure (1)..(3563): unsure at all n locations
agagagctccacccagctcctctcccagttttagtggaggtgaaactgtttggctaagctccagctccaggaggggtggagctggagctggagctgtgccaaacatgccctaagtgttcgattataattaactccacttgatcgtgagcttgatctgatcaagtgataattaccttcttttttttctcatggattatgcgcatgaataatgatgaacagattgagatttaaaaccgagaaccatgggaggcgggcatgacatgcacggcggcggccagaacggcggcgtgaaggggctggtctccaagctcgtcggcggcggtggccatggcggcggacacggcggcggacacgggtacgagcaaggctacggcgggcacggttaccctccccacgccggcgccgcccacggcgcgtaccctcctcagcacggcgcgtatcctccacagcacggcgcctaccccgggcacggttacgtgccgggagcctacccttcgaacgccgcgccacatggaggtaatttagctttaactgaacagtttacagtgagttttaacttagagagctttagctccaattccacgtctcataaaactgaaacccaacaaaacggttttaattttacccgaaacaagagaggagctagctagagctctcataaacttaagtattctcacaaaataaattagggatgtggagctagatcttgaatgctccgatccacaacttcattccaagaagtttaaagttaaatttaggagttataggtagtgcctaaaagacccttaaattttgcacttgatttctgtggatttaaacggggaatggtatatatatatatatatatatgcagggcacatgggatcgtaccacaccggccatggcggcggcggcgggcgtcactacggcggcaagcacaagggcggcatgttcggcggcggaaagtggaagtgaagcggctagctagctctacgtacactatacgtgcccaccagctttctgccctgctacacctacgtataatatctgcacgagtatgagtatcaaccatgtggcgtacgcgtatatatacatacctaattaagaaataaataaagtgcatgcaggcagacagatctgtgtgtatacatgagcttaatgatcagctgatgagttgtgcaaattaagcatgtggtgacgtatatatactttgtgtgtactgatatacgtacactttgcataatactacttatatactagcctctgttacgtgtgaaattcaacggttttccggttcattaagatataaggccgcgatttgggccaaattaacctaccgatgattttgctatatatttgtcgacaaattttttccccaaaatttgacagatgttgtcggtgacatgggaccgggagtatcatgacttagagacttgaggcagacacgatcacccacgtggccgggtcgggcccgagggtgatacggccgcccttctctttgtctccccgaggggtcggaccgctcccgtctcggccccgagggccgaggcgccccgaccccttgtgggttttgcgccgcgtatatggggtaggtgagcatagcggggctcacctaaccacatttattgcggtttggacgagcgcgtcacgccgcatgtaacgcagtgcagcgcgctcatttatccggtcagtgaccagtcacagaccgatcagatcgtgggttaggtgacgacaggcggtctgacgcacgcctcgccccatcccgtcaggacgagagcctccaagcactcatccctagccggagccggcgtgttagcttctggagatggcacgttggttccggtcagatatatgccaggcttcatcctaaccattacaggcaagatattgtatgaagaagggtgaacatgcagattgttgaactgacacgtggtggacaagaatgaccgatttgtgaccagtgttttggnaaccccaanccntggngnnttcatgtttcgtcagncagacagccatgttcccacgacgcgcctgcttccggcggaagtggaggtaggtatgggccgtcccatcagaaggtcattcggacggcaatcatacaaatcttcgtccatttatgaaaagataggataagtccccacacaaaaaagagagatggtgcatgtggtatccccttgagatataaaaggaggaccttgcccacttagagaaaaggaggacgatcccagaacgatcggggactggctcgcactttgtagcttcttcatacacagatctaccaaaacacaggagtagggtattacgcttctcagcggcccgaacatgtatacatcgcccgtgtcttgtgtgtttccactctcgcgaactttcctcaaaccaagagcttagaacctcacccagggcccccggccgaaccggcaaaggggggcctgcacggtctcccggtgaggagccccaagctccgtcagatgtaattacagtacaatcgtagtgtaattacactgtaacttgcatataattacactgtatatgtaactttcaaaaatctctccgtaacatgttatttcggtaaaatggaggtcatagaaacaaattctttcatatatgtgtgtgctatgatttgttttttttctcaccaaaacaaatcttgtaatagatctaatgattcaaaattatgtgaaacttacgtaagttacactatagttacatgcaagttacagtgtaattacatataagttacagtgtaattacactacgattgtactataattacatctgtcaaatttttgaggaaaaatttgtcgacagatgtataggcagtcccctaccaaatttacctgaaaaattaatccatcaaattatacacttcggcaaaaggaaaaaaaaaaaaaagaacgcagagcccagccctggtccagatctttttcacgttggcgatctgggcattcggtcgtgagggaaacgaattctgacttagatatataaacacgtacgcacgttttctcgtacacctaatctaaaccgtatacagaatatagattgtatctatggcctttttcatggaaagttggaaaccatcatggttgagcacgaggcaaaccatcgccggcgagatccatctgatcacggcggcggcggcggcggtaacgacctgatcggctacctctgtgacgacgtccttgtacatgtcctcagctccctgcccaccatcaccgtatcaccaggtacatcgtcagccgttcgatgacgcctaatggacggttgagatttaaatcctatacttttcgggtaatttatccttgagaaggtatcttgtaccatattttctaagaaattttaaagttcttgataaagcaccttaatatacctaaaatttacactaatttttttataccttaagatacttattagaacctatagataccaaatttttacaccaaaattttacactaaaataagtactactaaaatttatagtatgaaatcttcgtacctccaggtactctaaagcactataaaaaaaaaccaggtgttccatgatgaaatcgtgcgcaaattggttacttttgttgtggtctcgtgga

SEQ ID NO: 9618 - DNA, 3826 bp, Oryza sativa
gtagaaagatcattaccagataaattaggcaaggtaaattcagaaactgcgaaggaaaaaaaaaagatgaaaagttcagagaatgctacttacaataggctcaaactgaggggataacaggttgtcttcgagatttcttagcaccaacagtatctgcattaagtaactgtattacttagaaggattcatttttaatcatagaaaattatgacagtacttatctccagtcaaaaaatcgggagaaaactttgttcagaaagctagtattgctgtacttaccgtcttcacgatgatatcatccatgctcttcagtttctgaaggtgtgtttccactggacacggcgagtctggatcgaaaatgtcgccgatgaacctgtatacttgtgcaaattgcagatcatctgaaaacagtgaaaaaaaatcattcagcttacagtttttcagcagcaatgcattgttaatccctgattccctgagaataattttgatctttcaagagacgacgtagaattattaccaggtgatagtggaagctcgatcgtttcatcctgcacaatgctggctgttgccatttcacttgtggtgccagtccagtccatgctcgtattactgaaacttgctgcccccatgaatgaactttcacctgaatcatcgtaaagaaaaagttatttctcatggcattttggttgcagctccgtgactaagatcgaaaggcgatttgttgaccggcataattaccaggaaatgaaacaaatgctgctggtggttcaatcaggccgtgatggttcccccaggctgcagtgcctgaagtacttgcccattccaagttctgcatgtctgaaaaaagaattaccacaaaacactgtcaaatcactagtaattaactatcgagtgcatctttgatgatgacatcaccgatcgcaatttgaatctagatcaactgacaattgctaatggtgatttggatatgtgcacttgccattggttgcaggaggaagaactccgggacactcccaaccgatggagctctgaacagcgacgttgtgatgcggcggcaagcactgcggctgcccgtggaggatcgccgtcgccgccaccgagctgctcaccgccggcgagctctgctgctgctgctgctgcatgacgagcctccgcctcgggtactgcggcggcagcccggcggcgagccccatcttctgcaccttgaggaagtacttctgcgcgtggctgcggatctgcacacacatcgatcaatcgcacattgtttcaatcagcattgcaatcttcatcagaaaccaaatcgagtagtagcttaatttgagcacgattgtgtccagctacgtacgtacctgtatggtggtcttggtgccgacgtgctcctcgatcttcttccagtcgcggccgtacatgatgagcgcgtcgaggaacctctcgtgctcctcctcgctccatctctcccgtggcttcgtgatggtgtacggcttcctggccttcttccccggcatctcgctgctgctgctgctgttgctgttgttgttcgtgttcctatccatcaacacaactccagtccccaaatcgaatcgagcagacgcacacatggcacatatatatacctatgcaaagccaagaaagaaaccgaagatccctttgtgggtttggaggttgacgacgatcgaagatgaggaggaggaggaggagggctggagtggcctaagaattaggcgcggtttagcgcgtacagttggcgaggttgcatggagacggcaatgcgcgcgtagtagctttgggtggaggaggacatcgccgggttggtgcaagcgactactcctagctagcttagctctcgcttgctgcgacggatcgcgacgtctcgtctcggcgagggggcaaagcagcatgtgcgcgcgcgcgccccgtcgccgtgtatggcaacgcttatctgctgggcgctttccgtttccggaaagtcggcaaggcccggaccctagcttgggaacgattgctagtggtaacagattaacagattagtacggagtacaaatttttgtgcacgctaacctgggtttgttctgagtaatttttaacctcgcaatttgcaaaactacgaaaaaaaatgaatctcgagttatttgagaatcttgttcttttagtgttttttagccatatagttctcatgatatgtaccctctccatttcatattataaatcgttttatattttttcaagtttatagaaaatttaacaaaatctaaaatatcatattagttttatcaaatctaacattgaatatattttgataatatatttgttttgtgttaaaaatatcactatattcttttataaacttgattaaacttaaagaaatagtttgattagaaaaaagtcatacgatttatattataaaatggagagagtatgaattatcaaaatggatacgttggtaggggtatatctttcttatagacgtataggtaagccttacatttccacgcgtcgaattgtgtggttaggcttgaggagttaattaattgcttcgttcttgggaaaaagttgtatgccaaaataggaaattttcggtaccgcatcggaattgccaatgtaatggcacacttcactgtacggcaaggcaagtcttgatcaccccagccagcctcagcctggatggaacagcacgtgttatacgtggccaaactcggccaacgaaatagcgcatatgtttgttgtgacttgtgaaaaatccatggatgaacatgagttttaaggacacgcttctctaatgaaataacagaggaaatggagaacaaaatcaggacggccacatgttcctggtgctgtatggtgtaacctttgcgtgtgtgtgtgtgtgtgtagagagggctaaaagtatatgcatggagtcaaaataactctgattaaatatagcacacgttaattcaaaaaaaaactcgaaactattttgttttttttactttgcacgttcagaaatttttaatcaaaatgaattgcctaaaaaataaaaaatagtttttttttttactgacgttgtctattacttatggtcaggatgaatccatgcttactgcgagcccatttaagagcccaaatactcgaattggtatgaactagctaacggcccatttctggccatggttgggttccatgatttgctacccactcacttaatctctgggtgcccagaccacaaatggctcttaacggtatgcatccatgctaagttgctaaccttgcaaaaagagcccaaataactagaatattagggaaggacctaatatcaaataattaggaggggtgaggctttgaacccaggtcgtctagcccaccaccttgtggagctagccggaagacccctgggcaaaaagagcccaaataaattgattcattactttttttgtttgaaggaaaatgattatgcacattggctggctatgtacacacaattgacctgttatgaacatgaggtcttgtcacaccccaatctgataccgccgtacaacggcacctgacaggagcgtgtcgtagggaaaacggcgtgaaccgcttcctatgaaaccgcgatctcggtaccagtcccaggacatagtgctggtacccacggtgacaaatatgaatcatagcaatccttaaaatatatagaggacttatttaccttaacttaggttgcagctcggacagcccgagaatacaaccgacgacgcggacgagaaaacaccaacagcagcagcagcagcggaaccaacggtctaacacccaacaccacaggcgacggctggggaccaggacgaaaccctaatcttcacttcacttc

SEQ ID NO: 9619 - DNA, 631 bp, Oryza sativa
  unsure (1)..(631): unsure at all n locations
aacctggagaaacaagaatcaggcgtcaatcggcgacacctccgcatctctctgaccctgctccagcagacaaggtttcctccccctgcaaacctttcagccattcaagagatagcagccctgaaaatgggcattgctctgcagttgcttctcctcctctcgaacctctctcacctgacatattgcctgtgtcacaggagcaaggggcgttgctcatgcttaaaaggcacctagatcctatgctgcatgaggctatggtgggaggttcaatttattcccctgacactactctgccacgccctgcttcccctgtttttgttctttcatctgctgcagaaccacaagagaacttagtggatgaggcccagcatgatgtggagacattcctagcagaggtgaccacgcccattcagcagccactgctgtctgcgccaggaacaaagctgcgtcgaccctgccgcaataaggtgaccactcctattcaaaggcatagtgcaagattggcactgaaagtcagacgcagtacaaagcttgaattaattgcacaagaaattcttgcaaagcaatttggtgttcttgatgataannnnnnnnnnnnnnnnnnnnnnnnnnnnnnnnnnnnnnnnnnnnn

SEQ ID NO: 9620 - DNA, 1245 bp, Oryza sativa
tgtttgtagacgaagtagtctttggccacgtggttggagttgggatgatgcggacattgggagttcattatcttgtcgaatgtgttgacgcggggacgttgtcgggaagatggagaggttgttgccacaagttcttcgggcttacgcttgcgatccttgcggttgttacttccactccctcctgcggtcggcgtgtctttccttggcttccaagtggtgcccgactgtttggacgcagtaatagcatcttcggctttggcatactcgttggttttttcaaacatctgcttaaccgtcttgggaggtttgcgtccgaatttgccgactaggtcgtcgtggcgaatgcctttagtaaaggcggcgatgatgatgtcgtcggtgatatcggagatcttgttgcgttgctcggagaagcgtcggatgtaatctcgaagggattctccagacttctgaatgatgttgtagagatcaaagtgtgtaccagggcgttcaaaagtgccttggaagttggcgatgaagtggtcgcgtagttctacccatgatccgattgtgccacggggtagcccgtgaagccaggaccgggcagaatccgccaaggccacgggcaggtagttcgccatggctttgctgtctcctcctgctgcgcggattgcaagaccgtagacggtgagccaggattccgggttggtggtgccgtcatacttctcgattccagtcggcttaaagtcagctggccaattcactcgacgcagatcatttgtgaaggcagcaactccgtccatgtcgtcgtcgtagcggtccggtgaatgatgtcctcttgccgcgcggcgctggttgatggtgtcacgaagatcgatggggcgtcttcgatgtgggaagtgtggtcgttcaactcggcgctccctatgttgttcaggaggcaaacgaacagatcgttcatcatgtcccttgctcttgcgactagatccggcgccggtaatgctgaggcttggttggtgatagtcttgagatcgaagatgagggactcggctaccagtcggggtgcgggtgcttgcggagttggctggaaccgaggcagcgatcatggtcttcgtctggttcaagatgttgacaacatgatcagcttggttgagtgcgtcttccttgaggagggtgtcaaggagagtgattgctgcaaccgcgttctgctggggggtgcgaaaaaccgttgtttcatcgacgtcttgttgcccgatgaggtctctc

SEQ ID NO: 9621 - DNA, 3947 bp, Oryza sativa
ccaactctgccgtcgagactgtcccaagaggttggagtataacgccaacctctctggatctagattggatcggggccgaagccggagttcgcctagatcttcgagtgggagatgtcttggctgtaaagacagcggccaaatcatcaggaagtctcatcaggattgagggataggacccgtcgtcttgatctggtcgcggaggagtagattggatctcgtccgagtggtttgaagccgacccgagagagatgatcttggagtaggcctcggccgagttcggaataccgaacggcgcggggacatggtctctccccgactggttcgaatccgagtcaaggagagagatcttgctgaggttgttggtgatgaagttgaggctatcgaaccggaacgcctgcccgggagggaaggcgaagtcgtcgatgccggagacggaacccatcgtacttagtcagcaaaaacttgatgctgcccctacctggcgcgccaactgtcgaaacaagatttcggcaataataaaaagggggtggctatcaagctaggaaagtggatgggtttgaagacaaggaattttatacaggttcaggccttcttattcaaaaagtaataccctactcctgtccggggatgattccgccgagtatgttattgattgtataaactggaaaaaagatcacgcccccgcacacagacccctccttatataggggaagaggtccgctttacaaaatatagtccatatcctaacggaatatgggattatagatgaaatacaatcgtaaccgactaagatcccgagtatttccttgacatacaagtttagaatctaacccgagtcctcatagagatattctatctatatttggtaccgtatatccgactaaattataatgtcatgtagatatgaggtatccataatctccacactcgtgttattgaatttgcatgtgccatggttgaacccgaaattttcaataaaattaattttactgcttcaaatttatgcctttttggaggtcatatacaaagaggacacagctgacagctggcttgttcaccagttattttcttgtttggacgagaatggtttaaacatttcaatcaaatttattttgaatgctattttctatgtcaatccttttcatgtgacttcatcagcttagaaaaatcatgcctagcgatacaataatggatgctttggatggattggaaaagtacttccttataattgggagtttgtacccataatttgtggacggagtaagtatgcaagtactatcaacatgtaattccatcggtcgtacagtaagtatttgatggtcttatttgtctgtgtctaggataagagttggttaaacatttcaaactttcaccatccattttgtattataaaatctaaaagtttataatattacttctagaggaaaatctactcatacaatctttttttttctttttaaatgcacaagtttgtcataatatgatattacttttgaaggcaaatctacacatacgaaaactatttatggtcaaagtttaagagataatccaagaataccattgacaagcgtcaaatccaaaaaatatcatcgtacaaacgattttgtcccaaaaatgtaatcgttgttagggttccgttcatcctatagcactaagcaatgcagaatggacggaaccctaacggcgataatatttttaagaaaagtcatttgtacgttgacatttcttaaaactcacacttatcaatgatatttattggatttgaatgtttgtcaatggcattttttagattatctcaagttttaaaggtttaactaaatcttacgctaaacgtcaaaatatttacgaatcttgtcaattcttctactaggcgaatataaatggtcatgagtacagacacggaatgaacagaaaccccggaaggccagaacaaagaatttgtaacccagaatttatccaaacaaacatgactatgtaaaacgagatggtattaacgtataattgattgagttttaatcattacaaatttaaaaaatagattaatatgatattttagagcaacttttatatagagagttttagcacgaaacgtaaagtagtttgaaaagcgtgcacggaaatcttaatcttgatctaactcttattggagaaaagaacggacctacgctcccagttgttaattggcatttgtcaatcgatctgaaccacgacagctaacaataacaaatatgaatttggaagtcatatatagagacattttcaaactagtaggccaactgttttctaggctacttttactaaattgataaaaaaagcaatgcaaagtgacgctttacactaaagacctactgaattctactttcagaattatagcaagctgtggtaattttcaggtgtcgttcctggtaaaactgcattataacaaaccagaggcttccctcttgcagctaacttttctcttcgggagaaacacatcagtcagcacagtcttagacttcagggaagcaaggagtatctccagtacctacatttgaacacaaaaatcatcaacagtgccaattaaaaaaaaacaaaaacgactgatttttttttctctttactcaaagtgagagatatgtacacagtagtacagtacagacctcttccttgccaatcttcacggtccgttcctgcagcgcgctcaagtccttgacaccacactgtgcaagtaagctgacgcttgacacactggacgctggagtcattgagagatcatccctgacagtgtatgtggctgtcccaaccacaaatccaacggttttgacatgtggaattgccctgtgcatttgagtggagcagacagggcatacagcgcctttgctaacagaaaaatatccacaaggaactttagtggtactgtagcttacgacggtcgatttcccttcacatgtgaagaagctggcattgacatttaactttgcatccagcagcagctgctgcaatggacagagcacggtgggggcaaccgtcgggctgaggaagcgttccttgctttggcttgagattacatacttggaatccagcttctccacgctgtcaagcacattgcccatgctaccaaccatacgctccttggtaagcatgttgatgatggtgctcattgggaggcaaaggaggcaggagataaactcaatgacatcactaccagcctcggcaaagcagactttctgagccttggtatcaatcaagagcttcatcgataatctgatggctgccatgattttcccccttctatcaaaattctataaatttcttgggagttgattggttgcttctacaatcaacaacaaaagaaaattatatgggttttcagttaactagcgttagagtccaaatgatcagaacgcgcagcacactgacacatagtggaaagctatgcaaacaattttccagagaaatttagagcagagtagcagacaaagcaaaaacacgttccagattgtaatccaatgaagcgtctagattggttggcagctgctcaaaagtaagcaaaaatggcatcctagtatacaggatacaacttctcctgtggacttgtggggtaaccgggtaaggtaacaatccgtgcagatgacacatttccaaataagaaatggcagagcagtatgttcatattttccacatagtgacacgggaaaatagattcagtgcaagtaatctgctttccttactatctcatttggcaatgccaacaaaaaaaaaataaataaacacgaccttataaatgttcttacaggcaaactcattggttgcagaagcagtgaagcacttgagacaaatattagcataacatatcaagtgtaaactagtactatgtactgcactaatgttcaggatcaggtttatcagttacgttttttctgtaagtcaaatcgaatgttcctaaaaaaaatcgatctaggaaaacc

SEQ ID NO: 9622 - DNA, 2065 bp, Oryza sativa
cacgttgacaggctgtgttcggccgtggctgttcccatcctctgctacacgatttcctcgcgcacgcttttcaaactactaaacggttcgttttttacaaaaagtttctatacgaaaattgcttaaaaagatcatattaatctatttttaagaaaaaaaattagctaatacttaattaatcatgcgctaaacattgctccgttttgcgtgctagagagtagcgttggtaaccctcactccccaacgcagccacggtcggtaaacgaagcgaaccgacgtgcacgatgtcagtcggaagttgaataaggttattaaaaaagttgattgaattaaatgaaaaaagattgtgatcgctttcgtcgagaggaaagattgttattgatcgggacaaaaatgtatgcgatagatattgttatattttaaaataaatttcatacaccgaaagttgttatattttgagacggaaatattaactcatgatgacgacgggggctaagcctctactattggcgtgagaaccatgagagggctaagcctccactatcggcatgagaatcatgagaggccctacgaggtcttactaaaattttttgttctatctagataggaagtgtttactttgttcagacctcctgttatttctttttaaatccgtcattgtgaaaatctcgctgcatctcaaccttcatccttggtggtgtccaccatcgaatgcaatcaatcctttaaaaaaataaagtcatacctgttacatttacctctagaaggcaagcagaaacatatttatagcgagacgcaaattgacagtaagatttcactggctgggttgtaacatttctattaaaaaaaaactattccaagtgtatttaagactaatctaaaaatgagcaatacaaagtgatgctttccctttaagacaaatggaaacctactccatgctcacaatgaaggtctgtaacttgtacggaactttccaatttctcagatgcgatgcctggtaaaactgctcatgtatcatacatgtatcatactaactaagtagcagcctccctcttgcaactaacttttttcttcaggagaaatacatcagtcagcacggtcttagtcctcagggatgcaaggagtatctccagtgcctacattgtaacacagaaaatcatcaaccacaccaattaagaaaaacgactacgactgttctcttcactcaaagtgattctgatagatatgtacaaacctcttccttgccaatcttcacggtcctttcctgcagcgtgctcaagtccttgacaccgcattgtgcaagcaagctgatggttgacacgctggatgctggaacaattgagagatcatccttgacagtgtacctggctgtcccaaccacaaacccagtggctttgacatgtgccattgccttctccattgcgtagccgcacttagggcaaatgctgcctttcataaccgtaaaatatccacaagcaacacgaatgccgtggtaatggttcaatttcccttcacatgtgaagaagctggtatcggtgtctagctgtgcatctatcagctgctgcaaaggacagagcgctccaggggcaaccattggcttaaggtaaggctccttgctttcgtttgagattacatgatcggcgtccagcttctccacgctgtcaaacacatttgcaatgcttccaaccatatgttccttggtaagcaggttgatgatattgcttacagggagacaaaggaggctggagaggaactcgacgaagtcactgccagcttcggcaaagcagactttgtgagctttggtatcaatcacgagcttgatcgacaattcagcggcagccatgatcctttttattcgaagttctttaaatttcttgggagttgattgattgcttctgcaatcaccagcaaaagaaaattaaatgggttttcaattaactacagttatcgtccaaatgttcagagaaagcgttataatttaaagcagataaagcaaaaacatgttccagattgtattccattgaaagtttgaaacatctagattatattggttcagggctgcagg

SEQ ID NO: 9623 - DNA, 1601 bp, Oryza sativa
ttcgtctaaatgggatgccatgcaatccttttacacgttcgcgaaagaaaaatgaattcagtgcagtagtctgcttttctgaacatgtcatttggaaaagcaggaaaaacggataaaccacaatcttataaatgttcttacaggcaaactcataggttgcaggcttgcagcgttgcataagcaggtaaggacatacaaagattagtggaacatagtgttagacacaaactaaaaataccaaagatcaggcttatattactttttatttcttccattcaaattgggtagtcctttatattttgggctagaattcacagttggatcatgctaggaaactccattatactagaatattcaactacaaataatcatttcgtttgcattgctagatctccggtctgctatcaatacgggacatccgtagttgtttgaataaactgtggaaaatcacacgccatatcgtcttcgagaaacaaatcacacgcgatactcaaaaagttatgaaaatcaatgaggcatccatagttgtgtgaataaattgtggacaatcacgcaccatactccaatagtctccaatatggaaaatgtgaaaaaaaaatctgtatttactcatacaacctccctcccccaaaacccacatactcaaaaccctccgtccccaaaacctccaagcgcttgcaaggctgacgataaaaatatatatattaggagaaaaaccaaccgaaaataaggtggagaaacaaccaccacgaggatccctaaactagacgaaataatcaggtagggcagattcatcgcgcgtaaggaaaacaaaaatagagagcaatctgtaaggtgagaggagaatgtacagcacggaggacggtgaggaactcgctcacacaatggattgcccttgatgcccgccgcaggcctgcccgccgcagccgccggcctgcgacgacggcgaggaggaggagggaatcgacggcgaggacgatgagcacgagcagtaggtttgcttcctttatagcctgtagtaaatcggaccactcctctcggcccatttacataacggcccaccacgaatgcccacgttatcggagggaaaaagtctattttgactcttcctcattgaattgtctttctaaaccacacaaccggaaataacatctccggcatcttcaaagccaataacatctcccgcaccttaaaaaccaatgcaaataaacgcttttgatggtttgaaaaaaatatttctattgacgtactatcttcttcgataataaaaatcgctttgactttttcttcgacgtttaatcatttgttttatttgaaaaattagtataaatataaaaatagataattcaattaaagcacttttaataataaagtaagtcacaaacaaaataaataatagagtgaataacgaatgatcaaacattttcgttacaaacagaaacttaaagcgagtaatatgagatggaggaggggtccattttgcgtgccggggaggagacccctcctcccgaacacagccatagtaccaactagaggatgccccgcgtgttgctgcgagacttggttaacatcaaattgttagatatgaggtacaatctcaa

SEQ ID NO: 9624 - DNA, 3605 bp, Oryza sativa
aaggccgcgctgctcgcgcccacggccgccctccggttgggctcgccggcggacgccgacaacggcggcggcgccctttaccggtgcagcggctgcgcctgctcgagaagctgctacaacttcgtgaccaaggtgaacggcacgccgtgtccggtgtgcaagaggaagatggcgaccgaggtgagtcttgttgagccggacgatgtctccggcgccggcgccaaggtcgtgacgtcgccggcggcgccgtctggcgaggcaagctctagcaaggctggttacgcgccgggcaaggtgacgtacacggtgatggatgacctcaccgtcgcgccgtcgtccaccgtctccgccgtcgccgccctcgtggcgcttggcgtgacggacatcaggggactgcaggagaagaccgtcgaggtcggctacgacgaggtgacttgattagatatccacacttgaaattattttctcatgtacagtttggcttaatttgttttaaaccttgagctttcgattaacaatattgaatgtgtttttatacgtatagggtttggctgtgctgaaggcttcgttgcagtcaaagacagtgctcactgatgtcttcctcggtgcgaggcggactgctcaccgacgtcatcctatgctggtttgaggccaagatgatcagattacagagcaaacaagtagccaacgttgtagtaccttgttgtccatgaaggcatgaagtcattttggccatatggtcacgctaattttgtggagcacctgtattcgtcttaaaaaaaatgtagtttaccccttttcctagtataatcatcatctaacaaagtactaatcaaaattattttttattggtttcaagccatgcaacagtgaattattttttgttggactgaatcaacggagcattgttttgttgtccttgttcttggtgtggatcattaaattaggatggagccatagtgggagggatttcagcatgaagtttctgtttaaagtaggaattttggtgcatggattaacaaatgtgttaaaatttgtgacatgcacatactatttcgaggggatatcccctcatgtcgtgtatgttatctaatgtcacaccctgaaaatcattaatatataaattgttgtttaattggaattattagaatttatttttaaaagcctagaagagaagatctaattttttttaattaataaattccaatataaaatggggccagataaaatttcattaaatactttgcttaattctataattcctagatttttctgggatttatttgagctaaggaagtatttttaataaatggaattgcatttcatgaataatttaaattgaaaaaggtttttaaaagtctcttttggctttgggccgaaagtcggcccaaaaccgttctctctctcctcggcccagtccggcccagtccgcagccgcgccctcgctgtcgctgacaggtgggtcccgcctgtcaggtcgtcgtcttcgtcgcgccgcagccgtccgaaaccctagcgccgcgccgccgtcgtttccttccaaatccggccgcttctttccttctccggccgaattgatagaggggaaatgatcctcgggatctcctccgccttttctcctttggaaacatcggctaaatcggtttggaaatcgttggattcgagatcgaatcggtttcgtctctctcctccgaaccctaaaccttccttcacgttgccgccgtcgacccgaagaccgccgccgcttcaacctcgccgccggtgccgtccgttcctcttccgccgtcgctttggtcgccggtgagttcgccgtgccgtccgctacccgttggtgccctccgtttgtgccctagcgccgccgttcgccggtgagcttgcgccgtccgagctgtcgagccgccgagccgccgccgccggtggtgacgtcattgccgacgtcatcgtccccgtctcccgtgagccggtcgtggaccgatcgatctcggccgtccgttttggatggatcgatctcggccgtccgttcgcgtgaaccgccgccgtgcgcccggtcaaccgcaaaccctagccgctgacgcaataaatctatttttccttttcaaaaataattcattattgcgtcataattcaattaaaatcaatataagtgttttaatccgattaaatcttcaaaaattcataactaattcatcttagctcggatttagttggttcaagtctctaaatttttctaaaattgagatctacatgataaaaatatccacatgtactgttcatgcttgtttatgtgctgttttggtgattttgcttctttctgtttagattccgtcgtttccggagagtccgttttcgcaggagaagagtttgaagagttccaaggccagcaaggcaagtcacacagatcctaaacacaaccctttgagcatgttgaatctgtttaaagctattgatttatttcaacttatgcattgttttcgaatgtcattgggtggtgagcctttcccatttaattatggccgaagatgactttattttcctatgggttataatttgactagcatggaccttatatattggattggttcagctagatgttatttatagttgcttagccatgcttagaaacattagcacacttttgggataacttatgactcactattatttaatgatggcataatgatagttcacgatggtcaatcgtgattaggttaattaattacttaccaactaaaacttgataatggtgggttgtgagcacatggttttgagagtcgtgctcatgacaattaaggaccggttcacgagtttcggttgtgaaacattaaccatgccaaccacaagccagcgtgggcaacggctttatcttttgtatagcatggttcattgcggagcaccagactgagaagtggcggagataagcccacgggggtcgctggggagtccatgtcttgtttataagggggtgattatgatccaggaaaggtgtgccgtaatggattgtgttgtgcaaggggtattgtcacaactcctttccgaggtactgtggtggtattgaggcacatggtgacatgatgtggggttgtgtcttgtgggtatagtggtacacctctgatcagagtaaaactattcgaatagccgtgcccgcggttatgggcgggtctaacaatgtctttcgtgattagtctcacccttctcatcataataaaaggtgctctaactggtaataatttgattagcttctggtttggaatggtatattcctggtttggagatagaactgtgcagccgggatggttgttcagaatggttgagcctatacaacagggtatgttatatagcgttggattaatattgacggagctcgtggctcctcaccgggagaccgcgcaggcccccctttgccagttcggccgggggcttagggtgagatctcaagctctcgctgtgtgtggaaagatcgcgtgccaggaagaaacacgagacacggcgatgtatacaggttcgggccgctgggaagcgtaataccctactcctgtgtttttgtggattggtgtatgaatagctaccaagtgtcagccaacttctcccccgttctaagctctaaa

SEQ ID NO: 9625 - DNA, 6950 bp, Oryza sativa
ttcctgcagccctgtcatcggcaaaggtgccgatttccaccttctggccctcatctgaccaagccaccactgatcttgccgtgaagagttgcttcaatctttcatctcgcttgtcaccgccaccatgcagctaccaaaatctggtcgagagaccagaccactggggactgaagccatggaggtcggggcagtggaggtggtgaggggggggggggggggtaaatctaaccagggctaacgtgccatctctaaaagataacacgctagctgcggcttgagacgatttgcctacaggctttcgacttgacgggatggggcaaggcgcgcgtaagaccgacagtctccacctaacccttgatctgaccggtctgtgactggtcacataccggataaaagagcgtgctgtactgcgttacatgcaacgtgacacgcttgaccagactgtaataaatgctgttaggtgagcacagctgtgctcacttatcccatacatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgtgggcgattgcgtctgcctcaagcctctggtcatgatactcctggtcccatatcaccgacaccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgcctcaaccgcatatccacttcatgcgccgtaagcgggcgaatgggattagtggaagcgtggggacgggaaacgagggagcgagatagcgagatacgaaggagcgaggtagtgggcgcgagaaacgaggagccaggcccagcgatggcaagggtataaaagcatcgagaaaaggatttgcttccttcctttcgccattgctcctcttgccttcgccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgcctgagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggtcggcggctgctacttccagccgcgggggccggtgttgaaccgctacatcccctgcgtcctccgcaagaagtgggacgactggaagagcgactggttctacacccccctcgccaacgaaacgcgcctccgacttccaagccagcccccggcgcaggtctccagctggcgggcgccggtagatctgggggaggactacgacgccgtcctcgaccgcctggcgggcctgcgatcccaggggctcaccggggccatggtgtacggcgattacctccgccgccggattgcgccgctccaacggcgcgcccggagcgcctgggagtacactgggcctgaagactacatgcggacccatcagggagccagatgggattgggctcccgaggacttcaagatcgtggttcaaagggtgctgaatcttagctccgcggaggcgtctcgcattcctcaggagatcctccccctctacagcgatcccgaccgcgcctccattctaaccattatgatgggggtcggggcctcagaggagagagcccctaagggccacgacggcgcgggcgagcgccgccggggggaacaatctgccccaggagggggtcgtgcttctgggccccgcgtcgggggctcggggagcagccgccctgccgacgcccaggggaagaggaagctgggaggaacacctcccacatctcctccccgagggggcggggcggcgcgtgccagcagtcggcgcccggagggggccgcgccgacgtcgcagcccgagggggagcgcaagaagaagcggctccgcaagatgggggagacggaaccatcccggggaaacctgatttcccctccaaagtggtcatttaaccgaccccctcgcaggttcgccccattcttattgcgaccgtctttcttctatcccattaagcaagttttctcttacccatcttgtttgtcttctggttttttattctgcttcagcgatgccccgtcacattcctcccgccaccccaagtccggccagtccgaggccgaagatccggcggccgcagaggagcggaggcgagaagctgaccggcgtgaagccgcagatcgccttcgggaagctgaagaggccgcccgggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgaggccgctggcgcatcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcaaacaccgcagtgctggatgggttcaacgcccaagtggaggccctgcgtgcggaacgagcggagctcgaggccgcatgggcgcgcgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgcccttatcgccaccaccgcgatgatcgaggcgcaagacaccctccgccttcaacacgcaatctgggaggcggagctgaagaaaaagctcgacgccgcccaaggggtccttgactccgccgctgcccgagagcggcgggtaacggagactgaagcgacgtctcggcggcgcgaggaggcccttgagtcccgtgccatggcgctggaagaacacgccggcaccgtggtgaggggcttgatggaccgcgaggccgccgctgctctccgggaggcgacgctggcggcgcacgaggccgcctgcgccgaggaggagtgcgcgctccgcctccgcgaggacgcactcgctgagcgggagcgggctctcgaggaggctgaggccacgaccaaacggctggcggacagcctgtcccttcgcgaggcggcgcaggaggagcaggcgcgccgcaatcttgaatgcgtccgcgccgagagagccgcactggaacagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcgggcctctggagaggccagacgtcggtgccccccaccaatctggaaggcctcgctccgcacctcaacaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggtttcgagggctcggcccctcggctcgcgttcgcccctagctccgacgaggagggcgatgccagtggtgaggacgacggtggcgacgaggccggcgacccgggcgcgtcggaatgagcccccgagcccccgtcaatctttgattttttctttttctttcttctaaggccttcatgcctcttttgtatagatcaacttaatcttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttctggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtctccctatttgccatccagaagaccaccgatccgtgtggtcttggatgggccgtcgcccaaggcaacctccttgaccgggacctcgtcgcatgtggcaatccgctgcctcggggcggtgggggcggaggtgccaagcctctcgtcaccaccctcgggcttggtcgcagcagcgaggtggtccgcgcgctgctccatgcaagcgagcgcgactttaaggtcgccacggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataattggctgggacggtcggagcaccatccccagggccttgatagcatcaaaggccgcgggggaaaggatgttgagagccgctcctccatctatgaggacacgccccaacttcacattgcagatagtgggggaaaccaccatcgcaatctgccctccccgggcaacgcacggtgggtggtcggtctgatcaaaggtgagggccacctccgaccaccgcgcccgacgcgtcgcctcatgagtaggggccgcggccagaagctctcgcttcatagccttgaagctccggcgagaaacgtgagcacacgctcccccgtcgacagtggcgatggtggccccaggttcttggaaacctaggtcatcatcaccgtcatcggggtcaacggcgggggccttctgtctggcctcacttcgccgtttaccggagggaactgccgcggacttgtcctcacggcgttcctgcctcctgtcctcctcccacttcctcgttcgctcagccaagtttttgactgcgcgacagtccgcgagatcgtggagggaggtgttgtggacggagcaccacctgccggcggggcgctccctgctgggagtaccagcctctttctttttgtcgcacgcaggcctcccctttcgagtggcccgcggagcgccctcgacggcgaggacgtgaccctcgtcgccggaatggaccgaccttttcttcctcctcctgtcacgccgccctgtctgagcggcggatccgggggcggccgaagctgccacaccggaaccggaggggttccaggtccaggcctcctccttacgagccactcggtccgcgagctgaaaaagctctgcggtagtctggggctctttggaggcgatcttttcgagcatgcggttgtgccgcacaccccccctgaacgcgtagatcaccgcgtgtgcagggatacaaggtatagtattgcggacttggcagaaacgctgaatgtacgagcgaagggattcatcatccccccgctgtactgcgtgcaagtccgcttcttcacctgggcgtggataagtgccttgaaagttcatggtgaactgctggcacagatcctcccaggagtggaccgacgcgggtggcaggttcattagccaaccccgtgcctgtcccttcagggccatgggaaagaaattcgccatgaccctgtcgtctcccccagcggcctcgatcccggtcgtatagacctggagaaactcggtggggttgacgctcccatcatacttctcggtgatggtgggccggaaccttgggggccaacggacattccgaagactcgccacaaaggctctacagccgacaccaccagccgggggcacggagggctggtcctcacgtccatgtcgaggtgacactctggacgaggaggcgccctccgttgcacggggagtacgccggctattacgccggcgctcgatgttgaggcgggcatccggctcctcatgctgatcctcccgagtcgaaggtgtcgacgagggagtggcagccgaatgacgtgcagccgccgccgctcgccgcgccctccgccttgatgacacggaaccggtggtggcggcgccggaagtcttggtggtggcggaccgtccaccagcacccaggcgctgctgggccgtcacgaccaagttggccacgtcgtccag

SEQ ID NO: 9626 - DNA, 4768 bp, Oryza sativa
taggcagaacaagggaaacttggcgcacacggaagagtatgagagctcagaaaacacacactgagccccctacctggcgcgccagatgacggagctcgtggctcctcaccgggagaccgcgcaggcccccctttgccagttcggccgggggcttagggtgagatctcaagctctcgctgtgtgtggaaagatcgcgtgccaggaagaaacacgagacacggcgatgtatacaggttcgggccgctgggaagcgtaataccctactcctgtgtttttgtggattggtgtatgaatgagctaccaagtgtcagccaacttctcccccgttctaagctctaaatctggaaaagaatcaaccaacccccttctctatgggcaaggtcctccttttatacttcaaggggataccacatgcaccctcctccttccaaactggacttttcttctctttatggacggagattggtatggttgctgttcgaatgacacttcgatgggacagcccacacctacctccactcccggcggagacgggcacaacgtgggatcgtggctgcccgttgctgacgcgaccagtgtcagactggtcacttttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgcgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatacatgtggcgcagacttctttaaggggtcggggtgcctcggccctcggggccggggcaagcgtaacccgaccccccctcgggggaaatcaggaggagggcggacacctcaccctcgggcccgacgtccccgaaggtgccaggccacgtgggcgattgcgtctgcctcaagcctctggtcatgatactcctggtcccatatcaccgacaaatattgtttaatacttaactgttttattaaattctcaaatgtttgctaaatgctgcttttgcaaatgaaaccctactatgccatcctttgttatcatgtgcacttacatatttgctgcgtggcttgctgagtatgtcatatactcaccttgcaatcattcattagaggaagagttctacaatgatgctgatggtgtggaggattaggtgtagccttggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacaagggttcacacacatgtaagcgtttggaattttggatagaaattccgggcgtgacacctaaatagtcattaaagtttttattaggaaaagtgatttcataattcggggagtggatttttatccctcgagaggatatcatctcgttatttgcatgtcacttaaataaatttgaaaaaaaaaagaagacgtattaacatgtgatatatcacttcataaacatgcaagtttaaattcaacttctacatctcgcaaaaaaaaaacaaattattggttcttttcaaattaacctcctctacgcaccggtagtcgcattcatgatgcttcggttgcctcgcataaatgggtgattcattcaagtgctgatactacgtgcggcggagctgaaccgatcggtattaatttgaccgtctacatgcgcgcatatattgggactgcaatttttgcatgcaaaaaagcttgatcgatcaagaaaatttacagtgggcggctaattactctcctctcgtccgtaatccttcctgctcgtctctgctcgctataaattctactgctcacacagcaagccaatccaagctagccacaagcacttgctagttgctacgatggcgacggagacaaccagctcgaaggcgctgagcatgaagctgctggtggacagcaaggcgcagcgcgtgctgtacgcggaggccggcaaggacgtcgtcgacttcctcttctccctcctcaccctccccgtcggcaccgtcgtcaaggttctctccaaggactccatggtcggctccatcggcgagctgtacgccagcgtcgaggacctcgacgccacctacgtccgctccgccgacgccaggaacgtgctgctcgcgccggccggtggcttcgacaccggcaagctcctccagctgccggagacggcggcgccgctggccacgaaactttaccgctgcagctcgtgcgactacaacgagtgctatgactatgtttccacggtgagtggcttgcgttgtcagatcgctcgatgccctggcaagatgacggtggcaatgaagcttgtggtgtcgagcacgagcactacagctaccggatcggccagcggcggcgaggcggcgcaaccagcatatgctgttgccggcacgggatttgtgcagggggtggtgacgtacacgatcatggatgacctcagggtcgcgcccatgtccaccatctccggcatcacgctgctcaccaccttcggtgttactgacatcacctcgctccaggagaagaccgtgcagattggctacactgaggtaaagtgctactatttctctacgagcaatgtgtattgcttgcagtgcgtactctcatctctctgttccgatctgtttgtcaattttgtacaacactattgcagggcttggcgatgctgaaggcgtcgctgcagtcgaagacggtgctcacagatgtcttccttggcaagaagaggaaggcctgatgtgatgtgatcgcctgcgcgggagcctcgtttgcttttgttggaacgttcatgttccttgtccggccattgagctatcttatgtgttggtggtgcttttgtcagtcgatctaggatgcgttcgttcccagccgttcacaactcttcttcctcgtttttcatgtgcactttttcaaactgctaaacggtacttttttttttacaaaaagtttctatacgaaagttacttataaaattatactccatgtatgaaaaaaatagctaaaccataattaatcacgcactaaacgctactttgttttatgtgccggggagtgagagttccgaactctatgaattattgccgttctattgtcagtttgtcacgtattgatatcgtatgttcttcaatcatctgtaccggttccggaacaaaatcgaccctttgaatcacaggaatgaaaaatcagaggaatagtaaaaacataggattctcacaggaatataagtgtaaaacagaggattacaaaacacaggaaaaacataggaatgaccgtttgattgaaccgtaagaaaaacacaggaatttaaggagagataaagactcaaaggattcttaatatgaggttctacctcatgctaaatttcctccaaaacttgcatgggaaaaggtattccataggaatttcataggattccatagtattcattcctttgattcaaagggctatataggaaaaattcctacaggaataaaatcctttaaaattcctatgaatttcctttgaatcaaagggggcctgaataggaacatatgggccttggggtatccagggagagataggtcaggcccgcttaagagcaggtacaatagcagactattagccagctgtaaacatattttaatgagataaacgatgagagagaagagcagcgggctatagatctgtagccagctgcagcacgaactccaaaatgtaatgtgtgtatgacaggtgggacaatatattaataatatagtaagcaactattgtatgaattagctattagattgactatagataaattggagctagtagtggactatactattatttgctctaactagtactattcggcttaaccccggcaaggtgacgtacacagtgatggatgacctcaccgtcgcgccgtcgtccaccgtctccgccatcgccgccctcgtggcgcttggcgtgatggacatcagggaattgtaggagaagaccgtcgaggtcggctacttacaggtgatcgacttaattttagatatttgcaatagagattaatttctgatatacactagaaaataaccgcggctttgccacgccttagtatacataggccagctcaattacatgaacccagtacactgttaattatgaagcctggtaattacgaattgatcataactaaatttgtatatatataaaaaaggctacataatcacaaaattttacattcaacttacccaataatgcataatggcttaggaatggtttcgataataagtagtccaacatttttcattgaacaccctaaaaattagaatcggaaatagatataaatggtttgtacactttgtttgaaaaattgaccatatcaaattttagtaatgtcgaattttaacacattttggtattatcaaattttggtaacattcgctttgtttggtttgatgcctttactacattttgatgcctttaagagagagcttctggaactgccaaaattgggtaaca

SEQ ID NO: 9627 - DNA, 728 bp, Oryza sativa
gatctgctacagcgtcggtgatgaagacctccatggccggcagcaggggtgcgccgagcacatcgtcgtccgcagccggctgaggaggctggggaggcatggtacaaggtaggcaccagatctgttgcctcctcttcctcctccgccgccccgctgctcgacctcctcgaccccgcgactcctcctcctcctcctctctcttagggtatcacgctgatacccaggtaccaaggtctgatacctaggtaccagctcaatacccagggtaccaggtatcagtcgataccagggtaccaggacctccggaccccgcgactcctcctcctctctcttggggtatcacactgatacccaggtaccaaggtctgatacctaggtaccagctcgatacccagggtaccaagtatcagtcgataccaaggtaccaggggtaccaggtaccagccgataccagtgtaccaggtaccacctcggtaccttacccaaggtaccaggaggatttggcggtgaggtagctgctactctgggtgcttaggggcgacgacgctggcgaggcatcgcgcgtgaggtagctgctactctgggtgctcaggggcgacgacgccggcgaggtatcacccgagcgcgcaataccgaggagaatttttggcggtgaggtagctgctacttcggcaatgacaccggcgaggtaaggtagccactgctccggcgacgataccgagcaggca

SEQ ID NO: 9628 - DNA, 636 bp, Oryza sativa
tgcagccggcaaagccatgatgaattatttgcctatggccctagcagattctgcccggtcctagcttcacaggctacccggtggcacaatcggatcttgggcgaaacttcgcgaccacttcatcgccaatttccagggcacctttgaacgccctggcactcagacgatctctacaacgttgtccagaagtccggagaatcccttcgagattacatccggcgtttttccgagcaacgcaacaagatctccgacatcaccgacgacgtcatcatcgccgccttcaccaagggcattcgccacgacgacctagtcggcaagttcgggcgcaagcctcccaggacggtcaagcagatgttcgagaaagccaacgagtatgccaaagccgaagatgctattaccgcgtccaagcagtcgggcaccacttggaagctgaagaaaaatatgccgaacacaggggggagtggaagtaccaatcacaaggatcgcaagcgtaagcccgaggaacttgtggcaaccactacaccatcctcccgacaacgttcgcgcgtcaatacttttgataagatcatgaactcccaatatccgcatcatccaaattccaatcacgcggccaaagattgcttcgtctacaaacag

SEQ ID NO: 9629 - DNA, 2320 bp, Oryza sativa
acattgagcagggataagggagcaagaagaagcataacggaatacccgtctcttggcttagccagaacttttcagacctggacgacgacgttgagccatggcgtgttgagtgctatgcccgtgtatacatcttgcacttattgggaggggttctttttctagatgctgggggtgacattgcttcggcaatttggatttctttggtcactaaccttgatgatctgggccgttttagttggggctccaacggtgttggcatggacttatagacagctcttcgaggcctgttgttgccaggcaccatcatccaacattagtggttgtgtgctggtgattcagatgtggatgtggctaagactaccggttggcaggcctaagtggaggcaaatctttaccccttggccctacaatgagccatatatagagaagacagtggcctacctgtttgagagtatagccactgcacatgctcaccgggatatcgcatacaagcagtacatcaacgagatggactgcctgcacatataagtactttactatcacttctaattcgtcatttacttctatgattgagatactaacctacgacaactattcaacatttatagattgagtggttaccataccacaccactgaggctacaagtcttacactgaactcgttatgcaatcgagactccgattacttcatgtactagtgccaattgatttgtttttggcagttgaataccaccttccgcaccgtgtcatgcgatagttcgggaagagacaagaatgtcttgttgaggacatctcaactggagttgatctacacaagtaatattttttatctttgcttgctttcattgtcaatgttcaattttgcaccatttgaccctattttacatatcatcaccttccacttgtgaaggtacgacagggtgagaacaaagaaggtgaaggactgggtgctagagcataatagatccattgatgaatggaggacagcgggagaatgataggtacatcgaggcaatacaccaaaatcatctttttactgagtaccttcgttggctgcataggacatatagactgttcctacgccctacttggacggaagccgacatagaggaagaccacgactctgatgaggggcggcatccctacgacgttcggactagggttggatatcaaatggagcacgccccacttagagacagagtcgtaagttttcttgcatttgtcacagtgatttttatttgcaccctaaaccctaacatacatcttctcacgctgttagtccagagagcttcttaggagtgtgaatgaaatggggcatgccctccgatctccaaggggtggtaaggatacggagaacaaacttcgcaatgtcttagaggtaaaaatgatttaactctatgcattacttgacttatacataacaaacttcttttttttttaattcaaaaagttagccaaaggtgccgcaaacttgctgcaagattaggttgcaggtccgttggattggacgacgtgtaccaactgcggagagtatcactaccactaccttaatccgtgcgtccaagtaccgctcgacactccatcaggatagaagagcgtgaacaagttggtggtttgtcatcgtcacgcattccacagggaaggggaaaggggaaggcacaggctccacctagcggcgacgatgaggaggaggatgagggctacatcacaccagacgtcgaggagataggcatgtcgcaacttcccgatgcgcctcatgcgtcacagcctacccaatacaacttacgatccactcggccagcgaaaaagaggtaaaatgagcttaccattctcaagtgttacttgatttccctcactttgttttttaaatgttctaaactttggtttttcaaatgtagatatactcagggcttgcaagctattcggcgccaacggaaaaagtgatttctacgaagttgatctttgtatcatgtgttaacttgtttcacagacttttggatttgttggttgtatgaagtatgtgatggacttgtagtattgtttgatgtgtggaatgtgtgatggagttgtggacttttttcgtcaatctagttagcttgtggactatgcgatatgtgatttggtgtcaatatttgctgtggaacctgttttgtcgatatttgcattttttgcagactgtccaatgaaatttgttgttggcagggaggtagaggtcggcgccagctaccctgacgtcgtgctgggggggcaacaccagcaaatcggccgaggcagaaagccctcagggtgggagggttgctggcaccgtgctatggggggc

SEQ ID NO: 9630 - DNA, 3017 bp, Oryza sativa
tggcacggtcacggcgccagggtggctggcgccgccatgttggagtacggcgccagccactctggtgcaccagaaaggatcattcctgtaataagtttttcaaggggccatttgtaaaataagttttaaaaaaggaccaaaaatgtaaaaatttcagtttgtgtcattggtgctttggtccagtttccttgtatgtctgtaacttatgaaaccattgacttgcatttgcctatcattgtgcagttggaactggggtattgttgtgtcatatcagtgaatagaaaaaaggggaagaagatgcaacgggtttgggtgcatggcaaatttcaaaaaccctaaagttgttaagttgatatgataactaccgccagtacatgtagtaatgctaaggcaacttagattgtagggttttagatcttgccgtttgtttcctgtgggccctgagaggagaaatcgtggcctggtaaacttattgaaattgagacactgtaactacaaagcttgctgcaggtaaacttactgttttgaacgttaaaatttttaatggtcaaggccaccttccgaaggtgagccttttgtttgtgaattccggggaactgaattgttctcgtgaaaaatactataaaatgtctatgaaattcttgcgttctaaaaaaggcctaagaaacatatttggttgaacgaaatattgataatgctgttagttgtgcacctgagcaaacccaactccttcctccatttcataatgtaagtcattctagtatttcccacattcgtattgatattaatgattctagatagatatatatgtctagattcattaacattaatatgaatgtgaaaaatgctagaatgacttacattgtgaaacggaggggagtagtttggatggccatccccgctcttactctagagtctgtattcttcttcccgaccattttgctgatctctctagctcaagtatctatccaatctccacttgcgtttcgatttctcccaaacctacctcgtagcatccgctcctcgtcaccttcctccgccttcaaataccttccaaaacatatacgagttttaggttccatatgagtatcaagaaagttgaaggaattaaatagaagaatgttatgattagttgagaagaaaaatctaaatgtggaatttgaatgataaaaatattgtgatcgattgagaaaaaaatatattttgaaggttgaagttagaacctccttggaaggcttgtatttggtccaaaacaggtgtaattcacaggcccataaaatttgttgagccggactgaaattgcgcgcttggatgggccggatgtcagattgaaattcgttcgtagaggcccattacaccgggaaatagattatctcctatcaatcacactagaaaacgacgaaagtcgggcttgttctcagcttcagccgtactccgcagtccgctccacctagctccacatgttgtccccgtgaactcaactccggctccacgcgccgccaccgtgaacttagctccgtctccatgcaccgccgctacgaccttgccctgtgggtcggccggaatccgtccaggtcgttggcctcctcttctcgtcatggtgtcagtctcgatctgcatctacaacatcttctcgactgccgatcagtggcggatcagagaattggtatcataacatatctatcggtgtcacagtatgctaattatatttagatcatggtgttataacatatagataaacagttttgctatagattttgccgaaagtcgtcagtgtcgcctgacaccgaccattctactgtagatcagcccctactgtcgatctgcatttccggcaccgtctcaccctcacatgcgaccgacatcttcacagtttctggcgtcatcgcaacctcagtgcatgctgttggcatcagctctctccaaattgaaacgacctacttctagatgtagtcttgggtcttataaaaatacctccgttcatagccagattttgagaatatgaaaaaactgagtttcctaactctagtttattttctggattcaacaaccacagtttcttagaatctaaacgaaaagctaaactgttttgatgagcttctgatttcggaaaaagctacagctgacagaaactcttcaaagaggcccttgatttgatttctcgttaagtacagctttcaatctgagtacagcttctgcttcttctaaatttctcgttgggggtagtgagaagagatcagtgtatatcgttttgataattttgcccaatatttctcatcaatctctctgttgtttttctctttcatgttgtgctcggaactgtttgatgaataatgcacgaacagctcatttttattcaggatcggatcaattttgttgtttttttccaatcgatttctgtttgatgttttggtctaaattgtttgttcagatttgattcctcgattggtcatgctgatttgatccattgattgaattcgtaagataccctatttcgtcaaatcagaattcgaacttcttgatgttccttcccaaacaccatgaatgcacgggttttaatttcactttatttttggtgcccgacaattacgggcgaaataaaattacaagtcaatatttttttgattgctcccaagcaggtctttaaaatatattctagaacgggagtaactagtactccttccgtctcataatatagcaatctaataccggatgggatattttatagtacaacaaatctggacaggagggtgtctagattcattatactatgaaatatcacatccggtattaagttcctacattatattatgggactaatggagtagtagagtaatactccttccgtccaaaaaaaaagacaaaccctaggtttccgtgtccagtgtttgatcgtccgtcttatttgtaaaaaattaagaaaaaaattaaaaagacagtcacgtataaagtattaatcatgttttatcatctaacaataatgaaaatactaattataaaaaaatttatataagata

SEQ ID NO: 9631 - DNA, 1244 bp, Oryza sativa
acggtcacggggtgaattagtggccctagcgtcatgttgtgggcttgtggccgaatgactcgtactccagcaaattgttttgttgcctcctgtttgctgggtatctggctctgttctttccttcctagctgagtcctggagactggagaggaccaatagatgcctagatggtgcagattaatggaccacactacgtggttaattcgttctttcattttctaaaagtagatctaaatatatagttacaatcttctttttttcaaaattgatcatcgatacaatatacttttttttcacacgtttgaccattcgttttattaaaaaaaaccataattataatttattttgttgtgagttgttttatcactcaaagtactttaagcataatttatatcttatacatttgtatataattttttaataaaacgaatggtcaaatatatgttcaaaagtcaacggcgtcatctattaaaaaacggagggagtacgtatctactatctaaaaatggaagcctaaattaaatcaatgcgcacattgagaaatgaaaatgatacgaccaagtacatgtaatgtatttatcttttgagagtttttatcatccttgagtggagatggtactaatctagaccatccatctcgtacaatctaagagctagaattgctttgtaccgggtggtactgctctcccgagagaggaggtgttgtgggtgagagggtaaaattgaactttcgcatatacccttgcttctatcggtttatccaccacagcctcaagtgtacctcgctgcggctgcaaatcaagaatgaattgagacgcctcaaatctggccttatgccagctcatcaccgcattcggtgccaatgccctaaaaggtacttcttggtatctagcaccgggtggagtggtggtaccttctcaagaatggtaaaagttcgcttatcttttaggttctgatgttgtagattggcccttcttagactttatttttttcgagtggtaaatgttaatactatctataaatttttacagattttcaatactatttgtattgtattttaaagctaaaaatatatatgacggcatccctctaatgggaaaaaaatgaaaattcacatttgatagatattactgtctgtgtgcgttagcgtatagaatggcttggagcccgcttggtcctatataacactcatgataagttcagagaccagaaaaatatattgtaacagttcagaaacctagaaa

SEQ ID NO: 9632 - DNA, 707 bp, Oryza sativa
cttccttaaggcagttcgttccgaccttaacaaggttccacttcctgctttcgtccaagacactcttggaacaatgcaggcgacggaaccttgtatgggtcggaaagaacggccttaaggaacgtcgagctcctggtccatccacgaggccgacgcatgtacaagtcagaggtctatctttcaacatacgtgctagcacattttatggatgaccaacgcatgtcatatgttgacgaaatgttctgtttttccaatttgtactagtcggttgcgtccagcaactaaaccgactagtagaacttggcaaccagaacacttcgtattatagcagcatgataacgtacgaactacacctcctatatctaattttaggagattggtaaggaaagcaagatcggtaaggaacgtaagatgggtaacgatttcaagattggtaaggatattcatcactatgcacactatgaaagcatatggcctcagttttgctcagcaattattcatcatgaaccccaagtgtagatggtctgttcttatgtgcaaaaaaaacaagtgaagtgcccccccaaaaaaaacaagtaagtgccccctcaaaaaattcacaagtttagttgttctgttctcaagcaaaaaaaaaaaaaactgaagtgcccccaaaatatttcacaagtgtagttgttctgttatcaagcattattaaacaagcgaag

SEQ ID NO: 9633 - DNA, 5399 bp, Oryza sativa
  unsure (1)..(5399): unsure at all n locations
catacatctatttatcacaaagagcacaagtcctatatatctatcacaaatcatcatcatctcaaatatcatctatccatcacaaacagccatctatctatcacaaatgtcatcatcatctcaaatctatctatcacaaacaaccatctatctatcacaaatatcatcatcatctcacatatcagctatctatcacaaacaaccatctatctatcacaaatatcatcatcatctcaacatcacaaatcaacatatcattcatccattcaaccaaatatcattcattcattcaaaaatttcattcaacattgcatctactgcatgcatcatccactgcatcattcatccattccactgcatcattccatccattaccattgcatcatccaaaaaaggaggggcggcgaagagaggggtacctggatcgagtaggcttggggaggaagtaagaggcagcccgcggctttgcggggaggtggccgtccgcggcttggcggcgacgtggccggcggctgcttggggaggacgacggcgcccgcttggggaggatgacgccggcgtccttggtcggggagaccgccggcttggcggtgctcttgacgcccagggggggaggtcgtccaggcccgcggcttgacgttgctcctaacgccggcgttggtcttgaaggcgtgagaagaggccggcgtcgacccggatctggccgtcggtgtagtagacagtgccggcgtcggtgaagaccgggcaggagccctcggcggcggagcccggtcggtgtgtcgtacgagaagacgccgtcggcgacggcgaggttaaaagagacggctacaaggggcgaggtgtagaagagtcggcgccggcgaggtctaggtggagagcaggcgctcggcccggatctggggctgccggcgtagaggcnaggtggtcgccggcgcagatcccaggggtaggagtagaggagggccggcgaagggatgggtaggagaagagaagccgccggtgagggggaggacaagagcagtaaaggcggcggcggcctggatctggccggcggcgaccggagacgatgaggaaaggcggcgggggcgtggggttttgggcgccggtggagaaggtcagcggcgtcggtgaggcaggaggagaggaggcgccggcgtgggggagtaaaagaggaggagaggagcctattagttaataactccaatttttttattaaaaaaatcataatttcgatgggaatgtatatatttgctatagcacaatgcaatatagttaattatttgttatattcccatctaagttatagttaattaataattataattattaatatcacggtaaacaataaattaatattggtttgggttaattaaaccacgaattattcaaaacacaaatatagattaacaaagaattaaaacagacatgaattttattcgcatctaattattcatcgatatgattaatataaataaaatattggaccataaaataaattcaaaacgacatatagtacggataaacatggataccctatctcattcgcaatataagtttcatccagtaatcgtttacaaaataggtagtacacaggatcgacatctcactaatgtttgacaattttggaaacaccatccttccgcgcggacaaaaacaaatcttcgtcaaggcttgtctcaacttccttgatccggtgatccggttaggaaaatctgtaaacaaaaggacgtcgtcgtattggttgtaatctgacacgtcttcaatgctatcaatgctaacaatgttttgctttcctggtacagcaatggccatcttatcatcggaagggtcattgacatagaaaacctgagcaacccgctcagcaagaacccacggatcatccttgtgtcctagcttgcttcgatccacaaccgtcaggccgtagtcatcgatgaatacgcatgttgtgtctctgacccattggcatcgtagcaccgggatctgtatgttaaggccatagtccagctcccaaatgtcttgtatgatcctgtagtaagacttcttctcacctgatgcgtcaaacgcctccacccgaactccgctgttatgagctgcgctattcctgtccttgaacatcgtgtaaaatctatatccgccgatgtcgtacccttgccatgaggtcacaagcctagttgggccatttgctagcctgcgcaaagttttttcctccagcgaatcacccaacggcagatctttctcctacaaccattcaggaaatttccatttctgttctttacaaatccaaatgttcgttcttctagggttgcaggctcttatctggttcatgtgttcctgaatgtacggctctaagatggcgagctgttgcaaaacactgctatgtgcttccgctacatctttgaagtcctcatcgtagaaccttttcttgcctacgatccccgtcccagctaaccggccctcgtgtaaagggggggtcacaccgatgggtttggcgtccttcatgtaatctatgcagcattcgaccacctcctcagttgtgtacccctctatcattgatccttccggatgagctcggttacggacataccctttcagcacggacatgtacctctcatacgcccacatctggtgtaggtatagtggaccaatctcgataatctgaggtacgatgtggacaataagatgctccatcatgttgaagtaagctggggggaaaaacatctcaagctggcatgctgtctcgattgcaaaagtttgaagggggcctaactcttcaggatcaaaaaccttctgtgatactcgattgaaaaggtagcacaactttgttatcactaactgagtgtgaactggcttgaccactcttatggcaatgggtaggaagactgttaacatcttgtgacaatcatgagcattgtacccagagatggtcaaatctttcaaagatacaagttttctgacgttcgctgagaaaccagtcgggactttcacactatgcaagcatctacataaagattttttctcgtcaggtgttagtgagtagcatgccggaggaatttcgatcttcccatttggcagctcttttgggtgaagctcatgccttatgtccaaattgacaaagtcggtccgggacttgaacccatctttcgtcttactcgggatgtccagtaaagtgccaatggtgctatcaaacacattcttctcaaggtgcattacgtcgatggcatgccgaacctccaggtctttccagtaatcaagatacctgaaaaaaaattgagtgcttcttgaaggactggttactttcctctaaaggtgcatcagttgtgtcctgatccgtacgtttcttcctcttgacgggcttcttctttgtcaaatcgaagacagaacgacctgtacgtgtttcaggagctagaaagttctctactgtattgtcgaataatctggccttcgcacgccacctatgcctctgaggtaagaaccgacgatgacgcatgtaaacacccttggttgacgaggtgaggtacttgtacgacgtcttgtcgatacatatgaggtatccgaacttccccttaaactggcccgagagcgaaaagtttgcctgtaagtcgttgatcgtaacgaatatgatggcatgcagagtgaaatgttccctacggtactcgtcccacattcgtaacccttcctcccatagttcttgcatgtcctccatcaatggttccagaaacacatctatgttaatcccaggctgtcttggaccttatataaggacagacaaaagaatgtctttcacttctggcaaatccatgtaggcaagttgtacatcgttagaagaactggccaggtgctgtgtgtgctgcttaggtcaccaaacaggttctttccatccgtgctcaatgcaaacctgacatttctcgggtcctttgcaaattccgggtgtagtgcatcaaagtttttccactgtcgagcatcggcggggtgtcggatcttaccgtcaattttcctaccctcttggtgccatctcatcaactcggcgtcgtctcggttggaatatagccggttcaggcgatctttaactggcaggtaccacatcaccatcctagaaatctttttgttctcatccaccagtgcatcatctttgtcgaccacctctccatcggaggctccgttgcccgtcttgtatttactcgtcccacatgttgggcaagagtctaaatccgcgaatctcttgcggtacagtatgcaatgattttcacatgcatggatcttttgaacacctagagacaatggacatatcaatttcttcgcttgatatgtgttcgtcggtagcaggttcggcttaggaagcattactctcaaaagatccatcaaatcattgaagctcgtgtccaccatccatgtctggcttcaatatgagaagttcgagcaccgagcgcaggactgaatagtccttgtcgtatcctatggcttcgtcgtacagaagatcgttcgatgcattttccaaagcttcccaattgtccaacccgcgtcatgcaccagttaggacctctggttcaacgagccgcaacatatcattcagttcaaaatcatatacgttcattctctatacttgagccaccgtattcggcatgtttccgtaagacatgtcttcgattataaaattttctgcatcatcgaaacataaatcatctaactcttcgtaacgaccaccggcttccccatgaaaagtccatatctcgtatcccttcttaaatcctcgatctacaatgtgcgacaatacttcattcggatcttgcagcaagatctcgttcttacaaactttacatgggcaaaaaatgctcctcaaattctccctcgcagcatgtgcctttgtgagctcaacaacttggcctgattcattcaagaacgttgcatgagctcttttcgtgttgtacatccatgtccgatccatgatctacaataaagcttgccattaatacatccatgcctgattcaaacacgaatgtatttaaattggagggaactaatcaccgctagtaatttttttaaagttgaacggactatttaaacagccgcacatcaattttaagcattaatagaatattgtctaaccatttctaaaaaataaaaatattcgtcctttttcatccaaatgaaaataaacttaagaggcaaacccaacgtttcaatttaggtgctaattacttttataagacatgtaaaagattgcaatatgtatttgcttaaaaaataaaaaaacaaaaggtgcctacactattccatttataaaagtgcaagtttcttcgtattccaccgatgaaaactgaaaaaaatggaagcaaatgaaggaggagaacgagctctacacttttatatggaacccaatcaaagatttgaggtcaaaaacc

SEQ ID NO: 9634 - DNA, 12297 bp, Oryza sativa
  unsure (1)..(12297): unsure at all n locations
gtgcggcccactgcccgaccccgacattcgcctggttccaggcggagccatttatggcccgcctggaaccaaaatgagccgccgccgtccagcataatcacatgtgtactagtgggacgtttctgcaggaatttttagaaatattttgagaacaatagtttgtattgtaagcatttccagatgaatcccttgtgtttccattgaacatgcaaacaaaattttgaatatgacatatatttcgctggtggttacatgtaagtttcgaaagatagtcatgacaataataaaaatagaagatgtctaaaaaaacaaataatttggaataatcgaaggatgtaattgtatggaatcatatgggttctataggtcgaggaggatatgctgacccgtaaatttggttcaacaatgtattagtattaatataaaatagtaggatatgcttgcatgataatgcagcaagtctttagcaatgtgaagaataattaccctttttgcgtagatttgtagtgctaatagaggtatgtgctgtatgaaatactagttcgtaagagattgcagtcagtatttctgttagattttgttattttgaggggtgttagaagtagtacatgctcgtccttctaacacttgagaatagttaataacagttctttggtactacaaagggaaaaattactataaggaagggtttgagcctatatttgtttgtcacaaaatattaaaattaaaataactaggtgaaactccacgcgttgctgttgaagtttactatgataccaataagtaaaaataatgtgtcgacgagtgatactcgtggaccggatgagtagagtattggggtacgttggaacgagggtctacgtagtacgacatcaaaacagacaaaagacaaggattatactggttcaggccccttatcaggtaatagccctagtctagtttatatgggattgatgatgatgagaacagattacaaagagagtagtcgaaaaagatgatcccgacgagatcgtagtcgaggtttcgacgagatctcccggcgagttggttctgtgtactccatcttcgtaagctttggtgggtgtgttggcgaagagattcgatgatccgaacctctcccaaggggtcttcttttataccgtgggtcatcttgaccccaagaaaggttttgaggatatcggacctgggacggtataacagaaactttatcccttacgagtaggactttagaaatcacttgacccataaagatattttccttaatttgaagtaaattccatacgatgtatatgtaaataatccatatacgtaaaggtataccatatcggtatatttcacaagtcgcaggataggaggtatgccttatccgtaaccctgacataatgtgttagatatcttaaacaacataagcttacctaaacataagtttacataagttggtgtgatttaaatttaaataatatgtagaatgataattcaaatgtcaaagtaaaatgatgtggctttatgaaagaaaaaaaaagaaggaagataatttagattatacatctaagggctaaaaaaagttgagatgatatggcttaacgagagaagaaaaagaaaagggataatttgaatcatagattaatcatataaggactagaaaaataaattgatgagatatgacttaatgagagaagagaaaaacaacatgaactaagtgaggatgaactatatagatgtataggatattataaaaaaaataatggagagatatattgaaagactatgtgaattatgtggaatcatttaacatgcttacattttaaatctctaaaatttaataaattattaaattatagataatatagtgtgcttgcattatacttaaatgtaatagttgttagtggatgatgatgtggtgtctttgcatgttaagctttggaaattagagggctataactttatagtaaaagaggataagaaaagatgtatgtagtaatatctcaaattttgcaaaattataatggcatggttccaattttcccaaaatagggtataccttttcgtttgctcagtggagtcttcattgaaatcgatattttttgtttgtagttgagctgctttgtataggtcctcccttaagtaatgaaaaatataagagttaaatcttgtgtaaatgaatatatggaatgccaataacaatgtaattattactaattgcattgagtttttttctcaaagactgaataggcaaagcagatattccatctaagctgtatacatttcctgctgcttgaactggcaataaacacgtatgaccttagggagttgctgctcaagagttggacattcctatcggtatcttaaaattgcaatagatatgaagtacaagtagtttgataatttattttgttgtttaaacttttttattttaaaattttaaaaatatacccttccaaaagttatttccacattctgaatctttgggccacgccagctcacctggcctggtaaaataatacgccacctatagcaggcgtgatagttttatcctgccacgccagcgtcgccaaataacgccgccatgtcaaccagacatgcatgaccaaataatgatgccacgctagccagaccagtgtgacagtattgttttgccatgcatgtccaactagcgtggccaaaaggtttggaaataagtttcgaacgtgtttatttttgaaattaaaaattttaaaagttcaaaaatataaaaaataatcgtattttgaagggattaaatatgaagttgtgccacctgatggtcaatatgaagttcaaaatttgtggactttatgtgtgagaagatttttttttttggtcatagaatgaacctgacaaattacatgcagtaagctagcagagatgggtattagggcctctttacagtgcaacaccgtggcattcaacctgagccgcaaacgttgacaaatcctgagaaatcggtcgtcacgtccaaaaattcgctaacacgaattttaagtagaatgtgtattaaatctctgttcagaatcagccagagtatacatacggcaatttgatagacagatctatgttttacaaaaataacaaaataaaactcacatacgcagcagaaaaacaaataaaactagacttaatcttcacgaccaaagcgaagcttcctccataaaccacaggcaatacttgacgtccggaacaagctcaaacatcaaagaactcatcatctgatccaatctctgctttctggggagggggaggggataaagtaagattgagtaccaaccaccgtcctcattcttatgaccacagataaatccgcaagcgcacggaataccgctgtagcacttcaccttcgggtgaccccaaaaggatatcgaactcagggaacgtgtgtaatctacctaaggctaagactatccaaggacaacaactgatgataggcaggctaggctagagaggactttctatgggttttaattatctaagctaagcaaagttaatttcctatctgctgcttcgggcaccgatcctgcaggtctgccagcgtggttccagctatagctctatgatgtatccgaacgtggaggatcactgggatagaattcagggctgtcaccacctgccgcctacctctgacaaaaccgtgggatacacaacaaacaaaggtaacctctaacctagacaccgcgtctaagttattaattatgtcggtgacatgggatcgggggtatcatgactagaggcttgggcagccgcggtcacccacgtggcctgaccccctcgggggggtcgggcccgagggagaggtggccaccccctcctttgtctccccgaggggtcgggccgctcttgtttcggccccgagggctggggcgccccgaccccctgtggtattggcgccacgtgtgtgggttaggtgggcacagcggcgctcacctaaccgcatttattgcgggatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcctgtcggaatgatgagagcctcttggcactcgtccctagctggagccggcgtggtaactcctggagttagcacgtcagtcccggctcgattcatgccaggcttcatcgcaaccattgcaaggaagtcactgtttgaagaagggcagatgtgcggcatgctaaactgacgtgtggtggagaagaatgaccggtctgtgactggactgacgccggtcacgtcatcggcagacaaccgtgctcccacgttgcatctgtttccggcggagtggaggtaggtatgacccatcccatcggagggtcattcagacagcagccattgcagatctccgcccattaatgaagagatgacagggtgatcccctgtgtccgacgagtgacggcgctgggcatcactcaaggacaagcggtgatttagcttccaggcggaggcgcgagtcaagatttggtcaagatagggtgggtccccacccaaaagaagagtaggtagaagtggtgcatgtggtatccccttgaaatataaaaggaggaccttgcccacaaaggaagggggacgactctgagaagagaaggaaaaaagaggggttctagagcttgaactctcttgctctccggctctctgtaactctttctcacacatatccaccagaacacaggagtagggtattacgcttctcagcggcccgaacctgtctacatcgcccgtgtctcgtgcgtttgctctctcgcgtacattccacagatcgagggtgaagaacctcactcagcgcccccggccgaaccggcaaaggggggcctgcgcggtctcccggtgaggagccccacgctccgtcatctggcgcgcctggtagggggcgcgtgtgcttttctaagccctcgtcctctttcgtgtgcgccaagtttctcccgctcagcccaatggccgaacgggcagtggcgcacaacctctctccgagcgctagcggtgacgacagggagcagaacccgcgccgtcgagctcgtactccaccgtccccctttcgccgaagtcttggccgaaagaaggcgctcgaggggatcgaaagatccgcgacttcgtcacccacgggtgatgaagaaggacggcgagacgggagcgtcgcctcctcgtctacggcgatggcagcacgccccagggcgcgctccaggctgcgggcgcgctcctacgtcacccgcccgtcgtccccgatccagagactccagctcgacgttggctggatgatgtggccaacttggtcatgacggcacagcagcgcctaggcgccggcgggcagtccttcgcccccaaggcctctggcgctgctaccaccggctccgtgtcgtcgatgcggagggcgcggcgagcggcggccgttacccgccgttcgtccgttattccctcgtcgacgcctccgacccaagaagatgtgcgtggggggccggatgcccgcctcaatattgagcgccgacgcaatggtcgtcgtgctgcccacgcaacggagtgcgcttcctcgtccggagcgccacttcagtctgggcatgggggccagcctcccatgtccccggttggcggtgccggctgtcgagcctttgtggcgagccttcggaacgtccgttgacccccaaggttccggcccaccatcaccgaaaaatacgacggaagcgtcaaccccgccgagtttctccagatctatacgaccgggattgaggccaccgggggtaacgacagggtcatggcgaatttcttcccatggtcctgaaaggtcaggcgcggggttggctgatgaacttgccacccgcgtcggtacactcttgggaggatttgtgccagcagttcaccatgaacttccagggcacatatccgcgcccaggtgaagaagcggacttgcacgcggtacagcgaggggacgatgagtctcttcgctcgtacattcagcggttctgtcaagtccgcaacactataccatgcatccccgcacacgcagtgatctatgcgttcagggggggcgtgcggcacaatcgcatgctcgaaaagatcgcctccaaggagccccagaccaccgcggagctttttcagcttgcggaccgtgtggctcgcaaggaggaggcctggacctggaactcctccggttccagtgtggcagctccggccgcccccgggtccgctgctcgatcagggcggcgggacaggaggaggaagaagaggtcggccctttccgacgacgaggggcacgtcctcgctgccgagggcgcttcgcgggccacccgaaaggggaggcctgcgagcaacagaaagaaggaggccggcgctcccagcagggagcgcccgaccggcaagtggtgctccgtgcacaacacctccctccacgacctcgcggactgccgcgcggtcaaaagtttggccgagcggacgaggaagtgggaggaggagaggagacaggagcgccgtgatggcaaggccccggcggcccccgccggcaaccagcgaggtgaggccaagcagaaggcccccgccgaggatgtcgacgatggcgacgataacctggggttccaggagcctcaggccacggtcgccccgtcgatgggggagcgtgcgctcacgcttctcgccggagcctcaaggccatgaagcgagagcttctggccgcggcccctacccatgaggcgacgcggcgggcgcgatggtcggaggtggccctcaccttcgacatgacagaccacccgccgtgcgttgcccggggaggacagatcgcgatggtggtttcccccaccatttgcaatgtgaagttggggcgtgtcctcatagacgggggtgcagccctcaacattctttctcccgcagcctttgacgccatcaaggccccggggatggtggtccggccgtcccagccgatcatcggtgtgacgccggggcacacttggccgctaggtcatatcgacctcccggtcacctttggtggttccgccaatttccgcacggagcgggtgaactttgatgtggcggacctcagtctgccctacaacgcggtcctggggagacccgcgttggtgaagttcatggcggcagtccactacgcctatctccagatgaagatgccgggccctggtggccccatcaccgtccatggcgacctccaagtcgcgcttgcttgtatggagcagcgcgcggaccagctcgccgcggcgtccaagcccgagtgtggcgacgagaggctcagcgccttcgtcccggccgccccgaggcagcggatgatcatgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgtgaggtcatccatccggagtggctggcgaacccggtcgtcgtccccaaggcgaacggcaagcttcggatgtgcatcgactacaccgacctcaacaaggcatgtcctaaggacccttaccccttgccacgtatagatcagattgtcgactccaccgcggggtgcgaccttttgtgttttctagatgcatactctggttatcatcagattcgcatggctagggaggatgagaaaaaactgcattcatcacccccataggaacttattgttatacgacaatgccttttgggttaaagaatgcaggtcctacttttcaacgtactactcgaatttctttgggtagccagttaggacgcaacgttgaggcttatgttgatgacttggttgtgaagacgcgcaaccaagagaccttactctcagatctagcggaaactttcgaaagtctccgctccgcccgcataaagctgaaccccgacaagtgcgtgttcggcgtgcctgcgggcaagcttctcgggttcttggtcactgcccgaggcatcgaggccaaccccgagaagatacgagctatagagcggatgcgcccccccagcaaacttagggatgtgcaatgcgtcaccggctgcatggccgccctaagtcggttcatatcgaggccgggagagaaggcgctacccctatttaagctcctcaaacgttccgggccgtttacctggacggaggaggctgaacgggccctcactcagttgaaggcgtacctcagttctcccccggtcctggtcgccccgaaaccagatgaaccgttgctactttacctggcggcaaccccacaagtggtcagagcggcgttggtcgtggagcgcgacgaggacaaccctcgctctgcgcacccccactctgtgtcgactcgacccgggagagaccagggaggagaggcccccgagccgaacggcggcccgaggcccccgacggccggagctggccctctgcccgcttgtccgacgggccaggcccccccgactcccaggatggccccggggccactgcgggaaggccgcgcttgtcgccctccgaccccgaggtcgatgacacagaagccgagtgcgccccgcgcggcctctcggacgaaaagcgccctggagatgcggcccttggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattattttcaggcgcatcgggtcacggtggttacgtcttaccccctcggccaaatcttgcataaccgagagggtactggacgggtggtgaaatgggcaatagaactctctgagttcgatttgcactttgaaccacgccacgcgatcaagagccaggccctcgctgactttgtggcagagtggaccccagctcccgagcccgtctccatccccgaggccagctcgggcccctcgcagccgcctcacaccgtctactgggtgatgcagttcgacgggtccctgtctcttcagggcgccggtgcgggggtcacgttgacctcgccgagcggagacgtcctcagatacctggtccgcctcgactttcgggcgaccaacaatatggcagagtacgagggattccttgcgggacttagggtggcagctggactggggatccgccgcctcctggtgttaggcgactcccagctggtcgttaaccaggtctgtaaggagtatcggtgctctgacccgcagatggacgcttacgtgcgccaggtgcggcgtatggaacgccatttcgacgggaaagagcttcggcacgtgcccagacgggataacgcggtcgccgacgaactctcaaggctcgcttcctcgcgagcccagaccccaccgggcgcctttgaagaaaggcttgcccagccgtcggcgcgacctgaccccctaggggagatggacgcgcctgaacggcccccgaggcccgtcggagtccaggcctcgggacccgaggagagcgctcccagctcccttagattgatcgcttggatcgctgagatccaggcgtacctcacagataagactctacccgaggaccgcgaagggagtgaacgcgtccagcgcatctccaagcactacgtgctggtggaagggaccctctatcggcgcgcggctaacggagtcctcctgaagtgcattcctcgggaacaaggcgtcgagcttcttgccgatatccatgaaggcgagtgtggagcccactccgcctcacgcaccttggttggcaaggcctttcgcttgggtttctattggccgacggctctcaacgatgcggtcgacttggtctggcggtgcagggcgtgccagttccacgccaggcaaacccaccagccggcccaggccctgcagatcatacctctttcgtggccgtttgctgtctgggggctcgatatcctgggtccgttcagcggggccccgggcgggttcgagtatctgtatgttgctatcgacaagttcactaagtggcccgaggcttatccggtcgtcaagatcgataagcactccgcgcttaaattcatcaggggcatcactgctcggtttggggtgcctaaccgtatcattacggataacggcacccagttcactagtgagctcttcggtgactactgcgaagacatgggcatcaagctctgcttcgcctcacccgcccatcccagaagcaacggccaagtggagcgcgccaacgcggaaatcctcaagggcctcaaaactaagaccttcaatatcctcaagaagcatggcgactcgtggatcgaggagctaccagcggtgctctgggcgaaccgaaccacgccaagccgagcaaccggggaaacgcctttcttcctcgtctacgacgcggaggcggtcctcccatctgagctcaccctggggtcccctcgggccaccatgtattgcgaggctgatcaagatcagcttcgcagagatgacctcgactacttagaagagcgaaggcggcgcgcggccctccgagccgcgcgctatcagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtccccggccgggctccgttcggctggccacgggcgacgacacagagctgcctaacccgtggaacatcgaacaccttcgtcgcttctacccctagtaggggtcgggtgtcaggtctcgggctcgggccaaccccgcaccccccccggggcgtgcagggttggccgggggctaccacatatgcatatacctatcttttttctcttctgtatttcaataaaagcatttttcgatttcctaaggactgtgtctgtgccattgtttccttttgctgaatcttgacttgaattagcacgctcgtgctcgattctgccctcggtggcccgggccggctaaaatcgccaaaaggggcccagaaccgagccgtgccccggggcgtggtgaactccgggggggaatcggcaaaggcccacaatcgggtcacccccnaaattttaanaaccccccccccccccccccggggggggggtcaccacgctccggctggcagtctaacatgtggatctccccaggcactagccccgacccgcgccgtttgaggctgggacctgggcacnanccctttttcgaagcgagacacagaaggcccgcggcacagaccatcctcgtctcatacacacaacaaatagaattgacacaaaaaatttcctctttatttgattgcagattaagttagtctatacaagaagggggcccgaaagcctcggaagaagaaagaaaaaaactctataaggttggcaggggcctgggggctcattacgacacgcccgggtcgccggcctcatcgccgctgtcgcccgcaccgccgtcaccgccctcttcgtcgtagtcgagggcgaacgcgagccggggggccgtaccctcgaagctgtggacgatgtggtcggcagcgtcccggacctgcgcgcgcgcgttgtcctcggtcccgggaggaaactcgtccagcgctgcccacggggagaagtccgggtccctggcctggtagcttgccagtacgagctccaccgccccccgggcgaggtccctcgaggatgacttgatcgtctcctcgagctcctcggggagccgctggagggtcccggccatctctgagagacgctgggcgaggcccccctggttggcggcatacttcgcggtccgctcgccccagaggcccgcctgccgcccggcgcgatctatacgggagacggcgtcccgaagcatgccgggccctacctcgcctgccaagcggagggcctcgacctccccggcggacgagtccaacgcgccctgcagatcggcgatggtgtgttcggcagctgcgaggcgggcggctaggtcgccgtcgcccgcggccgccccgccgctgcgcaccctcgcgtccagctccttcacccgcgcctcgagctcagcggcccgctgatccagtgcggccctctcg

SEQ ID NO: 9635 - DNA, 2794 bp, Oryza sativa
gtgccggcggtgtgccttgcggcccgcctcaccatggcttccaccgagcgccgcccctcctcgacgcgcgcccacgccgcgtcgagctccgtccactctgcctgcaggacctccatctgggcacctagcccgtccagcaccgtggtgttctcggcggctagggcctgcaggaggggctccgcgttcaggggggcagcggaaggcgaaggagagagccgcctcggtgcgggcgccgcgtggcacggcccgccgatcgacgtggcggactcgggggcgtcccccgaagctggcacgtcccgagcgtcgcccgaggggtcgggcccgagcggtgcgcccgcggcctcgtcgtgggtggcctcggaagtcgtcgtcgcctcgggcggagtcgggtcgggggcctggcaggccgcttggcgtgcgcgcgcctcctccgccttccggacggactcctcggcccggcggagtttggcctcctcccgagcggcttcctcagcctggcgaactcggacggcctcctgggcagcttcttcggcttcccggaggcggtctgcggcttctcgccggtcagcctcccgcctccgggcctccgcggtcgccgtctccacggcctcggactggccgaacttgggatggcggggggggggcgcgatggaatctcgctgaggcagaagaaaaaccagaggacaaaagaaacgggtgagtgaaagcttgccttgggagatgggagaataaatacggccgcagtgggcgcggggacaaacctgcgaggaggtcggctaaacgaccaccttggggggagataaggtttccccggtatggttcagtctcccccatcttgcggagccgcttcttttttcgctccccctcgggttgcgatgtcggcacggcaccctccgggcgcctgctgctggcacgcgccgccccgccccctcggggaggagatggggaaggggttccttcctgcttcctcttcccccgggtgtcggcggggcggctgctccccgggcccccgtcgcggggcccaaaagcacgaccccctcccggggtagattgttcccccctgcggctcccgcccgcgccatcgtggcctcgaggagcccgctcctccgacgccccgaccgcctgcatgatggtcaggatcgtggcgcgatctggatcgctgcagagggggagaactccttgggggatgagggatgcctccacggagctgagattcagcacccgttggaccactatcttgaagtcctcaggggcccagtcccatctgaccccctggtgggtcctcatgtagtcttcggacccggtgtactcccaggcgccccgggcgcgccgctggagcggcgcaatccggcgacgaaggtagtcgccgtacaccatggcccccgtgagcccctgggatcgcagacccgccaggcggtcaagaacggcgtcgtagccgtctcccagatctaccggcgcccgccagctggagacctgcgctgggggctggctcggaagtcggaggcgcgcttcgtcggcgaggggggtgtagaaccagtcgctcttccagtcgtcccacttcttgcggaggacgcagggaatgtagcggctcagcaccggcccccgcggctggaagtagcagccaccgactaccgacggcggcgacactggctgtacggtgaagaaccaccggaacagccgaagagatgggcgcaccccgataaacatctcgcacaggtgcgcgaagatggccaacgtcattactgcgttgggggtaaggtgtgccatctggagatcataaaactccagaacatccatgaagaaagaagagaatggcgggaccagccctgccattgcgaaagggaggaagaagacggaccgccccgggtagtgtggtgccgggcgtccctcgcccagctcgaccacctcccggccggcggcagatgccggcatgaatcggcacggcagcccggcctgcctctcgctcacgatgcaggaaggcggcagcacgctaccgtcgagcggtgcggagccccgtgccatgacgccggcggaggaggagcttgagaacgagtgagtgcggcgagggtagggcacaggaaacaaggagttagggcgcaagcggcgaaggcaaggggaataatggcgagaggaaggaaacgaatctcttccttggcgcctttatacccttgccaacgctattcccggctcctcgtttcccgcgcccactatctcgccccctcgtttctcgcgcccacgcctccactaatcccactcgcccgtttgcggcgcacgaggcggatgtgcggccgtggcagtcgagatagggcatatcgtgcgtgcgttaactacgctcgccgaccgaagcgccatcatcatatctccaggcgaaatgaaccggctcttcccgattcgcgcgctactcgagaaatgtagcggtcttgaagaggccactcattattatcggtcgttttttcctagccgatgcgcacgatttgcgaccgctgggttcctgcccgcctgtagagaccggtcccacctgtcaccagacctaaggagtggcgtcacgcccgagcgcttccctcgaggggggcgatcgccctggcataacgccgggggctactgtcggtgacatgggatcgggggtatcatgactagaggcttgggcagccgcggtcacccacgtggcctgaccccctcgggggggtcgggcccgagggagacgtggccaccccctcctctgtctccccgagggggcgggccgatcctgtttcggcccccaaggctggggcgccccgaccccctgtgggattgg

SEQ ID NO: 9636 - DNA, 7681 bp, Oryza sativa
gtgaattagaaactacggaaaaggaaactcccggtgtgacatcgatgccacgtttgcagccgggcccaccaaaatgaagtccacgcgtccaactgaagcaacgtgttcttgggcgatatcgaagccgcgcgcaactagaagaaagggtggtgggtgcgctgtgggacgaatggcttctccctcgttcccaggcgcgtgcaccgacctccgcatcccggattcgccctctcccgtgccctcgccctcgccatcaccctctttcccgcgcccccgctcgccctcctgcgcactcgctgcattctatttcccctacccgcgcccgcagtcgccctcccacgcgtgccataattttgcccccctcccgtgctcgccctcggtcacaaactcaccattgccctccctctcgcagcaaccggcttcttcgcccatcgccggggtactcgctgcggacggaggtacgtcggtgtggaaccctaaatcatttggtcgaattgattcttcaatttttgattttttttcccctctcaacgtgatgtaaaccctaggttgcgatggatccaagcatggctgctgcattcgctcattttttgcaaggtccgaacttagtggctagtttatctcaatctgccagccagccttctcctttcccctcacacccggtgatcccattccaacctccatcgttttcccccttctgtacgcagccgccgggcccgccagctccacctccatcgcccccaaacacagccaaggcaaagccttcgagctccagatctgcacgccgtcaccgtgtgactgcttccccagaagctgctgttgatcctaagaggaaaatgtactatcaacagaggaggatataaggctggtatgtttttgtttgtttttttcacttgttgacacacaacagagatattgtgattttctggtactattgtgatcctgcaggctgcagtaggacatttaggtgctaattcattctaaagaagtagatttaggaggtatgtttaggtgctgcactgccgcctcatataaaatggtggtgtcatataaatgattcttacaactatacaggtgatggtgtttaaagaaatattctaggcaacaatatctgtttacagaattactcccttcgtttcaggttataaaacgttttgactttagtcaaaagtcaaactgctttaagtttgaccaagtttgtagaaaaaaatagtaatatttttaatccaagacaaatttattatgaaaatatattcgaatattgatttgataaactaatttagtaatataaacattactatatttgtctataaacttagtcaaaattgaaacaatttgactttgaccaaagtcaaaacgtcttgtaacctgaaatgaagggagtagattttaatttataaacttcttattcctatatgttttctgggaaagatcaaaatttgggcatgtgatgttcagtatttgtccttcctgattcatacagtattatgtagaaaaagcagtttttaaaagaagtattgcaatatttatctttatttgacgcaattaggtgcttcttgattgtagagaagtcaaattatgaggtatatgcgatgtatagatgctaattcttacataaatggtgtataagtgatgaatattcttggaattgagtgaattttgtgtgtatatgtgatgtataggtgctgattcttacataaatggtgcataagtgatgattattcttggatttgagtgaattttgtgtgtataccctttgaacttggtgtgtgtaggtttcctgtgtccatggtctcaatttctcaaagagttttccttgtaaataggagctgattgaatgaaaaaaatattatttctggttggtccaagaacatgcatatcagtgaccatcttttttttttgcggggaatatcagtgaccatcttagttggtgcatgtgacagttgacaactgtttggattagggtccttctatagttttaaattattttactgttataaactcttgccatcattggttccgagaagttgttaatatgaatagaaattggcccccaaattaattggaacaactattgatattttctctgtttgtctgggtccacttgctagctgccagagagtatgacaaattatttctaagattgcttcatatgcatgcctagctggtttcatgtttcttagtgcacattttttttccctttgctcattttttctcagtgcacattttttttccctttgctcggagttacagcacgccatgatccattggaatcgccaccgaggaggacaggaaaagacagagcgccataattattgattttcatatataggtaaccaatttgaaatgaaagtattttaaactacgaatttagtgatataacatgcataatacttggcatagatattgttagtataatcagtagtaaaaaaaatatcaagtttgattttcccttaaaataaaggtactctataatttgggaagggaggagtacatcacaaacatcgactcactaaaacatataaatgtctcggataaatcctcaacggtgagtggtgcacctgaaaggatttatttcaatctatgtggcattcagagaaggcttgcagctttatgaggaacttctatagcctagctcttgtcaattcccttgactcataatccatgacaccggggatgtgagtttccataaagtacttgtcccaattgatgaactttatattacagggtatcaattctcggtctctttcagtaaccattcccataagattctgcattttcgagtcatcgaacctacaagaaagggtacaaaatgggaccagctcttgatcaaagaaatcttttcttttttatttattcttggagttacatctacattacctcgttttggatattgtgaatggccagtatacctctgccacggcaacagtaaaatcatactctctcttgagatggttgtaaatatgacggtcttcagtggtagataacccacggcgcaacatatcctgcaagcggaaataatgacccactctgtgagaaagtagccaaaaaaacattgtcgaagtgaggtttaacaagaacaaactaacctgcaaaggcattttgtagtgtttatccatggtctcgtagaagctggccattgttgctagaaaattcggttgtttcaccttgactacatctccttttgcaccgacgaatggtatctgcgagaagtatttgtacgttgtttgagacatctggccaagcttgatcgggttgctcatggaagaaccaatctgatagatgaagtctgctgttccttgaggatggtagctgataatacaaagcatcgcattgaccacaatgtctgcaggtacctgcaaggatagattactcaaaaatggtaatacattgagtccatatgtattaaattttacaattatataggtcaaatagatgatggtggtacactaaggctccattcctttccacgtttaacttttgaaatttccttgtttaccgtgagcattttttcaaattgctaaattgtactacgtattttcatcaatttatttaaaaaatcaaataaacaaatctttcaagtttgtaatagttaataaatcgtacgctaatgatatttatgtttcacgtgcggcaaaaaagtaaaaattaaacccgctttcaaacaaagcctaaatcctagtcttgctctacaccaatcgatcaattccttatgcccaatagtacaggaagatagtatcttacaatgtctatgactgttgccacatctgtaggaaaaaacttcagtgtccccttaccatagttagtgatccatgtgtcaattgctctgcaccaaatccacagggtgtatttcaaagtgagtttgctgttgattaataatgcaagtaattaattaatggtcctggacagtgatggactgacttggctccttctatccatccaggaaaaggctccttccatgtgcttgttgtggctgatggacggatgataacaattgggagccgtgagttttgttcatatgccagcatctcacccattgcttttgtgaacacataggcattcgcccatccaaacttcttagctctatttagtcatcatgcgacggttgtcttaataatgttgttcctaatgatgtatcacataaaaagtactagaagtctagcgaatagcaatgaataaaattatgtgtgaaacctttgtgcgcctatctttttcatggtgtgtcttatggtacgttctgaagcattgttgtaaactagctccttcaacttttcatccttaaatgccatctcttctgaaatatctagatctgatcgaccatcataactcctccattgttgaagcggcttctccatcatgatcccttgtttcattagattgacataagcttgtttcattagattgacataagctgaaatttagaaacaaatatgtcatttaacaagaaatcattgttattggataagtagcatagccataggtaaattttaggtttcacctgttgacacaagaagaacgagctctaggtttgtgcattttgatgcaaaatctatcatatgcttcacacccatagtgtttattgccaacgctgtatcatatctgcacttatgattagcgttaataacttgaataaatcttaaagtaaccagtaaccttgttttacctttctgcgaagtttactgtcgcagccatgtgaacaataatatttgtttctttccttatatcttcagccagtctagcgtctcctataccgaaattcttcaaggacacatctcctgctagaggaaaaaccttgtcccagaaccatgaactgaagtgcgtttgatacttctcccgcaagggttgaaatatcggaagttgcatgatctgatatgacatgtagaagagaactgaactagatcagatcttaatcaattactcaacaattcaactaactaaatttttttctgaataaaagacaatatgcatgccgtgggggagaatccatgttgagcttttacactatatggaggatggaaatttcaatttgctacattcagtccacgcttcacactagtatatgatccccaatccacatgtctttttgaacacaacactcctgccatgaatcaatatcactagcgcttggcttcgggctcgtcgccttcgctgcggtgcgacccgttgtcggcctcgtcgtcgccgaacgtgacggaggagttctcgggcatcacggcagagtactggtccgtgccagcgccgctgggcgccgcgaggtcatccgcgcagtcggcggcaacgcagccggaggaggtgttacggcaggtggagaacgaagcagctcgaaggggcattttggtcagcccgggtgcgaaattgggtggaaatggagaaaattggttcaaatggcaaaataaatgtttagtatctcttgtgcgtggcattttaacgaatccattcggcggaatgatattttggcgaaacccactcttagcagtggcataatgtccaatttctcactgccgccaccaccgagctcaacacacccgacaaccctgaatgtcctaaatcgaactttcccatcagctttggatctggatcagacagagagggaaattgtgaagaaagaaagggtgggtgagcttgccctttccctctggagctcaccactgaggaaaaaccgctggcgtggacgccattgatgagccaccggatccgccggcaaagaaatcgcggctgccgcatccaacacccagagcctccccttcgagtctgcgtcggcagcggcgtagcaaggagagcaccggcaatgagggtgctgcgaggacaccacccatccacaacatcgatccccttcgagcggagaatggcagcagcgtagggaggacacccgacggcggtcacggcactgggaggacacccagcggcgggcacggccaagccaaatccaggcgccgcgcaggagagagcgagagagatgagagggacatggcggctgggagttttttccttttttttacgcgcctgggattctcgcgaaggggagagagagagaaagaaaaggaaattttgtgaaaatacccttcagtttccaggattcagggcgcagtccttttttcctctttttgtctcctatgtattgaatttcgtaggatgcgaagggcctaaacgcaatattttaaaccgagaaaagaacagagaggacgtataacaaaatatctataaaagagagggcttttctgcaaaatttgcagaggcgacgcggacgcatgtaagcccgtgaaatccatccgctctccagcgcgtgtccacgcgtcgtgaccccgtgatggccacggcagcgcaaaacgctgagggcgctgcatttcccagttggtttgaagactttagatatcgtatgggatccttagttttcatgaccccaccaacagtgccacgatgaatctcagtgcaactagcgttgctacagggcttctcttctgtgccatccaatcttttcatccaccttcgatccccttgtccacgagcatacgtttagctccaaagcctcccatctggcccccggcctgcacttctcgcaatcccctactcagcatgctggccactccatcatgtttcctccttggttggttcaaaccaatcgggaggcttgcccaaaactccaatcccgtcttggaataactctgcatgcttactccaagttttattttgctctgttttcgcttgcagatctgtttcttgatcaagtgcacaatttgttaaccagctgcgttcacgtggagcttgtagcgtcgtgcataacgtgccctggatcatgtgatggtaacatgtggcaaaaggacgtggcacgcacaagcagcggtagtgcgatcagtgcctaccgatcgatcgagattcagaaaagctaccgatccacaacatcaaaacttgcgttttatgttgttgaattgttccaatctcatgtggtttctatcattgtgcaccccatccccaattcccgatgcttgcactgggtactcagattaatggtggctggtccatgcacgagttcatattcatgcataaacagagctatgtgtgctcgagcttggtggtggtgtgatccaagaaggcggtggtggtgctgcaggaggttgtcggcttggggttggcatgacaaaccttgtgaaccaaggtggagctcaataggctcaggggttcccaggcacccggcccaatttaaattttttgtgcttaaccctcctttttgtcatatgggaacccctcataagaaaggaaaaagtccacttagacttccttaattgttcaccgaatctaattcgttacccttaactataaaatcaggtaggacgactccctgaattattgaaactagtgtaatttgactcctccagcggttttggagggtggttttgctcacgtggtgctgacgtggcgagcgggaagaagcagccgctgcaggggctggaccaccgggtgatggtggcgctggtcaagatggtcgccgccaacttgttcctacctctgggcaatgccgccgtccgcctacccgtcgtcgctcccgccgccgtccgacgtgctcgacgacgaggtccccgtgatggtgctgctcccgtggatcgtgcactggtggagaaaccatctttcgtcggtcggccgatttccacaatagtcccggatgcaataaaaaccggggctaaagatg

SEQ ID NO: 9637 - DNA, 1882 bp, Oryza sativa
  unsure (1)..(1882): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttttcattaatgaagagccgattagcttcgattgttgcttccagtttagctctctcgcgcatgtctgctattctttgttgtgccctttccagcttgaaacgatgttgctctagatatacagccagggaaatgatgtcggcttcatcttctgggatctggtggtggatctcttcaaacctggccctgattgacccgcagccagtaaccaaggaatccaaggaactccctagccgttgagcaatatccatgagtttggtcttgagatcatcatcaagagggaccaaggctccactggtggtttcctcttcttcttcatctaggaactgtttaacgtcaaaggaaaacatattggccaagacctggagaaaagataaatcgggattattggcaaagaaaatatcgcagccgatatgagaagatttaatagtactaacaggcacaacaagaggtggatgttctggtgttcccaagtgatgactgtccacagccgacggggtgtgctcactagatgctagccgacgaggagatggagatcgaggaggctgaggcaaaaaggggaggagattaagtttttgtggaactaataggagaagaacacaagtttaaggttaccaatggaggcggagtggatttcttcttcttagcagcccttggcttcttcgtctgctggaaaaatggcaataaattcatatgatgcacacttaatcggatgataatgtgaagaaagatgcataccaccacttttaggggccggtgttggagcatctggcgtcttgttgggacttggtgtaccagctggaggtgtcccagctcgacccgtagggcttgcggataaggccctggtgtcactcatgccagcagcagcattatcaatggcctcctctatttcttcattctccaggacctcctctacatcacgatccaaaggaggtagatcatcggcagcaaacttttgcttctttgctacctttttcgaggcggcaggaggtttagcagccgatggcttgacatccgattgcttagtgcttttccttttacaagtttcaactggaatcggttcatgagtttgcccatatagtaaattagttgtcttgggggccatatagccgatcactgaaggagctagtccaccaccatttgggataatccctgcagcatagttaatcggcttcccactttggctagtgtaaggcagtgaggaatctgtggtctgcgaacaaggaaaagagatcaagtatcgattaaacatttgctcaaggttagaatttttcaaaaagaaaagtgtacctgaggcatcgagtccgagaagattatcgtgaagaacattgaggctgatagatggaataaatgcttcttccactcagcccaccatcgatcgaagagtgtgctcctgtcacgcccgaaaattcactagtaatttctaaacttatttgtgcataaaatcctcgtataggaatcagctgacgtgcacaaactgataatttaatatacaaatccatcgtaataataacattacatacttacaaaagaaaagaaaacagcagcggattaacggtctagcgatggctttagctccactcccacaggcagctcaactggggtataagccaaacgtcttctccttcgcaacttcctcaattgaggtttgattgattattgcaaggtgagtacatggaatactccgcatgccacacagcaaatatgcaagtgcacaaggatacccaaggatggcataatatagggcttattttgcaaagcagcatttagcaaatatttgagaata

SEQ ID NO: 9638 - DNA, 10183 bp, Oryza sativa
ttcgaatagttttactctggccagagatgtatcaatgtatcactgtacccacaagacagccccacaacacgttgccaatgtatcactgtacccacaagacagccccacaacacgttgccatgcgcctcaataccaccacgatacctcggaaaggagctgtgacagtacccctcgcataacacaatccaccacaacgcaccgttcctggatcataatcaccccctcaattaccagaggcatggactccccagcgacccccacggacttctcgccacttcacagtctggcgccccataatgaattatactatacaaaaggaaatgccgttacccatgctagcttgtggttggcatggttaatgtttcacaacagtagctcgcgaaccgatccttaattgtcatgagcacgaccatcaaaactatacgctcacaacccaccattatcaagttttaattatcaattgattatcataacacgatttatcatcgtgagctacctttaaatatccagctttaggtaatagtgaagctttaggctgtgttcgcatgttcagcttgggaacatagtgcctccgcacggaaaatggagcgatccattagcgtatgattaattaagtattagctattttttttcaaaaatggattaatttgatttttttaagcaactttcgtatagaaactttttgcaaaaaacacattgtttagtagtttgaaaaacgtgcgctcggaaaacggaaaacgatggagaggggctgggaacatggggttgcaaacacagccacactaatgtttctaagcatatctaagtaactatactaatatatctaattgaaccattatatgaggccaactagtcaaattgtatcccaaggtatcaaggaataaggtaatcaatgcaaattggccgtagcaaaggtataagttcacaccaccggtgacattcgaaaataaatacacagttgaaataaatagagaatttaaatataggatcaacatgctcaaaggagttgtgtttgggatctatgtgacttgccttgcaataatcggtcttcaattaatcttcttgaacacttccgacgcactcacgaatcttcgcaacaacggaaacgatgagctaatacacaaaacgaggaaaaagactaagaaactccaaataaacagtacatataaactaaataaacatgtagatcatgattttagatgaatttagagacttaaacagccttattctgacttcatatgatttagttatgaattttacaagattaatctgattttagccttatatacagaaaaggatttacgatttatcttagaaaaggaaaacgggcgctgacgtcagcgatgatgtcatcacggacaggggcttccaacgatcgccggcgatctagggctcggcggcgcaaatcgaggataccggaagaaagagcacgacgacgggagctcaccgaggggcggcacgacgacgaacgacaacggaagacggccggcggcgaggtagaggcggcgatgagatcgggacggcggcgacggcggctttccgacaacgagcggcggcaacggaggggtggccggggtgcagctcctcctttcgaacccaacggaggtggcgacgaagctgggcgacgacgggaggagcagcggggcttcgccgaagatcaaaacgcgacggcgaactcggccttaacggcgacgaagggcttcccggggtcttcggcttcgggcagatggtggccggtcttccactcttcgctttggtcccattggaggcgacggcgctgaccggagatgtcggagtcgacggctacgaccgactggagcggcggccggcggcggagcgaggagacgagcgcgggcaggcggctaaggttagggaaaagctctggaaaaagatagaaacggaagaggaggtattgatactgctatttataggcaaaggtggaggaaataggctcggacccgtgaggatttggcggcggattggttaaggttcgccgggaaaataggagatgaactccgcttcgaatccaagcgatatacgatgggatttgctccgattcttgaggggaaagaaagaggaggataagggaagaaatcccttcaaccaatttgggaaacgagtcacgggatgcaacggattctacagaggaagcgggggcgtcgagttgcatgggcagtgggcacaggagctcgggttctgtccagagatagaaggagtactgtagcgataggaaggtgaaacagacttttgtctgggctaaaagaaaagaggcgagggacaagaaatagacttcttcgggaaagaaggagacagtaagcaggcaaagaggaagaatgggctgaagactggcccgaaaaggaaaagggaattttatttacttttccatttaaattaatcatggaaatgatctttgaattgttaaaaataattacaatgctcaaataatttcaagaaaaatcctgaaaataatttgtcgtgacacaaggtcacggacaagattggggatagacaggaaaaccccttttcctgcctatcctgagaaatgagcccgaataccaaatgatcacaccctgagtgacaagatttttagtattccaagatgtcctgtctgctacaggctttttgtctgctctatatagtacacagctttacatgtgagattacaattgtgctctttgccaaatgctttgttgggcccacatgaaattacaatcgtgcccctgcatatcaacagaccctaagggcattttggtacattatgggggtcattatagtcttttggtgccagctagatggagtggttgagtggtccctgggaatattctcttggcatctttattgtccaagtcgccttcttcatggccaagagtcttttccaccaacatggatcttctcctcgactaagggtcttttccaccactacgggtcttttccatggcaaatagtcttttccatctcgaccaccatttcggacttatccggtagctgatgtcacagcctgatttccgtttcaggatttataaattatttaataaattattattagaatttatattaaatgttcattaatttacaagtgaagttaaatgtgggaaataaaatttcctaaatataaagcatggctggatttaatttttattaaattctccatgattaattataccctctgaaattttctcggatttttcagagctcaattcctaaatgatacaaagaacagttcagtaattagttaatcaattaatgatctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgcttctatagttcctagatttttctggaatttatttgagccaaggaagtatttttaatcaatggaatatcatttcatgaataatttaaatagaaaaaggttttaaaatctcccttttggctttgggccgaaagtcggcccaagtctctctctcccttcccccggcctgcgcgtgctcggcccgttcggcccagtccgccgcgccctccctcctctctctcagccgctgacaggtgggacccacctgtcaggtcgtcttcctcctccagccaccaaccgccgactgtagccgcaagccgccgccgatctccttccaaatccggccgcctccttccttctccggccaaatcaattgaggggaaataatctcctcgatctcctcttccttttctctttaggaaaccgagctaattcgtttggaaatcgtcggattcaatgccgatttggttagcatctctttccaaaccctaaaaccttccatctcgctgccggtcgccgtgggcctccgtcgccgcctcctagcccctataaaaggatccctgagacctcctcaatccaccgtcaccttcgccttagcccgccaacgcttgtagcgccgccttcgcgttagctcgtgtgtcgccgtcgtcggcgtgagtccggccgtgccgcgccgctgctctagtcgccgccgtcactcggggaggccctcgccaggttcgcaaggtcgccgccgtccttgtcccgtcctccgtttccgccgcagatcatcggagcgccgccgactccgtcgccccgaagctctccaccgctgccgttggtccagccacgccgcgccgttggtccagccaccaccttcggtcgtcgtcgccaccgtcgggatcgcgaggaggagcagcacctcgtccacccctccgtttccgccgaagatcgctggaacaccaccgtcgtcgttgacccaatcatcgccgccgcttcgacctcgccgccgtcgtcatccgtcgtcgtttgccgtcatccaagagctcggtgagttcgccgcgtcgccctctacccgttggtgccctccgtttgcgtcgccgcgccatcgattgccggcgagcacgaggtgccgagccgccaccggcgatgacgtcatcgtcgacgtcagccgtagacccgtggtggattagatcgatcttggccgtccattttgtttagattagatctcggccgttggtttcgtagaccgcctctatgcacccggtctaccgtggaccatctttgatgacgcaataaatcccttttgcttttcaaaaataattcattattgcgtcataattcaattaaaatctatataaatgctttaatccggtttaatctttaaaaattcataactaattcattgtaactcagtttaatgtggttcaagttgcaaaagttgtataaaataaagatctacatattaaaattatccataaattgaattaaatttatttaatttttttaaatgggctttaattagattaaatcttgtaaaattcataattaattcatatgaagtcagagtgaggccgttcaagtctcctaattcatctaaaattattatctacatgtttgtttacttcttatgtattgtttatttggtttttattagtctttttcctcgttttgcgtgttagcttgtcgtttccgtcgtttcgaaggttctcgagtgcgccggaagtgttcaagaagactaattgaagacccgttattgcaaggcaagtcacacagatcccaaacacaattcctttgaccatgttgatcgtatatttaaattctttatttatttcaactgtgcatttattttcgaatgtcaccgggtggtgtgaacttattcctttgtatggccaatttgcattgattacactgttccttgatacattgggttattataatttgactagttgagctttatatattggttcagctagatgttagatataattgcttagccatgcttagaaacattagcacataattgggataactaatgtttcactattacttaatggtagagatttaatgatagctcacgatggttaatcgtgattggtgaattaattaatgtgccaactaaaacttgataatggtgggttgtgagcacatggttttgatggtagtgctcatgacaattaaggaccggttcacgagtttcggttgtgaaacattaaccgtgtcaaccacaagccagaatgggcaacggctggacactttgcatagcaaggctcatcgtggagtgccagactgagaagtggcagagataagcccacgggggtcgctggggagtccatgcctctggtttttgagggggtgactacgatctaggaacggtgcactgctttgagttgacatatgcgaggggtcttgtcacaactacacaaatggtgacatgtttagcatgggcacatgatgatatggtgacatattgtggagttgtgtcttgtgggtacagtggtacacctctggccagagtaaaactattcgaatagccgtgcccgcggttatgggcgggtcgaacaatgtctttcgtgattagtcctacactactcattaataataatgtggtaattgatggtaattaatttagctcctggtttggaatggtacattcctggtttggagatagatctgtgcagccgggtatggttgttcaggatggttgggcctgtgcagcatgggtgtgctgttcagtgttgattaatattgatgattaattactctactgttttacaattcttaaatattttctaaatgctggttttgcaaatgaaccctatattatgccatcctttggtattcttgtgcacttgcatatttgctgtgtggcttgctgagtatgtcatatgctcaccttgcaataatcaatcaaacctcagttgaagacaagttgcgaaggagaagacgtttggcttatacctcagttgagctgcctgtgggagtggagccggagcttcgctagactgtaattccgctgctatttttcttttcttttgtaagtatttacgttattattatgatgaatctgtatattaattgtcagtttgtgtacctcggctgattcctggacgaggatttaatgcacaaataaattcggaaattgctagttaatttctgggcgtgacagctgacctgttattaactcaagaaatacgcaaaacggataatgagacttagtgacaaggactcactcgaacggtattttccgactcgaatagtgttttccaactcgaacaacattttaccatttccttgttcgaatgaccatttgccactcggatacttagaataaaaactcaatcttacccaatctcttcctctacagtgttttgggccgaatagagaggaacggtggtgacccctagctacaacaagcccctcacgggtaagggcgaagtgtgttttcggccgaaaccgtgttcgaatcaaaagctaggggagaaccgccgtcctcctattcagtcgaaaaacactaggatagaaaattttgaagttcgaaagcggttattcttgtcagtcattatgcatttatttgtttattatatatatatatatatatatatatatatatatatatatatatatatatatattgttatatgtatacatattctttatgtattgaatatgcacatttatgtcaaagtttgctcaacaccatgcggcagtttgatctgtagtcaaagcttttcaagtttggtactggaaaaagaaaagctatgaagatacccttgcttctctctaagcatcgttggcttcgagctcacacaccgcacaatcctcttggagtcaaccagacaacggtggtgacgctcacaaatctgattcacaggtgtgaagttattttagggaaaactaacttggaaaactttttggatatggtcgaaaacgcttgttcttttgctccgtcgaacctattgtggttgggaacttaattatgtatattttctgtggttgggtaccatttgctattttctctgtatgcctgtgcttcatcatcatttcgtttttgtcggggaagcaggtttatttgaaccgaaaagttgtggttcgacgcaacaagtatcattcaactcgaaacatgaagctcgttgcatttcgaacacacgagaagttgctcttttctaaagcaactaaatgtgatgatgaagagaaggaaatacattacgatgacacttgtattttttctttaaaatttttccaatggcaaagagaacatcgagatggtagtttgcgtgacttcgttgtcgagtttagaaaacggcgttcgaataatgcttcgagcagcattaacttttggcaaacttttagaccatctgagcgtcaacttagaatatggaaaaggcgctactcaattgtcccttacacgggaatgccttctcctctcaatgtcatttttcctttttcttttccttttattccgcaaagactcgaatcagaaaagaattcgagcgtttagctttggtttttgaaaaccgccgtccccctttcctttcgaaggagtgacgaggtcaaaatcgcactttatcttgtcgcatggaatttccactttctgctcgaatcggttatgagtgtttgagtgtttcatcgtttttttggtttttggacgatggtaaaacttgttcgaaaaccgccgtcctccttacctttcgaaggagtgacgaggtcgaaatcgcactttacctcgtcgcatggaattttccactttccactcgaatcggatatgagtgttcgggcgctttatcattaggtttttggacgaaggtaaaacttgttcgaaaaccgccgtcctccttacctttcgaaggagcgacgaggtcgaaatcacgttttacctcgttgcgtggaattttccactttccgctcgaatcggatatgagtgtttaagcacttcatcgttaggtttttggacgaaggtaaaacttgttcgaaaaccgccgtcctccttacctttcgaaggagcgacgaggtcgaaatcacgctttacctcgtcgcgtggaattttccactttccgctcgaatcggatatgagtgttcgagcgctttatcgctaggtttttggacgaaggtaaaacttgttcgaaaaccgccgtcctccttacctttcgaaggagcgacgaggttaaaatcacgctttacctcgttgcgtggaattttccactttttgctcgaatcagataagggtgttcgaacgctttatcgttaggtttttggacgaaggtaaaacttgttcgaaaaccgccgtccttcttacctttcgaaggagtgacgaggtcgaaatcacgctttacctcatcgcgtggaattttccactgtttgctcgaatcggataagggtgttcgagcgttttatcgttaggtttttgggcgaaggtaaaacttgtcgaactgcgtggagtgctttttaacctgttgtcaagttggcttttcttctccgaagcgtgcggaggattttctcgatttgttatcgtgttggattttcctctccgaagcgtgcggaggattttctcgatttgttatctagttggattttcctctccaaagcgtgcggaggattttctcgatttgttatcgagttggcttttcttctccgaagcgtgcggatgattttctcgatttgttatcaagttggattttcctctccgtagcgtgcggagtattttctcgatttgttatcgagttggcttttcttctccgaagcgtgcggaggattttcttgattcgcaaacacatatacaatccattattgataacaccctacgtcctgtttatatgtattaacaccgagaagaaaagagaatcttacaaggtggtcggtattgtacacttcgagcaacatgtttcccccttttttttttctcttttttttcttcttccttttcttttttttacacatagaacttcttcaaggaaacagcattccaagtatgcttaattcttctccatcgaggtgtgccagcttgtatgctcctgttttaactttctttttactatgaatggtccttccaacagccacttcatttagtgttttcttgagggccaaatcaccttcttctatttgcctgattttcacttttttgttgtaatagcttttggtttcttctgtgttttttgccattttgtctaatgcttccactcttatctcgtgcaacatttccaaggtgatttcccttccttcttcgtctttttgatcaaacacaattcgaggtgaattcgctcccacctcgcttggtgtcattgcctcatctccatatattagcctgaatggagtcatgccagttgatcgaacaactgttgttcttaaagcccaaaggattgacaacagatcttctggccattttcctttggcagaaccttccagccttttctttatggcttctactattttctcatttgctctttcaacggcaccatttgttcgaggatgacccacagaagcaaagttgatttgcaggttaagacatttacacatatctttgaactttcctgactcggatcgttttccattatccttgggtattccaaatcggcatatgatattcttccaaacgaatctttgtaccgaagcagatgtgattcgtgctactgcctctgcttcaatccaccttgtgaaatactcaattgccacaatgacaaaacgtaaatctccttttgctcttggtggaattggccaaactggtggaattggttgcaactctcttggtggtgcttttgacgttgcaccaaatttttggcatgccttacatgtcttaatgtacttct

SEQ ID NO: 9639 - DNA, 1235 bp, Oryza sativa
atattctgccgtgttgtttgttgatgggaaaactagctttgcaaaatattttagtgtttgcttcatcggcgtttttacaaccactgctgcccctacgccagtggcattgcatgctccatcagagtatattatccatagtttttcatcttcttccttttcctccacctcattgggagtccattctgccaaaaaaatctgccagaacttgagactttatagctgttctcgaggtatacttcaaatcaaatggtagaagttccattgcccattttgtaatccttcttgctacctccttatttgtcaatacctctcctatcgggtatgctgacagtatcgttatgtcatctgatattaaataatgtctcaactttcttgaggccatcacaattgcataaatcaacatttccacttctgtgtaccttgtctttggcccttgtaaagcttctaatacgaagtaaactagcatttgcttgttttctttctcttgcactaatgctgcacttactgtccctggtgtcgctgctacatacgttagtaaaggttgacctttctgtggacttgctaaagttggcatattctgtaactacatcttcaaatcatcaaaagccttctggtactcggccgtccactcaaatgtgtttgctcctcttagggttttgaaaaatggcaaaccctgctcttcagatttagaaaggaatctgctcaaagaagccattcttcctgtcagcctttgcatttccctttgtgttttttggtggctccatttggtgaatcgctgcgatcttgtcaggatttgcttctatgcctctcttagatactaagaaaccaagcaactttcctgctcttaccccgaaaacacactttttcgggttaagcttgactgaatattttcttaaattctcaaatgtttcctgcaaatccttgccatgagtgaacgcctgtttgcttttcaccacaatgtcatccacataagcttctacattgcggcctaattgctttgccaatactttgcctattaaccttgcaaaagttgctccagcattctttaaaccaaatggcattcgaataaaacagtaaattccaaacggagtgatgaacgacgttttctcttcatcttcatcacaaaaacttaatgataaccggagtactgcatctaagaaacccatcaactcgcagcaaactgtagcatctactaactactctattcttggcaatgggaaatcatcctttgggca

SEQ ID NO: 9640 - DNA, 14353 bp, Oryza sativa
  unsure (1)..(14353): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcgttgtcctcttccgtttgccccctttcccgagctctcccgtgccccctagcgccgccgcgacgtgcttcaagttcgccgccgccgccggccgtcttcggcatcgtcgcgccgccgcctccgtcgtcgtcgccgctcgccgtttccgccaagaggagcgccgtcgtgcgaggaagctcggccgcccctccgttttcgccgccgacccccggagcaccctcgtcgccgtcgacccgagccgccgcgccgcctcttctcgtcgccggccgccgtcgtgcaccgtttgccgtggtggtgagtaccaacgggttcgcctcgttgtcctctacgcgtaggtggtctccgtttccgccgccgacctccctagcgccggcgagccctccgacccgagccggccgtcgtgctgacgtcatgccgacgtcatcgccagggctgacgtcatcatctccagggctgacgtcatcctctctctctttttcctttttcccgattttctaatagatttaaacttcggaaaatcataactaaataaccgtagatccgttttaggtggttcaagtttctaaattcttctaaaatcaaggtctacatgttaaaaatatccacatgtactgtttatgcttgtttttgtgctgttttgttgattttgtttatttgctttagtttccgacgttctggaggagagcgtttccgttgaggaaggttccgaagcgtttgtggaagcccaaggcaagtcacacagatcccaaacaaccctttgagcatgttgatcccgtttaaagctattattttatttcaactatgcattgtttttgaatgtcatcgggtggtgaacctttcccagttagttaatggccgaagatgactttattttcctatgggttataatttgattagcatgaaccttatatattggattggttcagctaaatgctatatataggtttgcttagctatgcttagaaacattagctaactaaaaggggttaaatataaagtatatacataattattattgttaattagggttatattcaatggtagctcacgatggttaatcgtgtgatgttaattaattgataatttaaaacctggataaggtgggttgtgagcatatggttttgatggttgtgctcatgacaattaaggaccggttcgcgagctactgttgtgaaacatttatcgtgccaaccacaagccagcgtgggcaacgactttatcttttgtatagcgtgattcattatagtgcgccagactgagaagtggcgagaagtccatgggggtcgctggggagtccatgccttgtttataagggggtgattatgatccaggtacggtgcactgtggtgaattgtgttatgcgaggggtattgtcacgactcctttccgaggtatcgtggtggtactgaggcacatggtaacatgatgtggggttgtgtcttgtgggtacagtggtacacctctgatcagagttttaatctattcgaatagccgtacccgcggttatgggtgagttgagcaatgtttttcgtgattagtctcacactactcattagtggtaataatgtggtaattaatttaattcctggtttggaatggataattcctggtttggaggtttaatttgttcaactggggttggttgtacaaatacggttgggcctatgcaacacgggtgtgttgtatggtgtttatttaatattgattaattattcaactgttttactattctctaaaatatttattaaatgctgttttctgcaaatgaactatattatgccatcctttgttatcctgtgcacttgcatatttgctgtgtggcttgttgagtatgttatatgctcattcttgcaatattcattcatcagaagaggagtacttcagtgaaggtgatgatctggaggattaggcttgttctggttaagttgcctgtggagtggagtcgccatagctgttccgtagtttgttatagttttgttttccgctgcgtagaatgttttatttttctttgagaggaactatctacctctgtaataatttattatttgtgagtattcaatagttaattatttgtactctattatcaatattgtcattgtgtgcctcggttgattcctggacgagggtttaacacacatgtaagcgtttggaattttggatagaaattccgggcgtgacaagaagcaaaatcctctataattttggagaaatctagggaccaaaatcccctataattgtcgacagagggagtactgatggctcggatgtgcgcatatggttggatatgtgtgagacgtattttgatatgtaccaaatcaccccaaatttcaaagtatctgtggttgcgttacatatgtcaagaaatgctgctaagtggtatcactcttacaagttagtggctgacctcagttcatggggccaatttcttcatgcagttttttgacatgaaacagcaggagaggctcctactgtaatatatattaatatatatatatatatatatatatataataaaagggagaatttacaaaggttacaaataattacaaataattacaaataaaaaaataatttcttcatgcagttgcttctgaatttgaggggattgttgagcatgagaaaatggttgcattagatgctttaactcaaactagaactgtggctaagtataaacatcaatttgattcactggtttatcggattagagtatttgatccatcaggcatgatgttggtgactcgctttcttggtggtttgaaggatgagattcgttttgcagtagtggttcaacttgatacacttcagcaggcagttgctattgcacttaagcaagaaactgtgttggcagagaaggctactaaaactaagggcaagtttgttaagtatacttgtcctaaacctgattttggtgctgagacaacccctgctcgatctgacaaaggagatctttggaaatctagatagctgaaatactataggtgtgcttagggcctttgcttcaagtgtggggagaaatatagccctgaacatcgttgtaatgtgattggtcatattaaggctatgcaattgaatgaagttttggctgatgatgttcttgatgcagtggtggctgtaaagtattctgaggataaggatgatcaaagtaaaatttctcttaatactttgacaggtgcatgaattctcactaccatcagacttcgtgcttttgttcagaacaaagtctcgttgctcttggttgacttagggagtactcatagttttattgactataattttgcttagctcttgggtctaccctctacagcctatttcaccaaattctattaaggtgggtaatgggattgtttgccctgtcagtatatagtacctcacttttcctggtggattcatagacatacttccacttatgatatgagagtggttgccttgggaggttatgatgctaatcttgccatggattggctagaatagtgggttgaaatgtcttgtaattgggcccaaaagaccactaaatttcatcacaaagaagttctcatttcattacaattagtgcaagacccttctactccttccgaacctactgttgtttatatgcaaaaattgtttaaatggcacaaaggccgtgatatctgggctgctgccctattggaacaaccttccaaagtccatatccacctcctctgtcataccagttccagttcagcagttgttgactgaatttgacgatgtgtttcaggatcccaaatgcttaccccctcatcgagtatttgatcatgctatctctctcatgccagatatatctctagttaattgtcgtcccttcagatactctcccttgcagaaagatgagattgaaaaacaagtgacaaaaaatgatagatgttggtcttataacacccaatatgagtccctatgtttcccttgtgttgttggtgaaaaagatagatgacagttggcgcttttgtgttgattacagaaaactaaactccctcactatcgaaagtaaatttccatgccagttgtgggtgagctagctggcactatattattttctaaattggatttgaaggctggatatcaccaaattcgaaaggttgatgctgatgaggccaagacggctttcaaaacacatcatggccaattccaatttagagtaatgccctttggcctcactaatgtctcctctacttttcaatgtctcataaattcagtctttgcaccatttatcagaaaaatttgtgtttatctttatgtatggcattttggtttatagtcctgatttaaccagtcatttgagttagctgtagcaagtgtttatggttcttagacaacacaatttgtttgctaagagatccaagtgcccttttgcttgtcataagttggaatatcttggccatattatttctgacaaggggatgagtactgatcctgagaaaacaattgttatgcttgcttggccagttcttagctctgtgactgagttgagaggatttctaggtctgactggatattatcaaaaatttgtgaaaggatacagtgtgctggccagacctcttactcttttactgaaaaaaagggctttccaatgaaagaatgaggcagcccaacttgcttttactcaactcaaaacaaccatgagcactactcttgttctagcattgccaaattttcaatttccctttactttgggaactgatgcttgtgcttatggtttgggagctgttcttagtcaacagaaccaccctattgcttactacaacaagactataggtcctaataatcagaagctgtccatttataacaaataatctcttgccatcgtgatggctgtggataagtggaggtgttacttgcaaaggggtcccttcactattaaaactgaccataagagcttgtgtcatcttgatgatcaaatcttgggaactgagctacaacaaaaggtcatgactaaattgatgaggctccaatataccttccagtacggaagtgagtggacaatgtggttactaatgctctttctagaatctaatcccaagtgagtgccatttatgtggttcaaccccagtggattgaagagatgattaattcatatgcagtggatccacatgctcagtggctgttagctgaattggttgtgcattctcccaacagcccgggctattcattgaaggaaggactgattcgatataatgacaaaatttgggtgggctctaatgctggtctccaaaccaagcttattcaggcttttcattcatcaccaattggtgtccattccggtattgctgctacatatcaccgactcaaacgtttgcttgcctagcctgggctgaaagctcatgtggatggttatttgaaacaatgccaaatatgtcaacaagcaaaatatgaacattgtcgtgcactgtcacgcctagaaattcacgaaccagaatttctaagcttaatgtgcattaaatccctgtccaggaccagccagggtacacaaacgacaattgttgacatacagatccacgtcttacaaaaatataaaagattacaaatgcagcgaaaagataaaacgagctaaacttggaagcctgacttctgcagcgggcgactccactccacaggcaacccttgacagcagcgacaaaaccaaccctaacaagatagctccaacttggaagatctccagctctggtgtgggggaaaagagagcaagactgagtactacccactgtactaaacaagtcatactggaagagaaggtatgatgcaggataaaaccaaaggaggctaagggttcatttgcataaagcagtcatttaaaagtagtagttgaaagcagtaaaacagttgtaataattaagcaatattaaccaatcactgtccaacgctacaccacgttgcaaaggcccaaccaaccacctgaactacaccagttcattaagctacactaggggtgagactaatcacggtgaatctggttgatcgcccataaccgcgggcacggctattcgaatagttttactatggccagaggtgtacaactgtacccacaagacacgattccacacatgtcgccatgccccgaagtatcaccatgatactgcaaagggggaaatcgtgacaagaccctccgcataaccctcccctaaccatccacaccacgctaaggtttcacccccacccccagcaggcagtgggcagtcccctctgcgctgcggtgaatccggcagctggacaaccggacaccccggccgacccaactccatcacgcccaccctcgcctaggaaagggtcgagctatacttcagatcaagcagttacccactcccgcttgtggtaagcacggtaagtctcccagggtttcccatgaaccggtccttaattgccatgggtgcgaccagcaaaaccatgcacccacagcccaccattcagtgtattttaattaactgacaccattgtggtggcaccaatccaaagctatactcatagttaaagtctatgtaataatgtgatccgcattggtgtactagttgagctaagcatggctaagcatttcctaaaccaacatctagtcattttgatacccaagttatcaatgacataaggtaaacaataaatggctgagtaataggacccatcccacatgacattgtaaaagaatacaacatttaatagaaatacgggatatttgtaaattgggtacaatatgatcaattgtaatgcatgacttgccttgccctcgcattgatgataccacagcaatgtcttcgagaaaccgcggatcgacgaaacggccgaaatctacgcgacaaacaaagcacacaagcaaaacacactataagactactgaaacaaagaacaaaacaatttttaatggattctagagaattttatgaatttactgagacttgaatggacttaaacggagctcggatgaattacttatgaattttagaagataaactgtgtttttactaatagagaaaaatccttaatcaattttattgcgcaatattgccccagggctgatgtcatcaaaggagggggagcggcgccgacaggcgggccccgcatgtcagtggcatgaggcggccagtccaccgtggaccgggaccacacgagtggtccaccaccggcccacgggactgacggtccagatcggccgggaggccgatcggacggcgcgggcggtggcttggcatggctcggctcggcagaaagccggccggccggccatgaggagcggcggcggcgcaggaggcggcggcggtggccgaaggcgatggcgagctcagagagtggcggcgcatgcgggacagggggaagaagggaggagaggagctcctcaccggcaagcacggcggccggggcgaaggatgaaggtggcggcgacgaccggcgacggcgagcgatggccgagctctgggacaccctaagagagaaaagagaaaggttagagggggagtgggagtccacggcgagtgaggatgccggctgaaggcggggaaatggaggagctcaccgacgtacgtgggaaacggggctccggcggaaatttgcggcaaccgagtggcggccgaggagcaggcggcaccggcgatcgcgaaggcggcagcgacgaggctagacagcggccatagtggcggttagcggctaccgaaggtcggcggtgggcggcggagctcggaagagagatgcgacggcggtagagggcacggatggaagcggcgagggcggaaaacgagagaggggtctcgggggagcgatttataggtgtgagaggggggcggacgtggtcggttagccaccctattgcgccggcgacgtgggaaggtcgggagggagagagaggggattcaaacttgaatcccggtcggtgcgggacgcgcgcgcgtgcgaaagaggtggaggactaggcggcgacatgggcacgagcgcgggagaggcgcgggatgggcgcggaggagtggcgtgggcgaggcggcgtgggcggcagcggcggttgctgccgaggcgcgggtggcgggtggttagggacgactgacaggtgggccccacctatcggcgtccccgagaggagggaggggaaacgggccggcccggccaagaggaaggtgagcgcgggagggagattgggccgacggcccaacaaaggaaaaagggaaaataaaaagaagaaaaaggaaaagggattcctgggattaaatgttgcacttgctcatttttaactggttaaaattatttatagagctctgaaaatttcactaaaaatcatgttaatgtattggagcatggggaactcaagaaaaattccaccacgccgaattcgattattaaatgcattttttaattagggaattagctctaggttaatttaaataatttcttcgagcgatttatttaacaaatttttaaagcaagaaaaagggagaaacttcagggcgtgacatgcagctgggttattggctccattatctattccaaaagaggcatggcaagatatttctatggtttacctagatccgatgactacaatgctatattggtggtggttgatcgttttaccaaaattgccacttttatttctcttaagaattctttcaccgctcctcatgtggtacatatggttggaaaaaaaaatttcaagacaaatggcattcctcgttcaattgtgtctgacaaagatagattgttcactaatcactagcaaattttggacaaccctctttgagatttgtaacactcaacttcagaggagcacaacatatcatccacagactgatggtcggactgaagatgtgaatcaagcaaaatcctaaaaagtggaacaactagatacacttggtagagttttggtataattctaattatcacacatcattggtttgttctccttagaaagctttgtttagcaaagaatcaaattactctcaactccttgacctcactgagacaactcaccctgaagttgtggatttgcagactaaacgatagcatctgtctgaattcttacaacaacagctgactcgtgcccaacttcgtatgaaacaccaagcaaacaagggccgttctgagagggagtttgcagtgggtgatcaagtgttcctgaaactccaaccttatgctcaatcttctgtggttaatcgcccttatcccaagttggcctacaagttctttagtccctttggtatcctggaatgtattggcaatgcagcttatcggcttgatcttccgggtagtagtgctattcaccatgtgtttcatgtctctcagctgaaggggcaagttcccaacaatacacctgcctattcttcattaccttcgccggtcatcctcgacgctgttaaggcaagctattttggatcgccgtttagtaaaaaaggggaacttggctcatgtgcaagtgctgctaaaatggtcttctcttcctgttgatcatgccatttgggaagattatcatgtggtgaagaatcactttcctgatgctctagcttggggacaagttgtaactccagcgggcggcactgtcatgaccggcaatagtatggatcacaacgtagaggagttaagcaagtagcgcgtgagtttgggatttagtcctgcttgcctggaatgatttgaggcctgtgagcccagtgtgcctgtggcccattagcctatttcggaacatgttaaatattcatcaggtggctcaactgtcgcgagtctggcaaatgaaatctatcgtgcatagctaccttaagttcttcccaagtagtaggtaaaactccctcgtcagctaacccagttcaccacatgatagcaaaatctttgaactcactactggcttgtcgaactctatgttgcttaggaacaaggtgggcactaaacttttgttctactgtcatctctcaattaaggtatttctcagcatcataatatccccaaaaagagggtattttaaacttaaccttagcataaggatcatcgggcacacgattattgttaccttgttggtggtggtgatttgaagtgccacccatacctgtgcggtttgtgcgtagatgatgtcgtagccgtgcttgccttgtagcttgtgcatcaatattgccactagaatcatacaccgtgtctttaggatgaccactgtcgttgctgctgcttacttcctctttggaaggttcttgtgtctccaacacagcaacccgatcagttagcttggacatcccgcttgtccaacctctccatttggtttacgaagccgattttaaggatggcatcttggacagcctttgtaacggcctccgtcatctccttttgagcattttctacaacagtaatatggtgcctctcaacaactctcagcaatatggagctccttaccaagccattataaggttcttaccagcaaagcaaaggatacctggaagatgtaatcagcgattgcaaggatcaagaacctgtgctgtctagaagtaatatgttgagctaggaaggccaaatatatgtgagtggtacgcaatccaatgacagatagtaatgctgaataaaatcccaagtcacttgcccttagttgctagtctactcgtgtcctagacagtagtggtaacaatgatggcgcaaggaaaatgacactagtaaacagcaagaaaggactggtaggcaagcttcggcgagtctcagcaaaaacagcaaaaccgcaaggctgataagctcaacggagcgcgtcgtgagctcgatgcactagtggaaatcaacttttctttttttttattttttgatattttttattttccaggagcacaaaaataggcacaccacgaagttacagctcaatcggagttgatatgtggcctacagaattttctgaaaccactataaagaatgtacagaaacttgtgagctcgacagacaattttgcaaaccaaatttcagaattttgtattcgccaaaccctccgaaggtggggagaaacggatgtaaattttttttctcttatccgaaaagttatggttgtttgaagttagggcttccgactaggtttttcagaggggatataacctagtctgtttagcggtggtattgggatatggtggcaacggagtatgtaggatgctctggtgatgcgtggtgatctggataggtgtttatgatggcggaaacggctctcaaaggatgaaccctaacacacggatgaaaggtggcggctagggttacaaaggaaaacacacgactagactaaaacacgcattagaccagcaacaagaacttaaactaggactcaaactcaacactatggactctgaaaaggatcatgcaaaggctaaacacggtctgggttaaggtgtctaacgactacaacttttttttggcttttctgtagactctaggataactgcaaagaacaaaaactaatctagggtaaagaaactgagcgaacctgacggtgaacctagagctctgataccacttgatgtggactagggaacccgatcttccgaaagattctgataatcaacgattttggcggagtcgcgacacaaatcgatccggcttcttgaatgaacacgctcttgagccccgcaatcgcagcaccacgtctgctctagttatcacccgtgttgaaacgcggatgacctcaccgagaaggctaatccttgtttgcgaatagaagaacacaaacaagaacaaggtagaatacaaccaaaattgcagatgaatgattaagctcacaagttggggtcttacaaaccgatctagcgatgaaactgttctcgacagaataatctaagcaaaacccaaaccctatagataatggcgggtactgatatataaagtttaaggttgagcaaccaacccttgacgcaaccctaatgggttccaacatgatacacagcctaaaggcccaaataccgcgacacaataccgggacagaatctggatgtcaacctattttgggtgattacccgttgactcggaaagatattggacgtcggaccaaaaccattgaaaagattatcttcttagctttccatccatataaagaacgcccaatccgagcttgtatgtgacctatgcgcctgttttagtgcagactggtcttggactccgaattgcactcgaagttgacttggtttggacgtccaccttgatcctccataactctaggtccttctccaagtgtcttcttatcctctccattattcctaatcacaatataatcattaggtagcaatatattctcaaattcatacaaagaagaacataggaacgagctcacctctaaattcaattgtcgcgcgcgagctcttgttatcggtccttgaatgaccggtggaggattgttgtgtgtatccgatggagtgatgtccgcatcactctctccctccaacctaatctcgtcggcgacgatctcgttggtggcggtgtgttacatgtaatcaaatcgtagtaaaaaaatgtaaaatggaagaattcttctctgattttattgtgttattttttgaaacacttctccgctttatcaaaatggtgagctttacctacccctggatcctgatcttagccttaagtacttaatcctatcccagtgattgctagatcagcatacggtttcaccgcaccatcacctacttaattgagttttaattattttaaacttagaaaattaatttatctaatattgtagagcaacttctatatagaaagtttttgcacgaaatacaccaaggtaaaatctgtaccctaagtgcaatgcagtgctcttcatctccaatggtacagtatctgctgttacaaaaatactatctctgttccaaagtatctgctgttacaaaaatactatctctgtccaaaaaaaagctaacctagaaggggatgtgactctcctagtgcaatgaatctggatagccctttgtctaaattcgttgtactaggaggagtcacatgactcacatcccctcccaggttggcttttttttttttgatggagggagtaggtttgaatctatattattagtacaaatttgttgttttagcttgatagtcctaaaatgtttggatataagctaattatttttttgtttagtatcataaaactaatattctacttaaggatgttcaatttatacactatattatttttctaggtttaaatcggggttatattatttagttatcttcatgtacttttgtttgataattctcctatttatgttcatggaatgaatctgtcattcctttcttatgttcctagctagttaccaataacatatgcaagtaataaattgcatgcacttttgttgaaaaagttaattcgttcaagttgccagataacatgatctgtcaaattcttgtgcaaactttgtcgccgctcatacatcatattgttcaacatttctctttaagttgcatacaaattcagggctagagaaaccaacatgctatccaatgaagagacagtaaagctgcacaagggcttcataatttacatgttgcttctatttggtcgttctatctttattttctcaagcaaggtcgttcaataatttttatgggcatgattaattacatacatggtcaagtgatagattatttgagatttatacatgaactgaagccggttttattgtgcagtgaagcaggagaggaaacttatatatgcaaccatgtgcgaactaactatagggccgtaaatgcatatttgttgagaatacactcactggtggagagaaaccatctttggtcggtcgaccaaattccacaatagtcccggttctattaaaaaccgggactaaaaacgatttttagtcccggttaaaaaaattttgatctttagtcccggttggtaaactaaagatgatttttagtcccggttcatcccctgtcagatgtatgtcagggggtcgagaatctttagtcccggtttatactaccaaccgggactaaagattaccactttagtcccggttagagttatcaaccgggagtaaatatttctctcccacatctgatcggttaagtccagacagatatttacataagattaaaaatcccctctcttcctcttctcagatccaatcctctttctcctccccttccctctctaacttccctcctcc

SEQ ID NO: 9641 - DNA, 18060 bp, Oryza sativa
tgatttggagatatgcatcccatttgattcgggagaaaatacagggattaacactagccattagcaaatcaacaataaaataaaataaaaaagatctcgaggtctttagtcccggttggtaccaaccgggactaaagattccccctctttactcccggttgatggtgttaccaaccaggactaaagatcgatctttagtcccggttatttgaactgggactaaagatagcgatctttaatcccgaattcgtagtcccggttggaaaaccaggactacaaagggttctaaaccgggagtaaaaagcatttttccaccagtgactgttaattgcttgcggagcagtcttgagatcaaggccgtagtgcaaaatgttatgaattctggctgcggtattattagcagtcgtctacttgatgctgtaagctagcttcaagtgaaattggaggtcaatggaatgaaatactctgagatgcagttctgttcgtacaaaactgagggtaaccgaaggtttttgccttctttaaaagttctgttttggatgcttcatgtcacttggacaatatgctggcatagacggtatgtacgattcattgaatataatataacatgattcttggtttttcggatatttcatgtaataatgactcatggatccattaattcttgctatatagctggtacccattactaacaaatattgctataaagcagctctctggtgcagccacatcatcggtatgttgtagccgtggatcgttggtcttgttctgatctgagccatgtgatagcatacgccatctcctgagtcacagatcaattgagcagcctatgtttagcggctaagccaaagttaggaggatgtatggacgtacgacccatccaataatcctcacggtcgcatggcccccttcatccaagtcttgctcttaagacatctaagagcaagttctacataattgaatatcttgactgcaatgggggttacatatttgaaactgtttatgtcattttgaaagtatcaaaatatttcagtagttttcatttgatatcgatatctattgctacgtacaacctgttttttgctacttactacagttgcatatatatcgcagcttgcttgtacggtttcaatatgtaatactcctccctccgtttcacgatgtaagtcattctagcatttcccacatttatattgatgttaataaatctatatgaatgtaagaaatgctaaaatgacttacattgtaaaacggaggaagtaatatctatctcagatctaaaatatagatgtaataccctgcaacaaaatatagatatgataattaatattatgatttttggaaagcacttaatttcctatttagtcattatttgagttagaaatctatgtattaagtcatctatgaggtcctcgaaaaaaaagtcatctataaagcccgcagcaacacagcggggtatctgctagttgggtctggtgtgaatgccacgttttgaacgtgatgctaaatggattggtgttgcaaggctgacttggcagggggctgacttagcagggttgtggggggcgttggggacttgcggtgtattgacctctattttggtcagagcacaagggacgtggtctatgtgacttttttttgtaccgtatgtgcaatcgtaaggacgcaggaaaaagaaaagtctagaggtagctaagtcattttgctcgtgcagattatggtttatcacgggaacgctttgcaagctcttaaatttaaattgtctgacaattatagtatagtaaatgcaataactaaattattttgatcatttttttatacatattcagtttctaaatatacttattttgtattcagtttctagacttattttgtcaatatacttttcgtagatttgtataagcatagtgcttaatttttattattctattaaaagtcaattaattttactatgtggaaaattttgtatttgggttgagatttgagaaggtgaagaaaaaaacaaatccaaattaggggtgcaaattcaatgagcagcatatagatcaaatgcaagattataatgtaggcaaattttgctacaggatatcgcaacttcgtggtattagctgtgggacaccgcacaaagtagcttttggggaaagacagtctcaaaatgtggtcatttgccaatgcacaccgcagacattaaaatattaatttctcgttcaataggagagataaacggtgtaaaaggtcaaaaatgctcctaggcccacttgtcatattgttttcccacacctaactcccggccatatccttcgatcaccgccagcgaccaccccgacaccgacgtcggcaacggcgcgaccgcaccaccattactacttgttctccagcaagcagctcaactcgttcggcgccacggccgtgcttgccttctccaccaccgtgccgctccttgcgctctacatcctcgacagcctccgcttaggcgacacggtgggtgtcaccacggcgtccccgcacgcgttcctcctcgccgcgcagatcttcaccgagggcctccacgctgccgctgggtaggtcgtcgtgctccatctcggcgtgtattggcttgtgtattgtgcgtctatggtgggtgttctctctctccctaggaggccttgtatttataaccatagatgccccattgtctaagtagaactagggagtcaagtatagatacgatccgagtagtccttttcgtttccatatagaactttattggtccttccttatctgaaactccttctgtatacgaggtatgattccgtataagacttggtatatggtgggtcccgtcgagcttagtcgattactattgggtatgtggtatccataacgctgacactattagaatataatccacttgtcaagtcagagcaaagttttgtattatatagtaggaaaaacttataagattacaacattagaggttgtaacctggcaaaaagaaaagaaaacaaacatgccaccactaccacaacacaggatggcagctccacaaaaaacgtgagagggtactagcactaagctgattgctgctaagcttgaccgatcgccaatagacctaagggggtcataggtgccccgccaaacaccgactccacacagaagaacgtcaacgtacgagctcccggttaaactcatgtacaggggttgagaagaggaagagagcgagagagaaggagatccacttggacctacctccaaccttatggcaacaaccaagaaatgtcgatgattaaactgagagaaggcggcaacagtgaggaacgaaagacctcctgggcaatgcctgtggggaggtgacgctagaggctccaccgtcacccatgaaggatgagaaagtggtcgcttgacaatgccctaatagagggtcacgttgctagaaggcatcaccgttgctggctcagggagatgtcgagctaagctttcacctgcagaacccacacccacacctatcgtctccaccttaaagccttgttacccgatcaatctctgctagcacataactccgatgcaccaacaccccaacgccggctagctcattcccgccttcgtcgggtctccacgtgccaaagtcgcctcccgcacccatcggtgtagctcaccaccgacaactgcttatcctgcaatccatgccacgaccaccagcctccattgactcacccgcaatggtcgcctacagctgccggtcgtgctggcctccttgctgtctccaatgtagtcctcttgtcgcgccggctgtgttagcctcccggccgttgcccgtaccctcactggccgctagtggctatcaccacgcgggccttcagatacggtgcggaggtgctagatacggatgcgaggactccagatctagtcatggcgacaccgaccactagctaccgtccctagggccatctgcgggagcgctagaaggtgtcggatccaccgcctgcaccgccctttcttcgtgctgcgtgccacactgtctccgcgtgcgccagcatgccgccttcttcggtgagcacaccattgcgcggtgtttcccccaagccgtgaggtggatgagaggagagagacgagcggtggcggcacctagggttttcccccgagctaccattgggatgtaaataattatatccatatatgtagatatacgagaaatgaatttatatttagaatagagttacataatttgagttggtcaccaggattctatgtttgcactgtggggtgtcgaactagaaaaatgatacgttttgattagtgttcttctctatgcaaacgatgagttcaactcccccgtcttataatatagcaacataatactggatgaaatatatcctaatatactacgaatctagaaagagagatgcatatcatctagtactagcatgagacagagggagtatataattataagagcttgtcccagctcatatcgttgtaattgaagcctgggagagttcgcgtctatcctaattcattttttaattgtaattaattggctatgtgcaccgtgaacttagtgcaaaggtcggaaatatatgctttctataaagtttattaagtctaaaactcaacatgcaaccataccacatcacccactagcaataattacatatttaatcacatgtaagtatacaacatgatctatattttatttaattctacaaaccaaaatgcaagcatatccaatcatcacccctcatatcatcatttacacaatattttaacaaacatatctatcacttttataatatttaacatatagttatcaatatgtttcacactaaagcacaggtatcatttgactgataaaccctgatgtttctcttttatttctttttactcctagcttgattgtaatatatatatatatatatatgtatatatatatatatatgtatatatatatatatatatatatacatatatatatatatatattgaatcgcttagaaattcccgcagcaaagcgcggagaatcacctagtgtgtgtatatataaatatacacttcctattgttttaaaaaacatgcatgtgacgaatgctagcaaatctgaaaacggcgtcccatttttcttcaactcgatcgactctagtagatcccagttaacttttcgcgttcccatatgtagataagtatatatatgaccaaattcgtgtattactgataatatactttgatcattctagatcaggaacacaaatttcaacacacggtcccggcccctttgcacctaccagtcaacaagcagtaccaggtcttcaccctggctgtctcttatcgagtgatcaattaatcctagctagtcccatgtagctcagtcgaaacttcataattcagctgaggtagatgaactcatattcgtcaaaggcaaatttcttgcgttccaggtaatctaataaagaccaggtgatcttctttgtggttgaatcgtgacaagtcgactgccgccagtggtcgatcgtaacagtcaactctaggacaggtgtttcgttgcctagcatagtgatgaacttactatgtcatataaacagaagatttagtacgtagctggtgacgacaaccatatatatcttgaagaaaaatctcaaacacgacgtagaaattaacacacggcgatcgagtatatttgggcagcaataactataaatagaaagccccacctccaaatgagatgcagacacacatctcaaggcattgtgcacgtagacacgagtgagctgtttaattgagacttcgtgcagtcgtgctcctatcttctcattaggatttaacttaatctgatcagaagatagtatatgcacacgtgagtgagtttggcggttaaagtgcggtgacagtctgagagtgcgtgcgtgtagttttcaaaagaaaaaaaaagtgcgtgtttcctagttgaactcgtaatagaataggagtagtaaactaaggatacgtggcactgatggaaggcagccgcggtgacaagggcaaggtagtggtggtgatgggcgccacggccaccggcaagtccaagctggccatcgacctcgcattgcggttcggcggcgaggtgatcaactccgacaagatccaggtgcacgacggcctcgacgtcgtcaccaacaaggtcaccgacgaggagcgcgccggcgtgccgcaccacctcatcggcggggtgccccccgacgccgactacggcgtcgacgacttccgccgcgacgccgcgcgcgccgtggcgtccgtcctcgccaggggccgcgtccccgtcatcgcgggcgggtcgaacaggtacctcgaagcgctgctcgacggcgagggtgggtcgttccgcgagcggcacgagctgtgcttcctgtgggtggactcccgcgcgccggcgctgcacaggtacgtgcgccaccgcgtggaccgcatggtggagcaggggctcgtcggcgaggtgcgggggctgttccggctggacgacgccgactactcccgggggatccggaggtccatcggcgtgccggagatggacgcctacctccggcaggaagccaccggcgccctactgacgcacggagacaagtacaaggtcgcgctgttggcttccgccgtcggcgagatcaaggcgaacacgtggagtctggcacgccgccagctgcggaagatccaccggctccgcggcctgcccggctggagcctccgccggctcgacgtcaccagagtgctggagttgaaggtggaggcccgcagcgaagcggagtgcgccgccgcgtgggaggcagacgtcatcgcgcctgcggcgcgggaggtggggatgtttctgcatggaggagggaatgtggtggagagcggtagggaggagcagccggtggtggtagagaagatggaggttgcggcagtgggtggtgccggtgcggcggcggccgcggagaagtggtgtggtcggcggttgctggagacgacggcggcgtaccatggaatggaggcggccgcggcagtttgaccagttaataacgtcggaagagtagtacatatatattcatgacgtttcatggtttggtttggttaggttagctggcgattattttattaattaattgtttcattttttaataattgttgtatccatttaataaactcaacctgaaggttgattttcggaatgtaagtttgcgtcacctcttctcaatatactggagaatgtcagctcatttttttcatcaaactcaaacaattataaaaaaatcactaccgtagaaaggcaacaagtgccggttgggaaaccctaattggtgctggtttttccaatcggcaccacggaagcagtatggatgacactggtcatcggtgccaccaaaaaccggcacctatatagtcctaataggtgccggttctaagccaaaaagacacgtggctactaaattggtgccggacctagctaataggtgccgattctaatgtaaagagacacgtggctgccaaatagctgccgtctggtaatgaaaaatcggcacctatatgttgggtaaaaaaaataaatattgcaggaaattcatccatacaaccctaattccatacgaccccaatttcatccctaagtcaaaattcaccaagtctaaaaactcatgggtccaaaaattcctatctttaaatcctaaacatttcaatatatattctaactcaaaatatgctaagtttaaatttcctaaatcaaaagattgtaagtctaaaatttttgaagtctaaaagttgtgggctgcggcctgctaacttgtcaaggcctagctcgttaaggctcgcgagcagctcgagctggctcgttatctctaacgagctaaaatcctagcccggcttgttagaaaaatgaagccgagccgggcttgtcacgagccgagcgagctaacgagccacgagcttcctgtccacccctacttacatccattgtaaactagagttttggagtccttcaccatggttgtgatcttgcgatattccctattatcagtgccaaacctctccccatcgcgcagcatctgatctagaataggttcaccatgatcgacacacgtttggtcctcctcctcctcgcagccgtcatttgcatcatgcccgtgatagttgccggcacttccctcaccttgctcctcctcgccaaggaagttgcccacaaaaccccttgtaagaagatgtgcatggacctgttgagccgaaagttgtctgtcttttttgcaatcatgacatggacaccaaatttattccagtgcatcaactaagtttgtgctggtggccacggcaacgagagccacgatccgctgtagttatccattccagatccattacattcaatgggtacctgcgattattatcgtttattacaaaccgtgaaggaaaaaacaatgaagatttcataatttacaattacattagaataaaaacaatgaggaatgaccattttatcctatgataaaattgagatttttgtacacacccacgtcacaatacttagatattcatggctaacgaaaatataaaaaaatttctatttttcgtcaatgcgaaaaaatatttggctaatgtgaaacactaacgacgatggcatagatggaataaaacattaattcaaatttagcataacatccgagaacagatctacgaatgactgatggatccatacaaatgactagtgcattttacatgtattaccacatggcaattcaattcaacgagaaaatgtgaatcggggtgagaaataatgaatatttaccttgtaggcttcaatcttcaactaaaacccaagaaaaatcgagcaaaaccgcttccacctcctctagccgatcgatgggcaccctaagataaatttgagataaatcaagctgtcaatggacatttccgtggccttaaaatagtttgactagcattaatttgactaacgaccatgacatagatggaagaaaacattaacgcaaatttagaatttcatccaacaatagatttaatgagattaatcgagtggcaagggagggaatacatgtactgctgttggaataaaggtgctggttcaaaacccaaaaccggcaccttaatttctcttgtcaaccggcacctatgtgtggggcccaccaacggctaatacatgtactgacaagcattgttggaacataggtgccggttctagacccaaaattggcacctttgtcttaaaatcggcacctatgtgtggggcccagcgacgtctaatttgggagggagaagattaaaggtgacggtttgacggttttttactatgaaccgacacctttctctgacacagattttaggtgtcagttttatttaaaaaccagcacctattgtacataaaggtgccattttttgaaaatttggcacgtgggagcaggtgcataggcacgaaaggtattataggtgccagctttacctactccggcacctatagtgccgacaccgtaaataatacgattgactaatgtaagatataccggagaatgtaagtctcccgtaactttttttatacaaccttccttaccgagctctagctggtaaccttccagattgcttaataatgttgtggtcagagtaaagccatagacgcaaaacctgtatctggtctagacaagagaaagtacaagtctataatctctctaatactgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcaacagcggaaaaaggcgatcctagcggggcttcagctccactccacaggcaaaactcaactggggtctgagccttggtcttctaacttcgtcttcagctcagaagcactacacttctgaaaagggggaataatagcaaggctgagtacaaccaccgtactcagcaagccacaccaatgatgcagacgtgcaaggggatacagggatggtttgtggctatttgcataaaggcggttgtaaaacattttattgagcaaaacagtaaaactgttgagtaattaaagtaacattaaaatctccactgatcaacgctacaccacgttgaacaggcccaaccaacccacctggactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacatcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggtaagcactgtaagtcttccagggtttcccgtgaaccggtccttaattgccatgggtgcgactcacaaaaccatgcacccacagcccaccattcagtcgcattttagttggataagcacgaccataaaacatggccaaaagtctcgagcacgcggctcaacaagatactagaatgtctaaaactgcaattatcccatcgactgatctagtggtaattaagcatggctaagcataaagttctagctaggtcacataagtaacacaagctagtcgatttattacccagggttgacaaaggatagatatcaagtaaacatggcacaagcgagcagataggtaaaccctgatcccatgtaattagcaaaacatgcatatttatttgtaaacggtaaaacatttataaattgggatcaacatgctcaaggggaatgtgtgacttgccttgcttcctcactttgatcttctaaactcttttcctcgcgaccgcgatcttccgaaacgacggattctacacgctggcacgcaaaacgaggaaaaaccctaataaaaaccaaggaaacagtacataaaaagtaaacaaacatgtagagcttaattttagatgaattttgaaatttgaatggctcaattcggagttcgaatgaattagatatgaattttagaagttttgagccattttaatgaatttctagaattaaactcgatttattgcgcaattattatttatttttacaaaggaaacggacctcgctgacgtcagcaaaggggaggggcggcgccggcaagcgggccccacacgtcagcgagtcaaagggggagggcgcacggtggaccaagtccacacgtggcctcgggggcacgtccaccacgtggacggcccagatcggcccgagccgatcgggcggccgaggggagcggcggccaggggcacagcacggcacaaggccggcctggtcgagcgatagcgcgcggcggcgtgcggccagacgaccgccggcgacagcggcgcgtcgcggcagcgggcacggggagcggcggaggagggaaaaaggagaagggacggtggggattctcaccgaggacggcgacggtgagacgaccacagggaggcggctggcggcggaaaggatggcggcgactggcacgagaggcggcgggaacggcgttccggcgacacccgaccatggcggagacgcggccgagggccggcggggccctcgagatgacgaagccggaggaggtggcggcacaagtcggcgtcgaccggagaggcggcgcgacgcggctagactcggcggtggcggcggagagagatggtgaacgcggcggcggcgttccaggggcagggaggggaaacggagtaggggccggggtgcggcgaggaacggcgatgccgatggcggtggtagcgcagcgcggcagcgacgggagcggtggtggcgcgcgactggaggtgacgagaggcagctgtggctcgggtgcacggtggatgtggtgtttcggcggagttttgtggaaacggagcggtggccggtgtgcggcaaagagcggcggagccgacggtgcaagcggcgcggcgcggcggcgactaacgcggcgggaaacggcgaccggagtttgccgaagtgtggcagcgcgtgggtgcggcgtggggagagcgagggagagtatgccgggctcgggaaaaaaggggaaacggacgaggggagcacggggatgctttttatgggctcgggaaggcgggatcgaggccggacgtggcggatttgaagcgacaacggccggcgacgtgggcgacatcgtgggcgaagtagggctcgatttggcgccaaaaattggggaaaagtgggggatttggtggaggaggtggaggggatcgtgcccacgtcgttggatgcgagctcgggtgcgggagggcgccgtattttgcggcgacgtggacggcaatggcggttggggtcggccggcgagaggtaggaggaggagctgacgggtgggaccgccggtcccacctgtcggcgaagggagagaaggagggacgcaaagcagacttttgcgagcgggccaagggagaaggccggcccgagagggagagaggggggggggaattgggccgaaaggggcccaaagagaggagggaggattttatttgttttctttttattttaattggttaaatgatcttcgtgactttaaaactatttctcgagctccgaaaattcacggaaaattccggagagtacattagggcacaaagaatattacaaaatattcccggccattgatttttaagggaaaatttcaaattctcccattattttacttgattaaattgatttatcttttatttaatttctagaaaatgtattattaattgatttttattcccgaacgaaaatcggggcgttacagcacagggtacacattttttattatgtgttctatatgcatttactcattgagaattagtgccttcaacccattctactcccctctcatgttacttgccccgtcataaccttgccctcttatgtcttgtaaaaagttaatgtcagacaagacagcacaaattgagttcttaagagtcagtgaagaagtgtccttataagtcctttgttgacaaaccgaagaactattgccatctgctcttttttagatttatctcgagcttcatcaaccattatgcaatacttgctattaccaatttcttctctaactgatttttgcactttttgagcaattatgcttaggatttctttttggacatcggatgatgtatacttttcatttcttggagaattttctagcacaacttctcgcacatctttgctatatgaagccaaaagcttaaccatttcgagaaaattatctcgatttaacgaatttagagattcattatggcctctaaatggacacccttgaaatgttaaccacctacaaggacataatcagcacacaaacacaaggctattagatattataatagtatagcctgtagagtttagatgtaaataatgtgcaaaaaaaaaaaagaacaactcatataattatctaatggattcaatggtagtcgtaagccttagtcttgctccttccaccaatatatcattctgcttaaccatcacctcgtcaatgtgagccataaagttttttatattattgtaacaaccaactcaaaagttatgagcagaagtggcattccccatgtgtttcacaaaagcacattcttttccatcattaactttcttccattttgaaactccttcactgtgaaagtaactaagccgaacttgccaactggttctttgaaaagagaaaacatggcaggcaataagcacggtctgtgtgtggtgaatactctagccaactaaattgtttaaaccaattactttggaatcgacgagcatggaatgcaccattcagtgggtactcttccaagataaattggtatggcccctcagatatataaaatctcctaccatcatctcgttggtcagcagggagtgttgggatacgcataagctacgatagcataaatcaaaattttctaccacgtaaactaggaaccatgcaagtattagatagatcgttaccactcgacgcgctgcgcagcgaaagaaagcgctaagaaggcgaaggaacctcgcgatgtagcgtacgtcgatgtagaggaaatagtcgatctcactggctcgaccttctcctcctcgtgcgttctcctcgccgtactcctacgccgatcagcaccgcaaaccagcggcccctctaccggtatccacatgtacagggatggaacgccacgcgcagatgtgctagcacccgcgcgcggctagggttttgctcggggaggggagtggcggctagggtttctcacgtgatgcaataccttcgccggtcacacccctcacgaatatataggatccatgactcaggtctccaagacccgtaggactcctattcggatccctaaccgaattaagctcattttggatctccatccaatccccttattccggcccattaagcgtgcgaccctgtaggttcatgtacactcggctgtaacccgaaaactccttttcgatccacgtgtcaacagcggcccctagcagaacgtattgacccaccaggcatacataaagatcatatcggctaaacctctagtgtatacttgtatgaacccctttgcctcacgatatcggttaagctcaaggctagatatgtgtcatcctctaataactcaataattcacttgaacctgtgatagattatataacttgtgattgactcctcaatcacctttggcatggccatacgcttccataatctatagcatcgaggagcccagagatatctctccataggaggggcaaatcccatcttgattattcatatcccactacatgtttcgtagcatacccgaaaaatacttttataactacccaattacggagtagcgtttagcaatccctaagtaagctactacacatgttgagaaccatgataatcacaggtctaataattaaacaccaacactaaatgagatcactgatgacacaacacatatagcccttgcagtgtctcatgttgggtctatccaacaacatgttccccaacatgtgtctacattattaatttggtatctctatatcatgatccatgagacatgatcatcaattaatacatgtgctgatcatttaaacatatttgttccacatacgatatttgatcagggattctttagaaatagtaacaatcaacataaagagtctcatgaaagaatcacatattcattaaccaataatgagttatctatttcaagaaataatattggataaatatgtaaacatattatgtgatacaatcttctcaatgattacctctaaggcatatcactaatagggagtgcggagatttgaacatgtttacctgggtccctttcaaatgccgtagttacaattccttgttcagctctaaaggttcagcactgttctgattaggagattgcagattaaccggatcaacagcttccacattagttgggttaggatttttcaacagagcctgcccttggagccactggcttgtaaaagcaatcaatcgttgttatcttcctcttcatcttagctaaacacctagcaattttgatgtagctgaaaatataaataaaggaaaatcacaaaattgattattgattctgctttaccggatcaaggttagtaaaactagagaatatagagtggatttacagggtatttacagtgttcgatttggggataacttaccaaaaagcagcagccaacagataggtggaacctggtccgtgagctcagaagatgtgcgcatgttctgcagaccacctctgttggattgcttgctcctagctcctgcttggtgcctcgagcagccactctatcggcggctggccgcgtcgccacgagactgcaatcggctgatcgccgattagcgccggacgggacgagggagcccggaaacgatgcgtcggtgctgcgtgcttgagaaactgaaggccggcccctagcgatcgcccgttagccatctcgcaagcgatgggacttcacgacgaagccgaggtatcgcttgactctctcccgtatatcgagactccaagtgctaatgggctgggcagctgcgcagatggccagatgggctttgtcgggggtggggaatcgttcatgggccattggggggtgccaggcccagttcggcaccccctatagcttcgacactgctaccggcaatggtcgagtgcaccgtcgccggccatgtcggacgacgagaaggtcctatcctcgcctcctgctccactaacgctgccatctgctgtcggtccgccgctgcggccgacggggcggatgaccttgtttcccacagcggcatgcggcacaacttaaaactactggccctcaccggctcaccgcttgcggctcacctccagctaaggttgtccatgatctgcgcccgctctttcctcctccccactggcgacaccaatggcgaagaagaggggggcaacaatgtcttttgttaaattctctctccagctctaatgaaagtaatagtttaatggttctattgttttgccgtaaattatcatatttttaaagtgtttttgagcaaattaacgttcttaatatgtctaccagtaaatatcatatttttttaatatcctgtagcaaattttgttaaataattattctaattctactatgttaaagaataagcttgtttgtttagggtaattttttaccaagccaaaattttatcaactttaataatgtcgcatgtatatttaatttgctactctatttttctcacagtagttcaaattctatacttaaatttgatattgatagcgccaaaatttattgacgacactaacaaaattttgataaaataaaaatgaactctattccaaacgagctcaataattcatatggatgcgagtcttacgccaccgtgaaatatcctactctacctttgtgcgccccaaccagccgctgtccactcggccgtcaacgacgacgtcgtcatgcgcgagagcgaagcgcacgagcgctgaccctgccgcgctgccgcagccaacacgccacgccaggagcttagcactgagcgcgcacaagagattggctggcatgaattagacacggcttccagttccaaatccgaaggaaaaacacagcactgcacgccccccgccccagcttgatgatcgattaattgtcggcagctcatctttccttgtcacatatcgcaagagaagtcatagatgcactagtcatatatagtacggctccccgggacccggccacggcaggcttagctgtgctgtgtgacccagcgagcttcgccggccggcgcctctccatctccggtccagtttgagctccatgtcagaattcacagtactgcagtggacctaaacgcgctcgatcaatcgccgtctaattaggccttgtttagtttagaaaaattataggtttagttgtcacgtcgaatatatcactggtggagaaatgctttctagtcccggttcataaccccctgtagtcccggtttttcaaccgggactatgaatccgggactaaagatcgctatctttagtcccggttcaaataactgagactaaaaatcaatctttagtcccggttggtgttaccaaccgagactaaagatgggagcatctttagtcccggttgataacaccaaccgagacgaaagatattttttcttttttttctgcttttaatattgaatattgatttcacacaatcccatcccatatccaaatcatcacatattacagaacatctccaaatcctcacacaaatcatctccaaatatatcacaaactcttaaaaaaattacatcacaggattctaaaaaattcatcacagattcacatctcacacaaaaatacatcacagattcacatctcaaaaaa

SEQ ID NO: 9642 - DNA, 26821 bp, Oryza sativa
aggagaaggagtgaggaggagaacgagtggaggggaagaaaagctaaggataagactgaggagcagggtcagacaatggacacgcgaagaaataaacatcgcgctcggcttggggtgatttttagtcccggttgtttataccaaccgggactaaaaataattggggcctgacacgacctgacaacctcttcaaccgggagtaaaaatgatctttagtcccggttggtgttaccaaccgggactaaagatcaaaaaatacccctaagcttttaaaccgggactaaagatgctttttagtcccggtttttattggaaccgggactattgtggaattgggccgaccgaccaaagatggtttctccaccagtgtatggacatatatttaaagtattaaacgtagtctactaataaaataaattacatattccgtcaggaaactgcgagataaattccctaacactaattaattcatcattagtaaatgtttactgtagcaccacattgacaaatcatggtgcaattaggcttaaatgattcgtcccgtaatttacacgcaatcagtataattgatttttttcctaaatttaatactccattcatgtgtctaaacattcgatgtaacagcgtgaaaatttttattttgtgaactaaacaggccgttagattatatagattaaatatcgtttttggacgattgagattaaatatcgtctgtgatgccatattttcaggtacatctctcaacatgtgtcttattaagtagctttgaaaattcatacactatgttagcgctgaaatgtccaaaatttttcatgtgaaatgtgcattatcctttgaagtagtcactatataaggagaactgatgcggaaaactatttattagcttcccgatttccttaaaaaaattgcaaaacaaccccaaaaaaagtcaatcagaagaacaacgacaaataacaataggctccacataagggagacttaattgccaatcgatcaaggtgaaaaaggtgactgaaatacgaggggggggggtatgacactactattttttagcaaaattgtttgaagaaatactggtctctccagaaaatcggttactgctattattggggaaaaaaatcaaattattaattttaaaaacctgtaactagccaccactgctaataacgagttgttaaccggttcttgagtttattttggatccaaactattaatatagctaatgtgtaactattcataatatggcatatagaacacatacatatacatgcatacattgcttatgaaacacgtttttacgagcggccagacgtcctatgtgcgatcaaagagatgcgaaaatcatcaactttagcaggtagatccacgttcgtttgcgaaaaccgatttttcttgctagcacccctaagtgacccccctgcaaaaagaattttggaaaaaaaaacattcacatcatacatgctttgatttaaatccacatctatgcatcaattcagatctacatctaaagagcgcatcagatacaaatctacaggcaatagaacatgcaaaaaaaaaaaacaacatcaatggcagatagatgtcatcgtagcagccagaaacagcgcgctgctggctgttgtcgtcactgcgtcgtcgcaggatccacctcttccaagtgcgtcctcacaggatttgtcttcgcctccgcctctcttgacaaccaccacagtgtgctcctcgacaagcttctcctgtaggtgcaaacgttcgatatgacaaggtgaaaaattttagaataggatctaaacaggactatagtgtttatacatgacatacaagtatgtaaactatttgatagcttctgggttagggatggcctaatccctcgtggatatagacagagggttaatgaaaatctatttaaaaaaaaagttgttgtaacgaaaagaaaaaaatctctcgcaagatacgctgatgatcatgtactactactgtaccttttgttggtttgaaattctgctgagaactaggggacaaaaatcagcactagcgtgctagcgttatcctaggtcgttttcgcgatgaattcaattcaattcggtcggtggagcggccaatttcgtaacctgcatctgtgccgacctatttgtccatcaagtaacttgaattcgataaatagcacgctatcaaggaacttgaactcgatagatatcgatcgtgctaggctagttaactactcgcagatgttctgaacatgtcaacaacattttaataacccctaaaatacatatatatagtagcatttcgaaatatgttttttatatcttttatctaaagttagcgtttagtgtgcgacctgtgctaactcatacctcttagccttttagcatgtgtgatttaaaaaagataggatgtgtttggatgaggcgaacctattttataagatgtttacttaaaaatagatgggttgagattaccttcgaagggaattattttttttaagatttgggttagctttacgtgaaaaaagtggcgaaccaatcaaaaccactttcccgctctcgctgacatacgagtcacgccatcccttttctaaaaaaaaagtgatcatttataatctcttaaataacaaaacaaatagctagaaccatcctatctaaaactagagataaacctaacccatcccaccttatataaaacctaaaacacgcttagctataacctattagccgtatacaccaagtgcagatgccagaaatatagtccagggactaaactttagtacctatcatatcggaagtttggacactaatttagagtattaaacatagactatttacaaaactaattacataaatgagagctaatctgcgagacaaattttctaagtttaattaattcataattagataatgtttactgtagcattacataggctaatcatggattaattaggctcaatagatatatcttgcgaattagtccaggattatggaatgggttttatcattagtctacgtttaatacttctaaatagtgtccgaacatccgatgtgacaggggctagccccatccaaacagggccacttgttactattttttttgctacatcaacagaacatacataaagccaagaacatctcttgatttttgtctagttaacaaatttttcatgttaacagaatcttcttctgtgctctttcagacccagtgaaccagccagcagctagaaaaaaaagcttgattctttcgatctctatttttcggatataggaaaaaaggtgcgcgtctttttgtcccttttgttctttgggcaagtcaagtcatccactttcctaactcaccaacccaacaattttagcttaaagattcaactacgcacaaacagagccccaaaaggagaaagaattacttctccaaacatacttcacaagttacgctattttctcccctcatagttgcttcatgtcaaaagaaatcgaacagtgtacaatcttttagagcaatttcttcttcaactttgctaatcgatccagctgaagcaatcaaattacacagaaaaaaaagtaggataacaaatgaaagtaattaattaaattaactatattctgaatattgagataaatagtaggagaaaccaaactcaaagttttattaattagaggtatgtattaaggaccagaaatttcctttgggaaggaaacaaaaaggggctgggatttacatgttcatatacactccatacaagatcttggatcatctgccctaccaaagtaccaaccttaagtgcacagttttgttttcactaacttaaaatccgaaaacctggcacttatagaacacctctggatacccatccatcgtccgattcttaaccctaaatcctgaacccgaaaccataaaagcgtcacacccctacataaaaaatgcttctgctatagctgcagattgatcatctcagctcatgagtgattcataactttgctaatcttgaagcataaaaaagagaggaggtgtcttgagctctcaagaaacaaggagatttttgttccttgtggcacacagctgtggtgcagggagctttgagattcgtgcagcggcagggggagggcgcgcgaagctttcacgaggcgtgcatctggtcgaggaggatgacgacggccatggcgagcgccggctcgaagcccggctccaccaccagccggaacacgtccgggcccacggcggcctccttactgcacaccgccgccacgcgccgccgctgctcgccggcgctggcggaggcgaacacgtcgaggcagcgggcggcgtacgagccctccacgtcgtaccggcaggcgccgctcggcgcggtcgccgatccgccgccggcggcggcggacgacgacgcgcgcgccggcgacaggtgggcgagggacttggtggggcgcaggctgacgtggcgccgcgccgtgaacctcttcggccccggcgccgccggcgacgccgcgtcgccgtcgtagatgagccactcgtccgcgaagctcagcttctgcaaaagacggaccacacgagaacatcagcatctgcggcggccggccatggccatggccatgggcaccaaaaaaccagagcaagaattcagagaccacataccttgcggcggatggtgaggagggcgcggccgtcggcgtccatgagcacgacctccctcggcgaccccccggcgtagctctcgacgcggaacacgaggttccccttgccgtcgaacaccgtgaaccccttcccgttgaacagcagcgaccgccgccacaccgtcagcgacaccgcctcccccttctcctcctccaccaccgccggcgccaccaccgcgacgttggggtgcaccttggtcatggccgctcgctctgcggcgcggcggagcaggggaggtcaaggacaaggagaggagaaggcgaagcgagaagaggagacgagtggtgatgagaagaggcaatagtgtggcgcgttggatttataggtgggggaggcgcgtggacggaaatgcccctgcgtgtttggggtaattacggggcatgccatgatagagattagtggcctctttttgctaactgcgagcatcaaaaggtcaaacctgaaaaggggtggttaatgggtggtgtcaccactaggctagtattattaattaatgaatagttcacttcgaggttgataattttgttttcacctgcacgtacatgtcaccttgcacaaagtatataaatatactaaaattaacatttcacctaacatgtgcatggtatagcagatgcttatataaaatgtacagttacaaaaaggatttaatctaagcaagaggttaatatcttgtggcttcaattttccctaaatatgtgtgtttacttttttcacaatttttccaaacagttcaaggggttctcctttattgtggagggctatatgtatatatattcttcttggtgatgccttttaatttgttgcctctttatgtggtaggcacagacttggaaaggagtggagggaacagatggttgtttctgtttcttgccttctccatttagaggttttaaagatatttagattttacacgtatgtgctagtatatatatttccaatacttgtgcaattatctttaatatttatagtacatcatatcttgattatctggaagttaatttttgtcccggggagaaaaggagagattttttttctagtctgaaattctccaagttaatttcatattggacatgtgcggtcgcacactctatctctctcaaaagagacagtatttcctttttggcaattatataagagatgcacgcagccacaaacacaccctttaagacatcctcaagagatagaaatcactacaaatcacacaatattctatttaaagcataatctagtcacgggctcacagcaggtgctctttttttaaaaaaaaaagaaaagaaaagaaaaaggaaatcagtttgtatattcctctatattattgcaatatatccatctgaatttagcattaataaataattatatcaaacaggcctaactggtaagttaatgatttgatttttttttgtcatatatagcgacctagctaggcagctacatgacattggcctgaaagcgttgttttgctactttggcaacgtggcctggaaaaaaaaagacaatctttgcagtaaggtgatggaagtttgtttgcttgtttttgttttaataaaaaataatctttttcctgttaggatcgataaaaggtacgtaattacctagctatgtaattaatgtacataatgccatatcattgatgctttaaacatatatataaaaaatggcacaaatcattactaaaaaattgtgtgcctctttcaagttatcatcaaattttgtacacccacgctcttggaacccacatcaaacacggccgacctcccaaaaaaaagaactaatgcaactagagaggtcgtatgtgggtaatatatccatacacattaatttaagtacggttttttggtagcatatgtaaaaatatatttctgtagcgtaataaataacggtgaactatgcagtgactttctcgctaatgtcttagaattgcttatacggtgaacagtcaaacatgtttaaaaagtcaatagcgttaaatatttagagatgaaggaagtagaatgtacatatgtgtatttataagacgagtgaatatatggtcatctacgctgtttgtactgtacttaaaaaatatcttttgcttgttccaaagattttcttttcttcaaaacgatgttaccatcaatagagcaaaaaatctatactaccggcgcatagcagcggcttcaacctttcacgcatggtcaaacacacgatagatggtgctccatatatagtagacccaattcctggccgagagagagccacgtgggacgcggtaaacacccaattagtggtgtaaattaggaagggaggtgttaattaactaattaattaattaaattaagattagccgatcgagtagctcgatcatatggctgcaaggccctcgtagcttgggcggctcaagctggggcccaaacccggtcatagttagattaattaaaacgactcctaatcagttgattaattaattaattaattaattataaccatggctatgatatctttatctggctcctctgggccggcttagatcaccatcacattagatttaatcatcaggatttgttaggaaatcatttgccgtcgacatctcggcgtgatgggaagaagctagctatgtaagctccggtcactgctttggctggtccttgcattgatcccttctccttgataatctctgcaataattgtcggtttgtgtgctaatgacgttggttggtggttgttaattacttgggtgtgcaatggacccaattaattggtaattaattagtcaacaaggagcgttgctactgtggagtaatttgtttcttctcatttcagattttttttaattgttctggaggacattaattaattatagatctagccagcaaatgcaagccatggtgcatgcatgaggtgtgttttgcttgtaatattattcaatcatgttatttgttgtttgtggtggtgattgaaacctaggctggaatttcatgacgtggctttggaaatcttgtttttaaagtttggcagcttggaaatttcttattgtcataatggtttctaaactttgtctctcgtggtggttgtcataactttactgctggcaacgagaaaaccctgaaaaatatgagccatctttggtcttcatatatgactttgaaaattaatttatactaaaaatctataaaaccatgcataaaaaatataatattgtgagtgtaacttttgaggaaaatatagacatatccaaaataatatgttttcataaccgtagggagtagagatgtacagttttatataagtaatatacttaacatttgcgctttattttaatttataattagtaaaatatataagtattctttattaattaacaaaaatattgagtattttatctgttcgtttggaaaatagaaacttcctatcctctttctcgaggtaaatctttctcgaggttttacctcaaaaaaggtagtatttcttttgttcatctggaagagatttgcactttatctattgaatatgtaattatattttgtggatgaacaatatctaatactaaccgagcagatggcgcactaattcacagtattcaagtaaaatatgtttttacgtcactgtttccaacaggtaaaaaaaatgttttttcgtttcattcatcgttgccctagttattcaaactagcttgcttgtctagcttggcgattttttttctcgagcgcttggctattttttttaaaaggaaaagagttcaggattgatgctattttttttcttttttgctattacgattatgataattctattgccatcatatatctgccgtactgtaagagaagataatcagaagcaaaatttgtttagtgtatggtgggaaatatgttgttatatatatcctcgaaaatttccaactcatgtagtgagcaaacagatcaacatgtacctacaagtctaataagcctattatcacaatatctttttgtcagcatacatatcacaaaagtgctgccttttgttctctcgacatatcctctgatggaccatctgtcccctacttttctgaaggatatcctttatctactgtagagcatgcagaaaattaaactaattaaacaaaacaaagatattaacatccagcatcatcagcagcaaccagcagcaaccagcagataagggagagagatcgatcgagagatcagagaggaacagaattgatgcaataatgcagcggcgtatcacgctcgaagtttggaagcaacaaacagatagggtgacccatgtcattaattttaggccatttggcagtctacaagagagaggcctctgacgaccgaaactgcaaaaggtagtagtagattccagctttttgggaagaagagccaaacgggtaataggattgtgacatgcactaacacgtcgcacaaggagtatggttaatttggttatgggcatccatggcacatggattatattcaacgagtttgtggcaaaccacgcatggagctctcctttccggccttgcagaaaaagttgtggaagagaaagacagcgatcgagaatgatgaaatgaagaattggagattatgcgtcttcacgaaggaatggaaaaaaaaaaggaaggcattgagaccgacagggagtgaacctccaattaatgtatctcatacggtagagcatttgagtccaggcgtgaacaatgatgtgatgtataagttttgtgagaatattgccttgtactccctccgtcccatcttaagtgcaaccataaatttccatgctcaactttaattgtccgtcttatttgaaaattttttataattagtatttttgttgttataagatgataaaacataaatagtaatttactagtgacttatgcttttattttttttaaaaaaatttaaataagacgaacaatcaaaattagacacgaaaaaccataactgcacttaaaatggaactgagggagtagaatttttgacgaggtaaaagtacgccagagagagtggatagagaagtaagccatcacttgggcaggaattaggctgtgtttgaggagaaggaaatagagaagattgggaagatatgcaaaacgaggtgagccattagcgcatgattaattgagtattaactattttaaacttcaaaaatggattaatataattttttaaagcaactttcctatagaaaatttttgcgaaaacgcaccgtttagtagtttgaaaagcgtgcgcacggaaaacaaggtacaatctcccctatctcccctgaaagaacgcaaccttagtctttgtactccgatcccttaattatttagtatgagatattttatgtttattttaaattaaaccttaagtttgaacaagcttatagaaaatatagttgcactttcaatgcaaaacaaatatattataaaaacatatttaacagtggatttaacgataaactaatttggtaatgtacgtagatatatattactatgtttctgtaaactcataccacttagaaaagctcaatacaccttaattataatatatgaaacgaagggagtagtgttatatcatctatatgatatgtctattcactcaaacaattagtcttatatatacttgaaaaacaactaaatagatgctaacatgttatacgaatagtactgtatattatataatttgacaagtaatggttatataaataatagtattgtctaaattattcctcacgtccatggtagaatgcaggagaattaattcatgttattctatacatacattaattaattaggcactacgagaaagcttttaggttaactagaaagagttagccattgattagatagaccatatatactatcgtaactagaatatgtgttagatacgcaattttaaatgtcgcagaccctttcattagtttttctaaatttaatgagtggaaaattcgaaattaataaagaaatatgaagtcgtatccgtatgaaaattcagaatttagtatttcattaatgttataatttcaaattaataattagcaagttgtaatagatatggactctttctttaatttggtcaaagtttattaaattcaaccaaattttgttaaatttttaaaaaaatttagggaccaaaagtatgaaaattcctaaaatttttcgaaatttcggtccgaaacgaaattgacaaccctgatataagctagtggcgtagctaggatttagagtaaaggtgatccatctatacgtaataagtaaattaaaagggtggtccactatataatttttattatattaactagcacatatactataatttcaatctcgatcaaaattttaggtggtctatggcccacagtgccatctagctagctacgcctcttatataagcccgtgtaacgcacatctcttgacaatttttttttgaacgaatatctcctgacaatttgttcctgctaattgtactccctccatcccaaaaaaggtaaaccctgggtttccatgtccaactttgattgtccgtcttatataaaattttttaataattcgtacttttattgttgttagatgataaaacatgattatacattgtgcgtgacttgtctttttaatttttttaaataaaacggacggtaaacgttgggcacggaaaccaaggtttgtcttttttttttaaggacggagggagtatatatctagctagctagctatctttacagtacaggagaactaaaacgtacttagtatctctcctgcaaccagatggttttctggagaagtgactcaatgagttgatgcatgcatgttacttcgattgtaccatatgcttccgcggaaaagcagatgacacgcacagttgaatgaaggactcaatacattaccaccacagacacaggtccatccagattaaacttttttgaaaaacagaatctcctactgaacgtgggcacgtcttctactgaacgtttcatgtgtctttatttaattcgcacatgtcgatttgatcatacggccggtaatatcaacacgctgttcacaaatcagaattcaaaatatcactgaagccaaatctgccaattattaaaaactagacggcgaaagctcatggccaagcgaccattcaagcacacacccacatatgtcttgacagtttgaggcgaacagaaacagtgaataaactgctactacatgttactccacgcaagccaagtcgtcaagaatcttgcttcttcttcttcatcagagatatatatatccctctcgatcgagatggaggctggcaaggcttggagagtgtgtacgtacgcacgtagctagtcttgttcagagtttttgtttttgtttttgttttgttttgcagcgagtgtgtggcgtttccgttggtcatatcgccgtcggtaaccacacgtggggcgatgcctgcatcgttgttcttcgccgtcgctttgcttagttgttagctcatgaccacttgttcccgtcggggagctagatagtatactccactttctgtggataccaaagaggatgtcagattataatcaaaataaatcttatcaattttggtaatgtcaaaattttgatataagttgacaatattattaaaattttaacatgatttcttatgtatttttgaaagtttggtaaaaaagtaaatgcatatatctttgatatttttttaaaaaaagatatggtttgaaataatatcaatctgaacaacctctagctactctacagtgaccaacttgccggccggctgggaagatctcaagctccagcaagcaactgtatttttctacttgcctgtcaatctgacttctaatgtaagacgggttaactataatttagatgagtctcctctataatattgtcctctatcactgacatataggcctgttaatcatgaaacccacttttatccgttactcaaaattatagggctagctctacagtagaggatttgtttccctgttatttgtattggctttaacaattagttgacatgggttcaatgccaaatatgatgatggtgattttcatactaagttgatgtgataattatatattttttcctttataattgtattcttttttcatactaacaacctcgctatcaattgatttaaggagagaagtagtagacactatgtgtttagcatgcatagctcaaacctaggtagccacgtgcgcatgacgacacttctggccaattgtgctatgcacagatctctactatggaatttaaattgaaaaagaaacagttaggacatctacaacaaagacacttcatgggtgccctcactaaccgaagccactacatgagacactattctcccaacgggggtactcatagctgggctcttcaaaatctcaggcaaattgatggggctttgaggttcttggggtcctttttcctgtcatcttctatggttgagttataggtagctacaacttgcctccaatatgtgtcaccttttctagcatttccctcaattagatctgtagagttctcaagccaggcactcacctacatatcatcaaatgctcaacatatacctaacaaatgcaaaatacacattggtaataacatcacagaacatttcgaggaatacatgttctgctatctaccaaaaggaaccaattgtcataaaaaaaatgcaactttcacccataatcagtcaacacagatattcttggatgctccatacataacttcaatacatcaaaagtgtgcaaatcaaggagccaattatttatagctaccaaaaacttttcatttatgtcaacaaaattaaacttcggacacatcataacttcaacaaaacagatacatatgcatgcatcacaaaggtttgtgcttcttctctatcaacaagacaatgttatgcacaaattttgacaatttgaccctttctaaaaactaattttacaaattaactgcggccaaaacttatttcagaaaggacccttttgttcagtgccaaatcgtatggcgctgaacttagacacctcagcgccaaatagcacggtgctgaatgtacattggcacgccgactcagcctctcatccatggtggcacggcattcaacgccagttgacgtggcgctaaggtgtctaagttcagcactatacgatttggcgctgaacaaaagggtgatttctgaaaggcaaaatttgctacaggacatccaaaaaacatgtaattagctagaggacaccatcaaaacgtgtatttgctgtagggcatcgcaaaaaactggtaattggctgctggacattcgaagcatcattttattatttttggaggaaagagagagagagaaatagttgtgtaaatacggttataccctttgaatttttttcctttttctttattcttttctttcacattctctttctctctcttctctctattatttcttcttgcttctctctcgatcccctttctcacatgcaggaggcggctggcgcagggtgatgtggggcaacggccaggtgtagcagcgcaggcaccggcggccagcgagcggcggcgcggcgggggcgcggcggcggctagtggcttgccgttgtcggcgtggtcgccgcccttgccccagatgagcgtgtggtcgtgcatgacgcgaagaaggaggacagctcggcggcgaggcgcaagccaccggtgccggcctccaggtccgcagatgagtttcggcgagcgtcgtgagaaggaagacctcggcgaggttgccggcgaagaacgacgacgccgggagggagacgagcaccgggccgccaccgccgcacttgagcgcctactccgacacaaccgacgtcccggccactcatcgccgagccgagcacgcagatgagcgttagcggccggcagcgcacgtcggcgtggctgcacgtaaacccctccccctcccctcttgacggcgaacgtggctggcactgcggccgcggccgtggatcgccgctctgctacccggcctctctgggaaggaggagagggagagggagaggggacttccatgtgaagcccgagttggagtcatttgagccaagggtaaacttgtctttaattattgtttctctctccttttcctccaaaaataataaaataatgctgcgggggtccagcagccaattaccagttttttgcgatgccctatagcaaatacacgtttttacggtgtcctccagctaattacacttttttggatagcctgtagcaaattttgcctttctgaaataagttttggccgtggtttatttgtaaaattagtttttggaaaggatcaaattgtcaaaatttgcgcaatgttatgtaggcaaccacatgtacatgaatcacactcccataaactacccataaagaagcaacattttctacacatgggtactgctacttctcatcatcatcagtttgcaaaacaactttttttttctaggcatcccaaactatatcaatcagtctcataaaaaaccacacaaacacacaaatttttctacacatgtttcagatctttatggcggtcttcgaatcgcttaataatctgagatgtgcaaacatgaaccttctgaactcagctaacatcgtcctgattccaaaaaaggaaggcgcggatgaggtgacggactacaggcccattagcctaatccacagtatagcaaagaccctctccaaaaccttggctttgcgactacgattacacatgtgaaccctcgtcacagtcaatcaaagcgccttcatcaaaggcaggagcatccacgacaacttcctctatgttagaaatttggcaagaagttgccatagaacaaggcggccaaagcttctcttcaagcttgacatcaccaaagccttcgattcggtgcgttgggattaccttttagccatgatgcaacatcatgggttcccgcagaaatggagagactgggtgacggccatacttactacctccacctcacaagtactgctcaacgggatactaggagaaaagatagcgcatggcagaggactcagacaaggggacccgctatcaccgcttctcttcatattggcaattgaccccctacaatggatcctctccaaagcaacggaactaaacgccataaccaagctaagaggcagagcggctcgcctcagaatctccatgtacgctgatgacgcagtggttttcataaaccctgttagagaggatgtctaggctttcaccgacattctcgtgcgttttggacatgcgacaggactggtcacaaacatgcaaaaatcgcaggtggcggcaatcagatgtgcaagcattgatctagactccatccttgatggcgtcccagcgttacgggcccaattccccataaaatacttaggactgccgcttctacttggaaggctgcgcaagacggacgtccaaccgatctttgataaaatagcaaaccgggtcaccggctggaggggaaaaaacatcgggccggcagggcgatcaactctagtcaagtcggtactgactgcgcaacctatctatttgctcactactcttaagatctctaaggaagccttgggcattctagatgcaaagagaagaaaattcctctgggcagggacgggggacattacaggagggaaatgcaaggtgaactggaaaaggacgtgcctcccaaccgcactaggaggactaggggttctgaacatggagatgtttacgagggccttgcgactgagatgactctggcatgaatggaaagaccccaccaagccgtgggtgggactagagacaccgtgtgatgaaacggacaaacttctcttcgccgcagctaccaaaataacaataggggatggaaacacgatccgcttttgggagtccgcctggctagacgggcaaagaccaaaggacagcatgccgctcgtctatgcaatttccaagaaaagaagcaaatcgctacgtgaaggcattgaaaatgacacctggatcgatgacctggagctaaatgggaacactacttttacagtggaactgatcagccagcttgtgtccctatggagcgcaccccaggacatcatgctaaaccaaaatgagtcggatcacattgtctggaagctctcgaatcatggagaatactcggcctcttcggcatacaaggctcagtgtctaggaatagtcggcaccaacttcaatcccctaatttggaaatcttaggcccctgcaaaatgcaaattttatgcgtggcttgtgattcaaaatagagtctggacttccgatcgacgagctacaagaggatggccaaatagcggagtgtgccccctatgccgtatgacgaagagacggcatgccaccttttagcttcctgtagatacaccagaaggatctggagactgacggccaactaggtggcttatcagcaattggatccgagcaattgggagccatgccaaagcgtacacgaatggtgggaaatgttagccaacaaaagggaagtgcccaagaaatggttgcgatccttaatcctactcatagcctgggaaatctggaaagaaaggaaccaaaggatcttcgagcacaaggaaacggcggcccccaaccttatggcaaaaataaaggaagaggcaagaacctggataatggcaggcgcaaggcgacttggagaattcttaccaacttaatcatagcgcttatgtaattttgtatagctcttttttttgcccctaggggttgtatttttttacgcctatatctaatgaaatagcacagtctcgtgctgattcctttcaaaaaaaaagatctgctcatgctcagcttcatccaaatcaagtttttttttttgcacctagttcagatctgggcctcaaatatttggaatgtgatcaaatatgcttgccaagcgtatgtcctcatcatgagtgtagtacatcctcgccttcccatcgtcttggctgactggatttgcctgcacacgctgcctcaccctagatatggaggccaatgtcaggccaccattgccggttgctagtggtggtggctgggtagagaaggggggaaactgagcatgagcgttggggaagtcgtcgtggggatgacaaaaatcgctttgggtggaggcttgaccgaaggggtgcaccagatcgggatccttcaagaaattgttgtacccacttgaccggttaggatccatgagaacaagctgcaacacacacacacgagaacacatccatcaagaaaatcaccaacataatgcgggagaaagaagaaaaacacgacgtcagcggctatagtttcacggcccaacccggctaggtctcccaaaaacttactcttgcggaacgacgacggcggcggcggccggtgatgcgacaaggcaaggtggagtaagatagggagcatgccgcagggcggaggaagacagggagtgcggcgagaggcgggcgaactgagcgttgtgtcgaggggtggaaggggaaatatgggggatggagcggtgtccacgggacacacgtctggccgccgcgcgcccaacacgtgcccccgcaccgtgtctcagcgaaaagcgaccgaggagcgcgtccctctgtgagcaaacgcgcgcctatgctgggagatggctctggcgcaaaaggaaacggaacgccgacaccgtgagccagggatacgagtctaagacacccatagcactttaaagagaagaaaagggtgagataactttacatgaattcggatgtaagctggaacgaaagcctttcagctccctgccattgtgcgaagatatcgttcttatttgacacatgaaagtaggggaaatttaatatcactgaactaaggagaaatggtggataagagcttcaactctataggcttgccatcattttttacagtggtataaaataaactttccttgtttgatggtttgtggttggaagggttaaaagttcacctatcacactacttaggtatccatatgtttaagtatccatatgatcgatagtggtgggtagtggcggatttatctttcatcatcactattagggtattttaaaggggtatgcatagatatatgtggatgctatatatgtattccaaaatatattataacaaacctcggttgatagttgagtaaaactgatacaaacaaaaatattggtatttgttgaaatcgatcggtgcaacttgactatttttattttctttcgaacattcatcagaaacataacatctcggttatgctgtcactgatgtcgtactcgtaccgtacaatatcacatcgctttccttgcaccggccttgccgtacttgcacgcagaatataaatacaaacaagcttaatttgataattttaagttctttttgttggagacttttgaagattaatgaattagtgatgtgcgtgcatgtatggtaggccagccaaatttcggatatattctagagagtagaatataacaaaaattgctgcatatatattatattgccaccatctgtatcttacatatattgtactgtatgtacttgattatctaatgcatatattcatcattgcttacgccattggacggtattacggaatcacaaatataactcacgtatacataattacatataaagccacgcatggcatactattttaattagtgcactaacaaatagttaatacctaattaattatacggtacttaattaccttgtttttacgttaggctcataagatcaacacatacgctggctaaaattaccaaaacctgagtagttaatttcatcaacttgacactttaaaatgaaataactggccagatttttgtaattttttacttctaactgcagatgtacggacgggaatgtgtttcctggcttaattcgacaacaaagaagtgggagtttaataatatcatccatgccttattaatatgataagtgcaccattagttgatgagtatgagtcttgatggctactaattcatttcctgaattctatatatatcttactcaattttatactactagaaatatttttgcaaacggccgaaatcggccttcccgcgcggactaggtcatccgcctgcgaagatgcaattttacaggcggcgcgttatatcgtccggctgcaaaattcatcttcgtaggcggcaccttattaaactattttaaacaatttcataaaaaaaatccttattcaatcttggagatttcgtaataaaatttttatacaagcacaaaaaaatatattggcaaataaaaattgcatttgtcatcttttgttaaacaaataagtattattgattatagttaagatttatttagttcctaaatactctaatagtaaactaagaattgtgctataatttgttgaactaatttcataattgtaaaaatctaaaatagttttggagcccttgtgtatatatgatttttaaattttgaaaggcttataattgtccaagatattcaaatcctagataaaatttttccaatttgaaataaaatataattttatgattaagtacagttttatttaattccgaataatattatgtttggtcctatattgttattatcattattatatttttttatatttgtactaaatacttttcctaggtaaccagtgaaaattataattattatttttaagccatttacaatctatacaaaataaaaatatttttatgaacagaacaaaatctggtccaatgaaaataaataataattttggcggccgacgatggcaggcaggcggccagcggcggcggggccgtgcccggcggggtgagcggcggcaggcgctcatggctgtggctggcggcagcgtgccggccatggctagcggcggcggagggaggcggcggcctgcgcgcgggagcgggcggcggccccgcgcggcggtggaggtggcgcggatgggaggcggccgcaggcggcgtacacagaggagaggtggcaagcggcgggcaatccggaggcgatgactttgtgatgattctgggatgattttggagataattctgtgatgtaaatttgtgagtgatttttagatgtttttgtgaatttgtggttgattttgtgatgtaaatttatggatgatttttagatgtttctatgaagttgcaaatgaatctgtgatgttgaatgattttgtctgtggatgaatttgttgttgagttcggtgcgaaatcaatatgaaagaagcaaaaaaaaataaaaaaagaaaagagaaagagaaagctccatgtggtgcttttatttttactcccggttggtgactccaacagggactaaggattcatctttagtactaggtattttaaccgggactaaagatgacgatctttattcccagattctttctcacagttcgttacctagaaataaagggggttacaaaccgggagagatgtgcatctctccagtagtactcgtttgaccgttcgtcatatttgaattttttaaacaaattagtcgcgcgtaaaatattatttatgacaattaaagtactaatcatagaaattttttaaataagacgaagattcatttcgaaaactgaaaaatgaaatcttcatcagatggaaggagtagtattttattatcgggactataatatgcttgtttgactgccgtgttgtacgtactggtgtaggcctagccgcctagacggctagaccgtacgcatgcaacactacatatatacatattccgatattatatataggctccaaaacataactatcttcgtttattagacgagagcaagctcttaaaataactttcataagttgattgcgtcctcctcgaattagtaagtgaaaaatagttgatcaaacaagcccgggttcattgctcttggagtcacacttcaatcattgaatattttggctattttctctttgacattagtaatatatatgtttacatgcagttgcgtaatccattgtagttagactttgtcgcctagaaccatatgcatatatgaagtacaaacacatcaacactagacgattagaatatacaatctagatatgcatataatcactggtggagaaaccatctttcgtcggtcggccgatttccacaatagtcccggatgcaataaaaaccggggctaaagatgatctttagtcccggttcaaaagggtaacgggcatatttgatctttagtcctggttggtaacacaccaaccgggactaaggatcatctttagtcccggttcgaatgctgtcagggcatgtcaggcccctctaggatctttagtcccggttggtaatggttggtattaccaaccgggactaaagatcgtaactttagtcccggttggtattaccaaccggggctaaagatcttagtcccggttggtattaccaaccggggctaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatgcaaatcggaggtgcctaaaaggtttgcaacttcatcctccaatgttttttttgtcatactacatttgcacctatgttttgcacactttttttgtctccaaaatttagttgtatgttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggaaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaagaaaatcaaacgggcgaggaggaaatagctgctgatggtaacgacgttgcggatgatcttggtcaaatgttgcaggacgccagggaggactgcgaaagtgaaaaggaggcccataaattggacaagatgttggaggaccacagaacttcgttgtacccaggttgcgagcaggggcacaaaaagttggataccactctggagttcttgcaatggaaggcaaaaaatgaggttagtgacaaggcatttggcgatttattgaaactcgtcaagaacattcttccggggagaaacaaattgcccgagacaacgtacgaggctaagaagatagtctgcccgttaggactggaagttcataagattcacgcatgtccgaacgattgtatcctatatcgcggtgaggagtatgagaacctagaagcatgccttgtttgcaaaacactacgatacaagattagacgagacgatccaggagaagttgacgggcagctaacaaagaagagaattcctgctaaggtgatgtggtatttccctataataccacggctaaggcgtttgttcaggaacaaggggaatgttagaatgttgcgatggcacgctgaagagcgtcaacaggacgggatgctgagacaccccgccgatggttcgcagtggcgaaacatcgacagaaaatttaaagaattaggaaaggacgcacgaaacatacggtttggtttgagtacggatggcatgaatccttttggagagatgagcagcggccatagcacttggcccattacgatgtgtatctacaacctcccccctggctatacatgaagaggaagtacataatgatgccgattattattcaaggccccaagcaacctggtaacgacatcgatgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatctggacagtccaacaaggggtacaaggcttgcactcactgtatggatgaaacagaaagtacgtatcttaagcactgtaggaaggttgtatacatgggtcattgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcttggaagccagcctatagagagcgaagatggtcacgcggcgatgtggaaaaagaactctatattttgggagttaccatattgggaattcttggacgtacgccacgcaatcgacatgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccaaccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactatcacgtgttgatgacacaactgctaccagttgtaataaggggtatcattccagacaatgtccgggcaacaataacaaagctatgtgcattcatgaacagaatttcgtagaaggtcatcgatccggatagattagaagcccttcagaatgaagtggtgcaatgtctcatcagttttgagttgatatttccaccttcatttttcaatataatgacgcatctgctttgtcaccttgtgaaagagatccgtattctcgggcctatgtacctacacaacatgtttcctttcgagaggtacatgggcgttctaaaaaagtatgttcgtaaccgtgctcgtccagaggcaagcatcgccaagggttatggaacagaggaggtcattgaattttgcgtagaatttatcgaagaccttcgcccaatcgaggtacctgaatcacgccatgaagggagactacggggaaagggaactcttggaaggaaagtaataatgacgatagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccacgtggctacgacaacatctcatgggcacgccggagatcaaccaacaacttgccttcctggcgaggggaccgtctgggtcaatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggatatatgggaacttgactatggtcctctcaaggttcctctgttccggtgccaatgggttaggttgactggtggaggcgtaatgattgatgacagtggtatgacaactgttgaccttaacaaggttggatactcggacgaaccttttgtccttgccaatgatgtaacgcaagtctttttcgtgaaggacatgtctatcaaaggaaagaagggcagagggcctgacgagcctaacgtcaagtggttctaccagtcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggaaaaggtatgtgcagtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacttttaatttactagcatcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttcaaatcatgcatgtggcatttacatatgttaattagagcttttaacattaaatttaatataattcctacgctaagtatatatgataattacaatttttattaattttaaatcatgcagtatgtacatacatatcttaattagagtttttaccaatttaataatatcattcatatgctaagtatatatgattattggaatttttattaattttaagtcatatatttgcttattacgatttatccacttaatttattacagacacaaataatttttcggcctaattgtcattaatctttgtactttaaataatgttaatgcattaacttctattttagaaacacatatgtaagcgaaaataatatgcagtgctataatctttagtcctggttcttaactctaaccgggtttaaaaagaatttgaaaatagcgggaaaagatctttactcccggttgatgagaa

SEQ ID NO: 9643 - DNA, 5093 bp, Oryza sativa
ggagtaaagatccaggggtatatatattcccggtgtgccctcgtcttcttcaccaacacttaaacgttttcggccgatcgatctctctcggcctctctccttcgccgccactacctagggcaaatccccgcgccgacgccgccgtatctcgccgtcgtctcgagctcatcgtcctcgccgccgcctccgcctcctccgctgccgccgcatctatggggtgagagccgccgccgcctctcctttcaacgatctccgatctcgatctctctctccgtcggccgcccgccatgagacgccgtgccacgcagacgccgcgccacgccgccataggcacgcccccccgccgcattcgccgccgcgcgcgcaacgccgccgccgccacgccacgccgctgccttcgccgccgcgcaacgccgccgccgcatgcaacgccacgccgccgccgccgtcaccacgccgccgccgccacgccgccacgccaagcgccggcgtgatgccgccacaccgccgttaacgaacacgtgaacgagaacgaacacgtcaatgtacgttgccgtgagaacgtgaacgagaacgagaacgatcgaacaaacgagagcgagaacgaacacgtcaacgtacgttgccgcgagaacgtgaacgagaacgagcgaacgaacgtgaacgagctagggaacgtgaacgatcgaacgaacgtgaacgaacgtgaacgtgaaatgcaatatatatatgttacacggcatttatcctaatacatattttttgtatcttgtagaaaagacgtgttgtcggagtcgtccctcaagccggagtggaagagctagccctagaaggaattcgtgcaggcaagtgacgtaataatataaatgattgttatatttgtaatgcaattaagaatattagacttgtaattagacttagtatataagattgtgtagtgttctaatattatttgagttttaatataagattattttattgcaaattagacttagtatgtaattattgactacggaattggtgcgactcctagcaattgactattgtagtcttaattagacttagcatatacgcacgaaacacttagcatacatgactattttagtcttagcatgtaatattatttgagttttaatataagattattttatttgtaattagacttactatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatatttcttgtatcaacagatggctgaccgcgatgaggaacagatattgtacgatacaatcacggagggaagcagctagtactggaatgaagaagaagggaacgaggatccaaaccaatacttaaacgaggaagagaacgtggagagagatgtggaggggaaccagcaggggcacgtggaaagggatgtggaggggaaccaggaggaggaggctagtggtagtcaaccctccgttggacaaaagagggcacgcgggcaacgaggtgcagcgaagaagcttgagggtcagcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggattctgaagaaaatggcagaacagattcagagcttcaagggagatctgtaccagaagtatatcctgaaggggcagacaccaaacttcgacacattcccaaagctaagggatcactgggacgatttcgttgcatataagacaggtgaacaagggcaggcgatgatggaaagaaacaaagaaaatgccgccaagaagaagtaccatcaccacttggggtcaggaggctatagcgtcgtgatgccgaagtgggaggagatgaaggctagcttgattgagaggggtatcgaaccggcagctgccaattggccggaacgatcgaagttctggtactatgctcacggtggaacgctcaacccagctgatggctcactggtcttcggcgatcagatacgagaggctgcgcgatgactaacagatgcagtggaagcctcctctcatggcacgttccgaccggacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagatctagatttccgggtatcgagctacgaactcagcatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggatgccatgcaaatacaggacgaatcgacctgtctcgttgatgacatcactcaacgaacaccatgtgagctgcatattccttacaagaacttatcaataaaggtaagctcgtagtttatatattctagatttagccattccgctagttgctgcttatatatgttgattactaataaataatctctcacaacatgaaggtggcgtcgggcatggccatcccaacggacccttcaggtacttaccactgcaggtcgattccagcaagatactcgaaggtcgaagttaagttggtcgaaggcgcgtacgagaacctcgagctggattaccctggagaagatggtgagacgcatctacgagacacaagccatgccattattctatggcgtaggcggtacatcatcctccctgggcgacaagcagcgtctcgtgcaccatctcctccggctccgccatctcctcctcaggatcctgcaccggctcctcctcatgctccgccagcaccgtctccacctcaggctccagcaccgactcctcctcaggatcctgcaccgactcctcctcgggctcctacacctactcctccgcaagctcttcttccggcaccttcaaagtcaagggcccccccagctccaccgcctgcccacacaagggcaacgaagaaggcgaaaattgatgccgccaagaacaaggacccggggtacgattgcacgcaagaggagcttgacgcttacgttgcatcagaagtcaagagacaattcaagcctcgaagtctagaaaagaagattcctatagaccccagtgtcaggaacttcttcaggggtatgtctgcacctgtcaaggaggccatcaagctatcggactatgagcgaacgctgaagaaagcatcttctggaaagtccaaaccagtccctcagcttggagagcaaccaaaccaggagatcgagccattggtgaccagggaagacatgatgatagaaaaatttattattgacaccggtctaactacggatcaattgctaggagttgaaccaatagaaaaggcataattgaaatacatgtacgaactcggtaaaccgcttgtcaagcccgagctggtgcagtccctacccacacaaatgtacaagttccatcagctgtacatggagatgagcgccaccggtagagagatgatcggagcgaggatcagggacccggacttcttgcaaggagatgatattctctggatcaatttcaagagaatctacgaagtataccagctggacgccctcgacgtctctattatgagttgctggattttgtaagtatatcgttcagttatatttcttaattactacgtctcctttaattaattaggtccttgtatataagtaaactatataaaataaaatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccgtacaacacagaattagtttaattttactgtcttcctacataccaaatttcattcccgtacgaacttgctaagtgtttcatatgtaatgcatcccacgcacattgcagattccactgggtgcttttactcttcgacctgtcggcctgcaccgtcaacgtatatgactcaatggataaaaaagagtctacgtttaacaaggttttcgaacttatatacaggtactggcataagttcctctgttaattaagaaattcttgttatgttaattatttctactacgaatcatatctttaaactctatgtagggcttggtatcggttccgtcatttggtctgcggcaactggagagaaagacttaggcggaggttcaaatttcctgtgagtacacatgctctacatttatatttctccaattcaaattaatacatacaagtgtatattaattagatctcatgccgttaatttgtcatttatttgtagtgcgcaaagcaaaagcagggaactaacttgtgcggctactacgtgtgcgagtattgccactgccttgcagaccaaatcatcaccacaagagagctcgatgtatgtacaaataaattcaaaatttcattacataacgatttcttgtttaattactaatcaatttcatacattcatatagtttattcgcatgagggataacctgaccacacacaaggaatttatcgcagcggttcaagaacaactcatgggattcatcaacgaagaaatccttgatcccaagggtgaattatactacgacagaaacacaattcaccggtccttagcttctgagctagcagcgagtactactactacgtcgaaat

SEQ ID NO: 9644 - DNA, 19924 bp, Oryza sativa
ggccatgcaaaaaaaaaaaaggtcagctcgatctttagtcccggttggtaacactaaccgggactaaagatggctcagccacgtagccggttatttaacccgggactaaagatagcgatctttagtcccggattggtactcccggtttggaaaccgggactaaaggggttacaaaccgggactaccaagagtttctccaccagtgaatattatattcatgtaataataacaacattattataatactggacgacatatatatatatatacgcatgaggagttgacttcctcttgagacccacgcatgcaatttcgagaacatctgaattgattggagaagatataaactatatataaacactaaacttaattaatatttaataaaaggtttgtctgatttacctccatcaaactatcgctaaagtacgaattaccccctcaactccgaacatatataacacaatctgccctacccactaaagagaaaaacaaatcatgttttctgaaggagtaacgaccatgagagtgctctacgtcgatgcagacctatgtgtaccggagaagccgttcatcatatcaatgatttcgagacctagagagtgggtcgatatcgacgtgcccggccgatcgagatgcgtcgagccaggaaacaaaaaggcatgcaccacatatgttatattctcccgtgtcattgtcggtgtgccaaacctctcaaatgtaatcttagtttgtgtgccatcgatcgatatcatttggttgaaaaacaatatcatctacgactaagagtacacaagtaaattaattagctacttagggaccatgttttgggagatacaaattaaagtgactacatatgtgtaagacgtatgtgggagatttgtgtgattgttcaacatattaattcctaacacacagaacaaacaagtatgtgtacgaacccatgactatattcaagatcattttcattattatgatcagtcgtaaatatatatgtcgcacttttccatgtatctacatgaattaatatttatgtgagcgcatccttaattaattccctacctagacttgaggagataaccacaattaatgtttaaaaccacacctatcaccctttgatcagtagaaccatgtcttgtcaaaaaaaaattctctctttccccaattagaaacaattattattttttttggaggagccacggctgggaggtagtgctcatcgcaatcgtgcaatgttgcattgtgcttggggatatgcaatatggcacatcaatatatacatgcaaaccattttcttcctttgaaaaagacttcaaaaacagctatgtatgtgttattctcttggctcaaaggaagaaaaagatggacaatatcatgtacatacatgtggccttgctctttccaggcaatttgtggtggtggcaaatgtgtttgtctggatcatcacagattaccaataacgatatttccatgatttcacatggactgtatggcccggccgcgaaatcaatatggatccatcaatcatgactagatcgaggtgagtgtgatcaagctgatccatgagagtttgttgagaagaacatttagtttatttaattagttaattaatgagacgggatgaaggtgaatctgtgggttggcacgcgctcatcggtgaacctgaacgaaccttggtttgattcctttgttgaaatagatatgagctcagcttgatccctggattttcttcgatatgctaacataaaaattaattgacaataacatcttcaatcgattagttcttttagagtaaaatggattgcatgtgccatgtagtggatatgatttgagttttatttcatcatgctcttgttagttgagttgaggagtctttgggggaaaaaatagaactatttggctacacaattcaataacaatggtttggaggtgcctatagtacatgtgcacatatttttctaaggagtgaccaaattttcagccattggtgtcctgcaataaaagaggttgcaaatactatataggtctttctgcaactttataggatgatttcagtgcggtcatgcctccacaactattttcactgccaccattagtctgaatctctagcaaaatgtttgtatgagtatcatagtgacttgtatggcgaaaaaccatctatgaaatatccataggaatagacacaaaaattgctaaatgtctgacaaattattattgggaaaaatatgttttatcggttgcttgggaataatagctaggaaaaccccttttcctaagattttattattcatgccatgaaaagattttattattcatgccatgaatggcaccaacataccatcaaataaaaactaacaggtaagcttacaaaattagccttaaagggaaagctattgtgtatttgtgtatttaagctcaacgatatattatttgaaaagtaaattctagtcacaatatgcaaaggtatgcactcctacaaatttcccgtcgtttaaaattttcccaatatatatttgactatgctacaataaaagacttttgtagacacacaggaaaattttcagaagcacttcaaacattgtcaataatacttttacactaaagacgattcagtcacatttcagatatatttcctaaatttatatgtagatatgtttcactactataatgtgcccaaaatacatgtaaggcattatttagaaacaattttgtctctacatgcacttttaggatgttaaactatgctaaatagctagatatgagtaacacggcacatatacaagttacgagaatgttgcaatgattagtgtaccccatataattgtttcctttttccgcaatggttttccatgacaacgtgtgcggtgtaatttaatgccactagaaaaaagaaatgccactagagaagctatgagaaataaagaattacatataaaatgtctatctatttgtacaaacaatttacctatgaagttttgagaatgatttaagatcgagtattgtatataataggcagctaattgcataaaaatttatagctctatattatgtaatataacacccctacaatgcatcttcattttagtgctagttgactattcctagttagtttaaattttttatgatattacagtgtataatctcacatatgttgcacctcagatcaaacttctcccttttcaaagacaccaaaattcatttgtcaacaaccatgaactttttcagtgagtaagaaagggtggcctaccaacatcaagaggaggtggcttgtctaattgtgcctaccaaattatggccaccagtccctaattaggtttgtacatagtgcctaccatggacacgactgatatatattgccaaactaaaaatgaacctggatatacatattgccacgtatatatagtaccactgatgctcgacaacgtttctgaaaatttaattagttaaacaggaaattaaattagtggaaaggacaagaaacaattggacctcgggaggcaccgtcctatagatttagaactaagggaaagacttgtacttgactgactaatgacaaatcagcacacaagtaatgtacgtagatggcgacttgactggacgtacatgtggacccttgaacgcttgtgtggcatgagattcttcacacactaaggtctattaattagctagtcctctctgttgttttctctagaaacaaaattgctatttaatttcttaagggctggttatattctagctgaggcagccgaaaaagactagccaacaatctttcgtgttaaagatggtatgtggttgtcaattgtacatgtatatttgtgatcgcttataaatgccatcatcaagaaaatttgcagctgtgacaaatgtctcgtgagtttatgtctttgagggttgttttcctacaataaggcccctttttggacaaataactattttatagattttttacttgagatagtagttgcagggatcaataaatgttacaactccccttcaaaccatagcacagaagcttggactggtagttgacatggcacaaccctcggttcacctgtccatcggtccaactctacggtctagcgatttacatgtatattccaagtctatcacaagtgatatatttgctagtccacaatagttgtgaggtgatgtacggggaaatcacccacctacgtttgcatcccgccaccatttttctcatttatttgcgggccaggcgatattcttgagtgatggatggtttttgttagtcaagtagttctctggtctgccggttcgtatgaaaattacctggtcttcccagttaactccagtgcaatagcgtgaacaattcttgatgcaatccaaaccatgacatatatatgtcggttcaggtttttttttccaattaaactgctgggcgggcgtttgttttcctgcttcaaagtaattcaaaccataatcttgatgatgcagcactctaataatacagaacacttacaaagtacagacgatcaaccccgacaatcatcgatggtgttaatttggtctatcatgccttttttccctccaaataaaacccattttagtgagaatataggcatgttccgcacttcaagtaatatcatacatgcttgctagttcaaaccgtagtttgtgtcaaatgttatcaaaataaaattctgcttaaccttagcaaccaaaggcatgctaaatgaacgattggtagggaatatgcagtaacagttatatagttgtatctaggattaacataaagtcactaccacgtaattgattttcatggacaaggccccctccatgctccaggctgaccgtacttgcgtctgcatgaaaaattgtttccgcggggatggttcatagcacacctgtggtaacacattatcgcaggcaggcagttaagaggttcgcgtgtgtaatgcggtaccataggcaagccattaagaagcacacatgtgatgatcgacctatatactactccttgcccgagcttctgtgtttccaacctgaagtttcactctccaaaacaaagcaacaaatagagggagatatattgaacttgaaatctttccttgaaattgatatacaaggttagatacttgcttacctcctccattttccgctttttttaaaaaaaatcgtcggtgcaatgcggagaatttgcagttataaaattggaatttatgagctaattttgcaaattttagctaaaatagattagtttgatgagcaaaattgttattgtaagcactagttaattgttttatttctttatttacgagaagatacatgtattttcatgtttggaggaaaaaacttgtagtttaatttatttgtattgtgatcatttacagcagctggatagagcgtggatgtacgatacgctaagaacttatccattctacatgtcagaagtttttaaatttcttgactaggttgaggtacattctttaagggagaattggagggaaatttgttgttcgtgcattgattgtaagaatcagaaaatatggacagatcccaattcaaccaaggggcacttagtgaagtgcggatttgtgaaaaaattacaaagtttggacctatcacggagaaatcactgttcctaaaggtgatggtaatccctaaggtgaagaggattgtttttcaatggatgtggtagaaaattttacagttaatgacattgcccaagatatgatggacgaagatggctcccctgatattaatgattttaaggtttattttgacttggaggatatgttgcgtcacactgaatcagaagtgctaatgggtacaacaagagggttagacaatttaaaggagttagagaagtcagcaaaggatcttttatacgataaatccaagggatgtgacaaagattttacatgctgcacctatttatttgtcaatgcaagattcttattactatgtactaagaacgatctctcggttaggtcctatgtgtagtacaaaagagccactacaaaatggacaattttaaaaacatttcagattttgattaaaaaattacgagaaatattaaattatatagaacgcacaatctttccaaatgaccaattaattaacggccacgtgaaaaaatcactattgcaggcaggcctcttaacttggtcacctgcaattgtgtgttttcataggcaaccagcttaagtggtctgcctgtgataatggatcttcgtaagcggctagggcatccgcttatgaaaatgcgcatgtttgtagacacctagggtttctattgtagcgagcgcctagctaactcatccgtatacgaaaatgcgcatgtccgcagacggtcagccaccagtacagtttgactgcatgcaaaagaggatacttcagtagtaagtgcctagttaactcgtttttgttttactccaagaaaccctttattattgttgagttcagtgaactagttggttcaaacagaaagtaaactgatgagttattattgagttgtatatatcaattagtccaattagtttaaacaaaattttaagacgcataagagaagtcgggtaagcaattcacttatactccaacatagtctcacattaaagctttattattaggcctcaaacatagtcttctatctataagtttgattttttttaagaggaagtatatgtcatataaatgatctgtatttctttttaattgtgcatcagctatagcttggtaacgcggttgtatacactaaccatatcgacctaaaagcttataaacctaagtagaaaaaaagttggacaatgcacctatactgcaactatcatcaaattaattaaatcacacgtgcagacgtgagttggactttgcctagctagcaaatatgaaatctcagtcgtctctctcgatttcatttcctttggttacacgtacgaacgaatttgccgacagcaatagctgcaagagaaaggcgctgcaaaagatagtctttcaacgaacacagattaaaaggagagagaggaaaagaattaatggaacgagacagatctactcctacatacgagctaccatgcatatcgagaagctgagaaggaccgaagagatcgaaggttgcgcttggccggcgcaagcaggcatccgatgctttgatcgtcgatcttccagaagcctgtgcctgcctctctctctctccctagcttgccagttgccacatcttcttttggagtttggagagcactatcatatctagccagcaccctactccctccgtcctataaaaaacgaatctagtaccaaatatggcatatcctagtaatataaatctgaatatatatatgtgtagattcgtagtactatgatatgtcacatccggtactaggttggtcttttatgcaacggatggagtatctaataagctagctagataatagatagataccccaaaattaaaagctgtagtagctagctcaatacactactgtacctacgcatgcatgcttgcgaaagccaccatccagcagcgaaagcgagtccaaagcacacacacaggcctatttttttctccaacaatagttggataaacttttgaatactcgtagcacgttttttaaactataaaacgatgcgtttcatgtaaaaactttctatatgaaagtttttctaaaatatgagattaatatattttttaagtttgtaataattaaaactcaattaatcacacgttattatcacttcattttacgtgaaacatttaatttttaatctttatgtgtatgcatatggccggccgactgcaggtagctctgggtggggtagctaaacatttaaaaggtgcttgctgccggccatgccgcgcggcgcgcgcgagatattgttgggcgcgcggacggccgccgccccgccgcggaggaaaggcgccgagggtgaccttgcacccggccggaaaacgtggctttgttctcggtcgcgctccaagtgcgtacaattattcctttccaagctttccacgtgataaaattacccgatttgatttgcagagtcagatccatgcatgcatatatagtgacctggtgattgtatgccactactacatgggcataaatagggctgtttttctagacaggcatgttaaacggccgcacgaaaaaatatattttcacatgcgaaccactaaaagatccatctagaagtctgagttacctccccattctctcttttagcacttcaatttttttcaactcattccccctctctctccttacctcattctttatctcctctcctctcctcctcgtaatgcattgacatatgcattagtattccgttcacttgtgaggttttccttcttgaagaacgtggaggcactgtagacttgatacttttagctttctagcttattacctagcatgccctttgaaatataggtgaagcatacttattctttttcttttgcccaggatatttcatgcatactcctctcctatctctctctctctctctgccagtggcggtggccagtgggagcacgacgaaggcgacgatgggcaacagcagctagcgggtgcgccgcgaaggtgacgaggggcaacggctgcagaggccggcaggtgcgcggtggctggtgggagcacggcgaaggtggcgaggggtgtgcggtcgggggaggagcatggccgtggcagcggcgagtggtagtgtgcggacgacataagcacccgcatgaaaaaaccggattttcgcatacccttctgggcagacgggccagaggtccgcatgcaaaaaccatatttggcccgtttggaaaattttgttttgcactagtgtgctaccccggtttacggccatgagcttgggccgaccaaatctcaagttcccgcatcgtctccattgcattgctcgtggctcgcacctaatcatattaatctttttaaaagctttctatagcttaattgatcacacaagtacagaaatccttttttttgcaaacggacaaaatgggttttcgcatgcatctaaacggcccacatgcacccccgtgtctgtgcaaatcaacatttttccgtgcgggtaacccaaccgcatgcgaaaatctcatcttcgcatgcagtcccaatgccgaccacacgagctaatgtcgtcatcgccgccaccaccaccgttgtcgtgctctccatcatcctgcttgtcgcccgccgcaccgtgagagagggagccactggatccgcatgagggggtcaccaccgccatcatcatcgatgcagtccgccggaggagggggctgtcgctgcagtcatcgccgatgtagttttccgcccgttgtcatcgagaccatgtgacggagagggcccccaccgccgtcaagacccaatgagggagggggccactgctgggatccacccaatcattcgttagatttttattatttttttctaaaattataatgtgaatacttctttcttcttcctctaccgaaccctattcaccaaagctcttcggagctgttgtgcactatagctcgatgtcaacaccctcgaacttgagctcatgctctcataacgccaccctcccccgggcgagctacctcgttaccgtgcaatctaggaccctattaggcatagctctagattcaagttctcatgtagttgggtattcctaatctacagatctatgtatttggatatgcacaattacgtcggtaacatttggataaattattttattctcattttagatgaattataaatttttcaaccattataattagcatacaaactttaaatccaataccatcagcctgaatcatcaggttctattgttgcaccatcaagcttgaccgtgccagtgcccttgagttcgcctgtcgccggtcacccatgttgaagctcaatgtgccatctagcatgttgttgtttctctccatctcgtgtgttgtgggttgcctactcgtcacatgtcgcctattatccaaggtctcaagctcgtcattgagtatgaccgctgctgatgctctctaattaagagctgcaggtacagtaagactgagctataagtttattcacaacaatacaatctcacgtggaagggagaagaaatgaagagagagcatagatctggcaactaatctatagccagcgctagcaggaaaaccaattaatggactgccacacttttgcagcaatcggagaaaattaaagatgagggcgagttcacgctcccacagctctcgggccgatttccaggtgacgtgctcacttcgagacatttaactatttgctacttttaaaatgtggtaattaagtatttgccgctcgtaatatatgacatgtgggtccaatgacaaatcattaattatcacttataagagtggcaaatagttaaatatctcgtttgcttctgcttctatccacatcgcctcatgcgcttgtggcgatgccgcttgcggaccgggagcaagcaaaagcggccccgtacggcacgagtgaacgcggcccgtccgtgctcagggctctggcttgcgttctatcttttccactaggaaaaagtccacttttgactccctaaaaaaaaataggccaaatctaatttgtaacccttaaatagaaagctgggtagggtgactccccgaacaattgaaactgatgtaatttgactctctcagcgattttggagggcggtttcgctgaccggtgttaaccgggtcttcgtcccacatggcgttgaagtggcacctatgtcacgttggaattaaaaaatatgtgcgggacccattgtcattcacacaaaaaaaatattattggacccagtacatgtggggcccacatgtcatccactctctctcccatcctttctcctccctgtctctcccttatctctctttctcttcctcttcggccatccgtggagagcaaggattgcagcggcaggagggagtgcgggcgctggagcggcgatggtggatcatgggctggtatgtgtaatcgcgcactggtgcggcagcgtattggctttaggccctgtttagttcaggggtgaaatgtttttgcatgtcacatcggatatacaaacacacatttaaagtattaaacgtagtctaatagcaaaacaaattatagatttcatctataaactgcgagacgaatttatgaagcctaattaattcgtcattagcaaatgtttactgtatcaccaaattgtcaaatcatggcgcaattaggcttaatctcgcaatttacacgcaatctatgtaattatttgttttctatatttaatactctatgcatgtgtctaatcattcgatgtgacagggtggaaatttattgtttgggaagcctcagtaggaaggactgggtcaaagggtcctcgtgatttactcgataacttgtcaagcatattgccctcttcttctgctttctggtgcatcgaaggcagcaatgagcaaatgacccacatagctaaagttctgaagttttttttctctctctgtttctttcttcttcttctttttgtttactttgaattccttaaggtctttcccttgtgagtaatacctaaagcactttctgtaatttgcgtggacatcagaactgtctttaccctctttttcccatgaataaattaactcgtgtttatgactgaagctatgccttttactaattattaaccagaactccttgtattttactgcttaggataaagttatccatctgaaattaagtatcttgttttcattaatctggtattaaaggggatgctgcgcattttattttatttttcattgttagccatatgattttgtgtgctagtgctacctaaacccacctactgtacttgttacatcaatcatcagtgtcaattcttatgcttggttgagtatgtatatatgcaaatacttactgttttcatctgacatgtgcagccatttgcatggtgctgtgtcacaaaattctgaatctctgatgattggattcaaggtttcaactttcaacacccaaccctcctcaaatctgcatacatagtacacacttcatcaagtgtctttcagactccaaatccagcttccgaaatgtccattgttaatgccctcaacattgttaccaaacctagccaacagggacctagttcttttttttttttgccgggtcggccaaaggttggccgaccaatttcattaagattgggaggaaaacagagtaaaagtttacagcgacattacaatgtcgtggcggccaaggaaggtccctagccagccaagaacgaaaagcaaaggcgaggctaaaccccgcaaacacccatggggattactcgcgaaattgggagaaaacccccgccaccctccaaacggcaatttcatccttgatgtcctccgcgagctgatccggtagcttgtacacgtgctgaaatatacgtgcattacgctccttccaaatcagccaacatattagcatgaaagcacagtcaaaatctgctctgtagctcttctgaaaacggcatctagttgccagccaccaatcagcgagggcagcatccccatctgccggaattggaaagctttcattgcaccatcgcttgatagaacgccacaccgccgtgtaatcacacgcaacgaacaggtggtggcagttctcatcatctcgctgacaaagtgagcacagatcatcatgtggccagtttcgcttggcgaggttgtccgcagtgaggcaacggtcctttagcgcaagccacatgaagaagcggactcgcgagggagctctggagtgccacagcagctcgccgaatgcgcagttttccgtagccatgaagaacatgtcgtaggccgacgccacagaaaattgcccatcgttcgtcagtttccacctgatttcatccgtcgaggggagcagcaacacatcatgaatttcgtcccaaagctagaagaactcgcccatcgcctcgttggacagcgccccctgcagtgtgcggacccaacgattgttggtgagagctttggcgaccgaaagcttgacacggcctgcataagagtgcaggatcggccaccgccatgtaaagcatcccttcccagtccagtttgctgtccagaaatcggtgtcttcaccatttcctatgatgtactctgttaccgagcgaaatatggcctccacatcacaaccaggcctgaaagatgccatcgtccagggtctctccctttgctccaacagggacctagttctagttgttatctgccttgatcttaccatgtattcatgtctgagtatctgcctctgctgaaccccccatgtatacatgcctgagtaattgtcaccaacattagtgctctcatattgttaagtttgttcctttttactaacaagtctctaaattctcatagaatatcatgagagacgctttgcactttttttttggatttttggccttccatggcacttgcatcatttcatgctaaataaccacatcattttttttagaactagggcacaaggcccccctttccattaacggaacggcaaattgtcttatagaaaactaaacaaaaaacagaaagcccagtaagagggttcccacagaaagaccagcaaaaacaactggttgagggagactgctagttcctggctgatataacaaagaccagaggagaaatcaaagctagaaagggatctgttaagcagcacagaagcttcaaaacggtcacaagcaacagcattccacacgtcagcatccttcattcattccaatcttctaacgtggggacgccaaccatatcttgagttgtaaacatcacttgcaacttgccttaccacccagacccccagctccattcgatttgcctccgatttctgcaaaacagtccaagattcaatcaaattacaaaccaagaagataacctctgtgggatctttaggaagaacataatcaaaacacgctctgtttctggttttccatatggcccagataacagcagtaatccccaccatcatcaaattttttgtgttcttatcaaagccaaataaccaaggccccaaaagttgggttttatttgaaaatggttttagattgagggcacaaatgaccacattccagatcaattttgctaaggggcattcaaaaaacaaatgctgtatggactcttccctacagcaaaactgacatattttgtctccctttcgccaaccacgtttgtaaagattatctttagtcaggattttgtttttgagaaataaccagaggaacaccctaatcttcaggggagttttgatgtaccaaaattttttcaaagggcatgaaaactgctgcaatttgagagctctgtacatcgacttgactgtgtaagagccgtttttattaaaattccaccaaagcttatcactgtggccattctgcagatggatattagcacatagatgctttattctgttccagtcctcaagcctatttccatgtaaagttcttctaaaagtgactttatcccaacccccctgcagagctttatccactgtgatgtgctttgtgttagtgatattgtacaggtctgagaattgctcatttaaaggcctacctccaatccaattgtcctcccaaaataaagttcgtttgccatctcccagtttcttagtacagaatttgtaaaaggtgtttttaatctccaataaaccttgccaaaagtgagagtcccccattttattcttaacctcagagaggggtttttttctcagatacttatccctaagtatatcttgccaccaaacttctttgttttccaaattccatatccattttcccagcagagcagtattcatagtttctaaatccagaacacccaacccaccttgatccctaggagaacagattataggccattgtaccaagtgatattttcttataccttggtcttcctgccaaaaaattctccttctaaagaaatccattctctctttgactccctgagggattttataaaaagacaacatgtacaaaggtacattgctaagactagcattggtaaggatcagcctacccccaatggactggagtttgccttgccaaccccccatcttatgttccatcttattttcggcagacttccagtttttgtttagtaacctctttttgtgaataggcaaccccaggtatttcatgggaaaagaacccaccttacaggtaaaaattttactataaacattttctctttccacagcctctccaatacaatacacttcgcttttattaaaattgatctttaaccctgataattgttcaaagaggcacaggatgaatttcaggtttctagcatgttccatattatctttgatcataaatatcgtgtcatcagcatactgcagaattgtcaccttattgttctcacttactgacaaaccctccaaaagagaactgctctcagccctttgcaccaacaaggtgagtgcttctgcttctaaattaaacagcaaaggtgaaagaggatccccctgtctcaggcctttgtgagtgttgaaatagggaccaatctcatcattcaccttaatagcgaccttgccccctctcaccactttcataacccaatcacaccataaatctggaaagccttttgatttcaacattctatatacaaacacccaatcaaccttgtcatatgccttttcaaaatcaaccttaaaaaggatgccactctgttttttcgaatgtaaagagttcagaagttcgtgtagaatgacaatcccttccatgataaacctattcttgagaaaggctgtttggttcttggaaataatatacatcatgaccctgtccagtctattcatcaacaccttggtgatgatcttgaaagtcacattgagtaagcagataggcctgaacttttgtatttgtgcagcatcttttgttttagggacaagagtaacaatgccataattcaatctctcgacactcagtaaacctttatgaaagtcattaatcagttccaagagatcatttttgataatgtcccagaatttcatgtaaaattccccagggaaaacatctggccctggggctctgttttttctcaattcaaaaacgactttcttcacctcctctagactgaaaggcttggttaattcccctatatcttccttcttaactttgctcacaccctccatgtttaaagagacattgttttctttagaatgaccaaacaattctttataaaagctggtaatataggaaagcaagttttgtgggccagaaatcacaccatcctcttgcacaagtgagtggatcaagctcttccttttccttccatttgccttagtgtgatagtatttggtattacagtcaccttccaaaacctccttttctttgcacctttggaaccatttaattttctcctctctaaccacatatctgagttgagcatcaagggctcttctattattcataatgttaatatccaccccaacagtttcagctaggatatcaatctcttcaatcttatccatgatttcttttttcctccttctgtattctccttcccagtttttgttccagcctttcagtttttttcttaaaaacttcagcttcttctgccatctttccatgctgtcccccctatagtcagagttccaaatctcttccactactgaagtaagatcctccctcagaaaccaactttgctcaaacctgaatatactctgaggagccatattctgtcctgtttccattaacatgggattatggtcagacatggccctaaccaaagtcctaacagtggtaagggggtaaatgtcttcccattcattgttaatgaaaactctatctagtttctttagagtgggagagttctgaaaattacaccaagtgaactgtctcccactcatctgaacttctctaagatttgcctgatcaatgatggagttaaaaatgaagcttcattttgtatatccacctatcttgtttttttcactttcctttctcaaaatattgaaatcaccacccaccactaaaggggaaccttgggagtaaaattccttagccaattcagtcaggaattcagctttctgttcagcttgcgctgccccatatactgccataaaatcccagacatttttgttgtcagcattcaacaatttaagtcttatgaaatacttcccagttttctcatttaatacattgactttgtccttatccattcccaccaatattcccccagatctaccacgagcagccatccaacaccaatgcatatttctccctgagcttagtttgtttaacaattcagttgaaaaatcatgtttaactgtttctagaatagccacaaagtccagtttgtgatccctaattaggtcttgtaaatgacctgttttttcaatgttacccattcccctgatattccaaaataagcctttcatttctttttcttttttactttacctcttttctttgaactcttgggagtgaccttgaaatctcaaggtttcccctcctctgattgctttttttcattgaagactagacttgtttcagcatctgttcaatctcatcaagagtagaattgtcagaagaatcatctgaccactcttgatcagtagacatgccttccatttcttttttctttaattcagcatttttatctgcttcaccctctttcataaagaggttaattctagcagattccagatttttaatcaaattcaagttactttccacatcttcaatagcacatcctaaactaacacccagaatattcgccatgttgataagagagacatttgattcattaataatagagggtactgtattctgacctttgttgacaaaagcattctgagcttcctttctttgcatggccatatcttgtggcttcaagtcttccttttccttcagtcttttactccttctcatctcctcttcttgactacctgtattgtcctccactaagttgatccccagtcttttggcaaaacttccttcagattcttgtgaatccatataatcctcactgtcacccaagtgcactctttcatcttccctgtctatcccttcatcacccacctcagttgcctcagagtcgattgtgttcactgccatccctctatttccagcctgctcccattttttgtcttgtgtcagaagaacttgtgtttcctccgtcaggattgtctcaccactggtcatacctacttctatgccacaatctgtggtcgacttagcctctgcttcctgaagctgaaaagccagcgctctgtctctcagtatctgagcacacttgatttgactttcctcaatcattgtagtaggacacaacatatctgtaggatcatcctttgagccattgcctcttagcaaaataccaggactgatcttatcacccatctccataatctgcttgccatccctttgaccagatttctgaccacttttcaggaaactttcagaccctacctgaacttcctcaaagatactctcattgaaccatccttgctcaacaacttcttccagctcaaagtgggcttgatacagcagacctttaggtgtagtaaggattaacttcaagggcagcgactcaagctccatcatcccaactttaaatcttatcacattgctagccctaaaggtggccatgtcaacttccataactgttcccaagttagatcccacttcatatagggcctggtaacctctcatagcatcaggaatgccagacaccttcacccaagcagtatgcatcttccccactgcatcagactcttgtgtccattctttcacattgacttgaacatcagtccccttaacattgaagtagtcaaagttggatagctcttcaaattttatcttgtttgggaacctcatctgaaaagtcccattgggcatagcttttgctttccattgccaattccacttaaattgctgagtgaagccttgttcaagctgagattcagtaaattccctcccaaagacaatagacaccattgccaaaggatttgcatgctctttaggagagtccggcctagtgttttgaataagaatgcaacctaaaccaggggcaccatacccaacaagcttagcaactggccttggttgcttgtcatacaaacaatcctcagttctatgagatggcttggcacagttaatgcagaaaacagaaacgttgcaatccctagccagatgacccacatttttgcatctctgacaaaaaaatctttgtgggataggattgttaccagcacggggattggattgcagaggttgttctggctgcagcacagaggtatcacccttctctgtttccttggctggttccttatgctgaatagggcgatactgctgctttgttgctcctcgtgcagccatggttttggcttgatcccccaaagctcctcccccaatcccctgcagcgactcacctcccgttgaaaacgtcggagcttgtggctttctcccctcgccgaagtttcgcatcggccttggattgaaacgcccacgccatgcacctcccccttgattcgccattgcccccagtcgacctcgcactaccttcgaaaatcgccgagtgtctccgtgaattgtgcttctccacttcgaaactaaataaccacatcatgaatatgcatcttgctatgtcatattttctatagagatttattaatatggaggtcatctttgaacgtaaaacaccaagagaaaaagaatttggcagcagaaaaggtcgcttttcttcctgataccatggcagagaagcacttaagaaataacctgatgaacaagtgtgctcaaccagctctctccaaagtgcatgtagctcaatagaatccatttaattgtgttcttgtcaaaatattcttaaaagaatttgtagacgtgatcactggcggtatgtcattcttaaattagacccatcaattataaatctcaagtgaaaaacaacatgaaaccgaccttagctcagttggtagagcggaggactgtagtcgttgcagttaatccttaggtcgctggt

SEQ ID NO: 9645 - DNA, 7040 bp, Oryza sativa
tcacttgatgaatttgtccccctatcaaccttggtaatcagaaggtaaattcaagatttatgtggaatacaggttgacaaggcgttcaatttgctgaaaactgaaaatgagaacgccaatagtcatgtcagcgattggctgaatgcactgtagtcatttcatgaaaaaagagaactgtataaatatggcatcgacaaaaaatgatctaacattctcagaaagagaaacaagacgtacaaaataaagaacagccaaccggcgtctaaggaaaagacatgcttttatttctcatcaggtggcagtacaaattaacagcaatttggtgaaacatgttactacatatgaaacagacaaaattacattctttataaatgcaaaacaatccttcttctccatgacttctaaacagctcattgccgaaaggaaatgcccgcaaacatgtgtgctgaagtgaggtaatctcccttatttgggcgttaaaccacttgataattggctgttaccaaacgagccctctgcgaatactttggtgggttaccatcctttagaggacgaattccagtaacctgcaaggtatgcagaaaataacattaccatacaataaaatgagaaggaacaacaaacatagaaccacgagtctcatctaataagggaaaaccaaccttcaaatcgctgaatgtactagatgcggaaaatccaattgatatggggaaaaatgttgatggatcagctggggggacaacaaattccatggagccactgcaaacaggggaaaaaataagagttagagccacaggaaaaaaaaaacaaaataaaacatggttatatgaactcgtatttcactgacctgcggtttgactgatcgataagaagaatggaccattccaacacggagtttctcgaatcatacctgtatgcaaaatgaaagtgaaataggcattataacaatcagctttcgctgtgcgttctaccttattagcatcaaggaaataaaagtttagctctatctacacaaagtgtcatttaggaccagttcatccaagggaattggactaaatcccgataaatccaaaacacatccccctttgaatcgcaggaatggaaaaacggaggaataggaaaaacgtaggattctgacaggaatgcaggtgtaaaacagaggattggaaaatacaggaaaaacacaggaatgaccgtttgattggaccacaggaaaaacacaagaatcggatgagagagatagactcaaaggaatttttccaagaggttggacctcttgctaacttttctccaaaatctctataggattagccattccataggaattttaaaggatagtataggattcaatccttaatttcaaaggcttccataggaattttttccataggattgaaatccttcaaatttcctacacttttcctacaaatcaaaggggcccttaacagtttgaatgccaatatgacagtgccaggaacaatagctagaaagcatagctatcacttgttatttttctaatattagcatcaatactaaggagataattgtcatctaacaattagttggacaattattttagtataatataacagccaagttcagtacagatagagatgaatttgaaacattacctccactctccatcaatctgtctaacactcggagcctcccgaagtgcaggcaatggtatagatatgacaacattgtgcaggtcaaacatctcagcagcctcatattcaatgttgacataagtttcatttccagataccgatggccagcagttgactgagcgaaaaaaacacaagttaataaaagtaggaggcaaccaagaaaagaaaaggcatgatcttcaatgtgatatagaagaaagtaaagtgattgtgcacctgatagaggtaacgatgactcatccatcccatgaattctccacttaaccagaggagtttcattttgaccacttgggaatggcctgtttggatcttttgcccccacaacttgttgactgttaaacaaatctttgttgatattggggtgtgttttgaagctaagtccaggtacatcctggttttcaatctataagacacaagtatcaaataatcagctccgacaaacagtatcatggaccaaacaatgtttcttgtccgcaatgcaaaatatggtgcaagaatcatagatgtaactgaacgtaataaaaagaaataatattcctcagcaacaaaaacatggcatgataagcataaacaaagtcacaagcacaaatgtgatagcaaaattggatatcatatgacatggactacaaaaaaaacagtacatggattatcttagcaggaaggtcacccaatataacacatgcattacatttacttagtagaaatatcgtataggttcaaacaaaaactgtcgtgctatgttctttgatctgcttgtgaaaatttctgtagaaaaaaatcaagcaggatgctagaggttcagaaagaatgttacctgcaactggataaacccatcagtatcattaaggacctgaagagcaagggttccttgcacatcaaaattattaacacctccatctcttttaactgtaacattgagtttttcttcaattgtcactgtgacaggatcacttggtggaagaggcgacacccttgactgaactgaactgggttgtacatcctccagaatgacttctccttcagctttcaaagattccaggaactgattcgtcttctgtgttttccctaatttcattccaagacctttaccaggagcagtagcagctgcagatggacggcctgtacaaacattgctagcaaacataagcaatatattatagttgattgaactttgtcgagcagttaaaatggaaagtaggaattatatagacaaacatagacataatcaggagactactggcatgggaatgaagatctgaatatcaagtactgcaagaagaaaacccagagctttacgtagtaaattttcccctaatgcaaagagttaatatctgccaagagaaatgcaaagagtttttaaattaccacctttaggcttgctagcaaatgagtccatatccatgctcagtccacctaatccagaaccacttccaaatccactaccagtaatgctcatgtcaccaaatgctttttcaactaccctgggacctgatattgccgagtatcctcctttgtcaagttttcctctttccatctgcatgaacaccgaccacaaaattcacctcttagacattaagaaataacggcaatgcaattgtattttaaacactaaagtttgcgcgaactgatatcaattgtaaccaaagaaatgacaagctggcagtaaaacagcacagagtcataaggtcaaactagcaataataatgtaatatcgattttcctaatggtcaaagtcaactacattaactgtcatttattttctctgaagatataatatgtatttttaatctgaagaaaggtgcagtgcagaccttcatcttatcaagctcactggctttcttcttcatcacatcccttgtttcattgattttgctttgcatcatcagcttgtgcgccttctcttcatggctctccatctcacaatattgtttgacttgttggactgttacgttttccttatttccaagacagatggcctcatcgaaggcaaatataagctcaaatgctgttttacaaacaccctcctcatcaagagagggagaatattcaggcacctgtggaactgttaaggagatcacagtacttgattattgccaacaaagaaaaccaatgcagtgtagtagcatctctaacggtggatatccataaagccccaaaacataacagattccattaaaaaaatatgataggttcatgattgtatagcttgcatgttgttttttatcaaaattgaattgtgttaatgtagtgactttattttctttgttttttttagaaaacaaaggagagctgcacttcatttcattaagaaggaaaaacaaaccacccatacaaccaagcgctaacaagcccttcatccaaaacacatccacaaatagcatcacacaaggcgacacatgaccaaaaaaccaccctacgacagcctagtgcccttaagataacgacctacaaaggaaaacttggagcacaagagctccagccaggcaccaaagcgtagcttctgttgacactgcccgcaacgcctacataacgtttggattcgctcaattgaatacacagtcattatagtgtttccaaatttcccaagcaactatgataaacaataattacttttcttttgtctccttggtaacatataatgataagctcaactaaacaaagacattataatcttcattttgtcctacaaaacaaacattaatagcattatctgatatttagtctgtacattgcaatatatgggtaggttaaaagaaaaaaattttatatgtttcatattatagcattatctgatattttgtccccttggtggtatatagtgacaagctcaactataccgagacattataatcttcattttatcccacaaaacaaacgttggtaacattatctgatatacatttattcactacagagcaatatatgtgtaggttaaaaaaccatgtttcatatgtttcataggataggattgtataggttagttaggtcaaaaaactggaacaatgaacatatgggaaaaaaggatacaagcttagagagcagcctcaaggtgtccagatcttcaagaatattgctctgcttgttagtgataagtagcaagtacaggcctttctattggctgataaacatagcgaacattttcagtctcaacataagtgtgctgcttcccagttccaaccagtttggggaaagctgcaagtaatccttcaatccttatgcgagacatgtcaacaaactgtcttgaaacaagtgctgcagttgaaaagcgcagagaagaaacagcattcagtctaatcacattagctttctggaaggaagcatcagcaaattggtaaccaagaggtgctcactacataggattttagggtcataggagttaagaatctactgaggcaacacgacaacggctagattagtatttgggttccacaaatttgcatatgagctaacaatcttatgagcacaggtgacaggtaaaaacttatacaaatacaacagtttctttttctatgcacaaaagaatttgttttgattacaacataagaatataaatttaaaaagacttctttttttcactgagaataatgcaatacaatatataacaacagaatatttcaagccagctaacctttcccggactttgaaatgatggaagcagcaagaaccacctgcggtacacaaaaaacaataataagctctcctaaacgaatcaactagttgcttataccagcaaaagagcaaatgtcagaatgtcccttcttaatattacaaagaataataaaccattaggcataccattttgaatggattttttggtactcagaattgctgcacttaaaatggattcaagaattatgcacctgccagaagtggaaaaaaagaagaggttattcaatcagtgcaacataatcagagatctcctgcgaactagatccaacccccccccccctttttttttttgcttccagatcttactactagcaggggcggatccaacttgggaaatgggggttgagttgaaccggcaaacttttgggagaacaaacaaactgttagttctactaaggttaaggctctgaaattaagagaagagcttcttccagatctacaagagaagctggggttaacgcaacgcaagcaaaattccagacaaaagtactcccggtggggggagagagagagagatgaatcggaaagaggatgtggatgctcaccaggatcccctcccctcgcctgctctgctctgctcgccagatggagatcggcgcccctaccctgtcagccgcgagatggcgcaaggaggggagacgagacgcgagattttcctttaggcgaaaggaaggagaagatagtcgaggactccttttatctcaaatttactatgactggtgggccatatgtcaacggtacttgaaaaaaaaaatggaactagctcagttattaggtactgtgtcgatagcaaaccgctcagttactagatgctctacgttcgtggcctgtttttaagccctccggaattttattatttaggtagattactgataaaacctattccatagcctctaggctattttgcgagacgaatctaacgaggtatgttaatccatgatttgccacagtgatgctacagtaatcagccgctaatcatggattaatatacatcattagattcgtctcgcaaaatagcctaggggttatggaatcggttttgtcggtaatctacgtttaatacttctaaatagcaagattccggagggctatttaatagctcggaggatccaaacaagtcccgtatctaggttctcccaactctctcctctccttttccacacgcacgcttttaaaactgctaaattgtacatttttaaaaaaagtttttatacgaatgttgcttaaaaaattatatttgtccttttttttaaaaaaaaaagaaaatatttaattaatcacacgttaatggaccgcttcgttttccgtgcgcacagcctgggataggaacagaggcttctgaatgcagcctctctatcaacctctccaagccaaattttcgtcattcaagcacaaaaaggaggtccaacagactgaccaaccggatggccaagccatcccgttggtcaaacttgctcactggctggctagagttggccaaccaaaacgccttgccaaacggtggcccgcagcaacgaccggtcggcgtggcggctggtgtactcctcaccgctaccagcttcgccgagcctttccgcccccgccgaattcagccgaccgcacgacctccgcctctgcgcctcggtcgtcgagagccgccgccgccgtcgctagcctctgctcagttgccgtcgccatcctcgcccgacctccgatgccgcg

SEQ ID NO: 9646 - DNA, 22194 bp, Oryza sativa
  unsure (1)..(22194): unsure at all n locations
tccccttttcctcttttctagcgttggcaggaagtatgcggcggcagcagcaagcggggaggagacggcggtagtgggcgcggcggggagcttgcgtcgcgcggaggccggcgggcgcggcgaccggaggcggcgggcgcggcgagtagcggccggcgggccgtggcgagcagaggcggtgggcgggggccggcggccgcggcgagcggaggaggaggacgacagccgcgtgggggccggcgggctgcgccgcgcggaggccggtggtggcggcgagcggaggcggtgggcggtgctgcgcgggggccggcggcggcggtgagcggaggatggcagtcgcggcgagcggaggccggtggctgccgtgctcgagttcctcgtcgtgctccttctgtgcttggttgccgtgtggggatggaggagatgggctctgtggggcccaccattggccagccaaatagagtggccaaatttggctaatggagagagggttttggccagccggttggagaggttgttggagcacttttttttggctagaatggctaaaatttggctaggagagtgggatggagaggctgttggagatgctctaaccactaacctaccgctccatataccaccatcaccagaattggttacaaagtcactcgacttggaagaggaacagtggtggagtcaccagacttggagatggatagagtgggggtccaaattgaaaaaaaaaggtaaagttagctattgtgtacatgaaaaaaatagttaaaggatgatataatatgaaaacttttaagaatacatagtacaaattgtaatttacttttttttgtctagcacaattaaatttgagttatccattaacaggtagtctcgattcaattgtgatcttcttttctcactgcatgacatatgatgactatctcttatcactatgtggcatggttccaacaaacccataaaactatatattggtatttccactatattgtttttttaatttttacatatatgttaatttggactaatatttttctcataattgaataggtaataaatatttttccatattttctataaaatgtgaataatgcatagtataatttgaaaattatattataagtatatgtaatttagtgttaagatatggacttgtagtactaaaactgccgcaccatagtagataggtagtcaaatgaacaaccataacataaaaaatatgagagaatctattgtgtgccactgatcttgtccatgttctacaatataccactaggtttgtcaagttctaccatataccatcatattttgcttaacttctataatatatcatcgtcgtccagttagccttcgttagtacggtaaaattttgtcttaatgatcgaaatacccctggataaaacttccaaattttgatcaaaatttctaaaatattagattgtaaaacttccaaaatttgagacggacaacttctgtgctagtttacaatatgatattttggaattattggccaaattaaaagggggcgcccaaccccttcccccttccccaggtggagttcatcgggaacggggtggggcagtagcctcctggcgagcgacggtgaccgtgcattggaggcacagggtcaacgtcaccgtcggtggagcagatgagaaaagatgggagagaaaaaaaaaaggagaaaaggagaacagggtcaacgtccacgtggtatgacatgtgggtaagaccactatcaaacgaagctttggactagaatgatacaataaaccaagttaagggatctcgatgcgtgatttgtaagttcgtggatctaggtgaaacctgcttataagtttatgtatcagtggtgtaatttactctattatgaaatttggtcttcgtagtaatacagcgtgaaagtaaaactttaactctatattcttccattgttccatcttcttcttgttttctcgttcttctttatttcgataataatattgctagagtcaaacactattacttacacatgaatactagcatctagctcatgtgtgtatgctccgtaatatatattatatatgttttttacataggtaaataattattattatcattggtatcgatattttatttatataagatacttgactagtttttaaaggacaagaaagatattttttttctaaactgttgatgcggaaaacacgaagacacgggagatttgcttagctctagtgtaggtcctacattttgatgaggtgcggccgtgccagctagtttgatcctgcaactgacaagatggataaatgacaagatggataaattgatggtcaaagagtctatcaaccaataagctgatgtagcaatactagctgatgtcggtagggtttgaaaaattggctatatatccgatgtagattctaatacttagataaaaaaaatggaagaacatgagcaaacaatccaatcagctgatgataatatgatgaagtagatgtccaatgaaccaatcatcagaaaaatgtagactgaatggttaaaataaacatcggctggaagtcagatgtaaagataacttatatgttagcactccgataaaacaatatacatgagttactagggtggattagatctattaatcaacagtaaaaactaataggtcggaccaaaccgatacaacattaagttacatcaacgaataaacctaataatatcgataaatcatgtataaagtgatgggctaagatagaagatcggacctaactgagacagtcccaactaaaccgatgagcttctaaacacaatgcacttaaagatagaattgaaatatcagatacgcaaatataccaattgaatcagagcaatccaagagatcgaagcgatgcatcctaaaagaacactagtgtagcgataaatttgccagggccaacggaacttagggcttaccccttcaccggagatcgaagccaatgcagccccgcgtcaggtgccaacttgcgccgatgataaaaacctcggaaaagagcgtgacgatgctccgagagtagttgtattgatcgagagataggtttacaggacaccgggatggatactagtcctgatcggacactaaacaaacttgcctgaagataaaaaggaaaattactgcaccctgcctaattaacactagataaattaaattatcgtgccgtggttttcatgatttctttttaaactcggtctcttctggataagtttccatcggttaattctggataagtttccatcggttaattgtctcatttcattaacaaatctagtaaaaattcttactaaatttggcgttaacataaaaataatctaaaatgctataaacattaataatattaataatattgaacgatatatagtcatataaatatatactatctccaatttttttaatatacgaccctgttgacttatcatttattttattgtgatttgatttatcatcaaatgttctttaagcgtgacttaaattaatgtttgtacaacaattttaaataagactaatggttaaacatttgtgaaaataatctcacaaaacgaacaagacgtacgaaataaaggtttcaaaggaaaatacatgtgtttatttctcgggtggcagtacagatcatcagcaatttggggcaaaatgttactacatatgaaacaggcgaaaaatacattcactgtaaatacaaaacaatccttgtttgtcatgacttctcaacagctcatcgccgaaagataacatataccgcaaacatgtgtcactgaagtgaggcaacaaacatcccttgttaggttaaactactaggtaattagcgggcaccaaacaagccctctgcgaatactttggcgggttaccatccttcagaggacggattccagtaacctgcaaggcatgcagaaaacaacattatgataaaatgacaccagaaggaagatcaaatatggaaaagtgcgagtctgtaaacaaatatggggagattaccaaccttcaaatcactgaatgtactcgatgcggaaaatccaatagatatggggaaaaatgttgatggatcagctggggggacaacgaattccatggagccactgcaaataagggggaaaagagttaacaacggagggcaaaaaacccaaatagaagtacaaaacataattatatgaactcatatttcaaggacctgcggttcgactgatcgataagaagaatggaccattccaacacggagtttctcgagtcatacctgtatgcacagtgaaatgtgaaacaggcattagaccaataagctttcactgtgctgtctacgttattgccaacaaggaaaaaaaagttgagctctatctacaagagatgtcatttaggaccaattcatacaagggatctggactaaatcccgataaattcaaaacacatccctcttaagcatacagattaacagtttgagatgccaataagactgtcaggaacaaaagccagaattgaaagttatcacttgttatattttaatactcctaccatcaagactaaggaaggagacaagtatgacctgttggaggattattttagtataatataacagataagttcactaaagaggaatttgaaacattacttccattctccatcaatctgtctaacacttggagcctcccggagagcaggcaatggtatagagatgacaacattgtgcaggtcaaacatctcagcagcttcatactcaatgttgacataggtttcacttccagatactgatggccagcagttgactatgcgaagaaaaagcaagttaacaaaagtattaagcaaccagtgtaagaaaaatacatgtccttgaagtacgagttagtggacagaagaaaataaaatgattgtgcacctgatagaggtaacgatgactcatccatcccctgaattctccatttaaccagaggagtttcattttgaccacttgggaatggcctgtttggatcttttgctcccacaacttgctgactgttaaacagatccttgttgatattggggtgtgttttgaagctaagtccaggtacatcttggttttcaatctataagacataaatatgaaatgatcagctatgatcaatagtatctatgagaatggacagaacaatgctgctcatcggcaatgcaaacatggagcaacaatcaaagatgaaactgaacataataaaaagaaacaatgttgctcatcagggacacaaacatggcatgataagcataaacaaatgcaaatgtaccaacaaaattggaaaccatatgacatggaccagaaatataaatgtaaaggaattatcttagctgaaggtgaatattgtcgcaaaagaaaagatgacccaatataacagatgcattctatttacttatgggtacatatctgatatctcgtatagatttatataagaaacaaacaaaaattgtgttacattctttggtgttgagaatttctgtaaaaaaaagaattcaagcagaatgctataagttcagaaggaatgttacctgcaactggataaacccatctgcatcattaaggacctgaagagcaagggttccttgcacatcaaagttattaacacctccatctcttttaactgtaacattgagtttttcttcaattgtcactgtgacaggatcacttggtggaagaggcgatgcccttgactgaactgagctgggttgtacatcctccagaatgacttctccttcagctttcaaagactctaggaactgattcgtcttctgtgttttgcctaatttcataccaagacctttaccaggagcagtagcagctgcagatggacggcctgtgcaaatattgctagcaaacataagtaacattgtatagctgactgaactttgtcaagcagttttatgtaaagcaggagtactggcatggggaaactatattacgaatttaagtcttgagatatttgaatatcaagtaccacaagaagaaagtcctaggttaacacagtaagtttacccttaattgttatggcctaacattaatgctagaatataatatcagccaagaaaaatgcagagagttttcaagttacctcctttgggcttgctagcaaatgagtccatatccatgcccagtccacctaatccagaaccactcccaaatccactaccggtaatgctcatgtcattgaatgttttctcgattacccggggaccagatattgatgagtatcctcctttgtcaagttttcctctttccatctgcaagaacaccaaccacaaaagttcaccacttagacattaacaaatgacggcaatgccattgtaatttaagcactaaggtttgcgcgagctaagctggaaccaaagaaatgacaagctgacagaaaaacagaacacaaccaaaaagtcaaactagaaatagtaatggaatattgttttcctaatgatcaaagtccactacattaactgtcatttattttctcgatataatatgtattcttaatatgaaaaaagatgcagtacataccctcatcttatcaagctcactagctttcttcttcatcacgtcccttgtttcattgattttgctttgcatcatcagcttgtgagccttctcttcatggctctccatctcgcaatattgtttgacttgttgaactgttacattttccttatttccaagagagatggcttcatcgaaggcaaatataagctcaaatgctgttttacaaacaccctcctcatcaagagagggggagtattcaggcacctatacaactgttaaggagataaaagtactggattattgccaagaaagaaaatcaatgcagcttaggagcaagtctgaagatggatggatatacaaagcccaaaaacatgatagtttgcatgttggtttcaatctaaattcacattgaaaatgtagtgcctttctttcctttttgtccccttggtggtatatagtgacaagctcaactataccgagacattataatcttcatcttcattttatcccacaaaacaaacgttggtaacattatgtgatatacatttattcactacagagcaatatatgtgtaggttaaaaaaccatgttttatatgtttcataggataggattgtataggttagttaggtcaaaaaactggaacagtgaacatatgggaaaaaaggatacaagcttagagagcagcctcaaggtgtccagatcttcaagaatattgctctgcttgtttgtgataagtagcaagtacaggccttctattggctgataaacatagcgaacattttcagtctcaacataagtgtgctgcttcccagttccaaccagtttggggaaagctgcaagtaatccttcaatccttatgcgagacatgtcaacaaactgtcttgaaacaagtgctgcaattgaaaagcacagaaaagaaacagcatttagtctaatcacattaacttcctggaatgaagcatcaacaaattggtaaccaggaggtgctcactacataggattttagggttataggagttaagaatctactgaggtaacacgataacagctagtttagtatttgggttccacaaatttgcatatgagctaacactcttattagcataggtgaatgataaaaacttatacaaatactttttttttctttttctatgaacaaaaggatttgttttgattacaatataacaatataaattaaaaaaacttcttttcggcactgagaataatacaatacaatatataaacaacagaatatttcaagccagctgacctttcccggactttgaaatgatggaagcagcaagaaccacctgcggtacacaaaaaccaataataagctctcctaaacaaatcaaccacttgcttataccagcaaaatgtcagaatgttccttcttaatattacaaagagtaataaaccattaggcataccattttgagggcttttttggtactcagaattactgcacttaaaatggattcaggaattatgcgcctgccagaagtggaaaaaacaagagattattcaatcagtacgacataatcagaagatctcctgcgagcttagatccaggccccaacttttcttttttgcttccagatcttactacttagtactaagaaggttaagccaaattaagagaaaagcagcttccagatccaaaagagaagctatgatttaacgcgaatcgacagagaagaagaagaagaagcatattgggtagagatagatgggaaacggatggatggacgctcaccagcgagcgagcgaaggatgcggcggaagaagcagcggggacgccggcgctgctgctcgcgggatggagatcggctcaggcggccggcggcgagctcgcgaggagaccgaggagacgcagggagatcgctcgccggaggcagccgcgggatctcgagcgcctgtcagaatggctgatgaagtaaacaagggaggtagctgctggtcccactgtcagtaacttactacctccatccattgtaggccgagtttagttacaaaatttttcttcaaacttctgactttttcatcacatcaaaactttcctacacacacaaacttccaacttttccgtcacatcgtttcaatttcaaccaaacttccaattttaacgtgaactaaacacacccgtagtattaaggtgatttctacgtagggtgtgtttaattccctttaaacttttaaaagttccgtcacatcaaatatttggacatatgtatggagcattaaatatgaaaaaaaagcaattacacagtttacatataaattgagagacaaatcttttgagcctaattacgccatgatttgacaatgtggtgctacattaaacatttgctaatgacggattaattaggcttaataaatccgtctcgcagtttataggtggaatctgtaatttgttttgttactaatctatatttaatacttcaaaaaaaattaaaaaggaactaaacacggccaatatgatgtctcattctgtacatgggttgtgggtttttttttttgctagctttcccaacttaatcgtctcatttttcgcgcacatatttttcaaactgcaaaacggtatagtttttataaaaattttctatacaaaagatggcgacgtagagctgcatgaagatggcgccgctgagcctaacgaatcccttgagcaagccgagctcgatgccccagctctccggggaagttcttgacgcaggtgacaagcacgccggtgttggcaaacgactgcgagttggcgccagctccgctccgctgcagccgacgccctgctccactccgccggccaccgtcctcgctatctccgctgcgaccgacgccgccccatgcgcctctgagaatagagagagaggagatagagctgacatgtgggcccaagggcatttttgacatttcacgcgatttctctttcctcttcaaccggaaagtattattttaatcggcgcgatgtccactggcaaattaccacgtttatggagtgttttcccccaaaagtgagtttgggcagtgtcctagggctaaaaccacacataaacagtgtcctgtagcaaaatttgccttagttgttttaagtataaatcatgttttacgtgacgtaaaacatgattttgctgtacttatgtgatgagtttggttcgttaatacacgagatgagtaaagggataaaagtttagatatgttcatatctccttaatgaaaagtaatactctactccggtttcgagaattgaattgccaggtgttgtattgatctcacaatcgagttatagttatacacttgtacgcctccctgccttacttatatagctttgggggcaaggcttacaaggagaacaacctagccggatatgatttttttctatgcatttacataatcatatataacttaagactatggaatatagcttgaaatacaatgcaacataatgtccaaagcattcatacatatacttccaatagtagtacatctatgtgcaaagtcgtatcttcaaattcattttacatagacagagacaaaattatgacagaattacaaacttaaaactgtcaaatttatttttgttacggctaaaatattatgaatttgaggttaggattttatccctaagtgtaatactattgaaagtacatacgtgaatttttctagattttttagtgacatttgttagttggtgtgcacgtgtgtacacgtgaaagcttgtgtgcataacatatgttgcctcaccacaattggatcagaaactctacacttgttgtctatgagtttttaaccttatggttacgttcttgtatgattgtcgaggaagtttagtagcgcatgcgaaacgaaagctcattagcatataattaattaactattacaaacttaaaattggatttatttgattttttttaaataacttctatgtattctttttaaaataccattcaacagtttgaaaagcatgttaacgaaagtatgctaacaaaaaatgagaaagttgaagtttggagttgaaaaaaacaactgagcctaagagattagatattcgcttccaacaattggattggaaactctacaattacacctaacttagctatctacgagtttttaacctctaagagattagataaaaagaacttgttgaatgctggtgcttaaaaaatccccaaattttcaccaagcacaggagataacccactccaatccactcatacagacaaatcacgaagaccaagaaagagtagggaaagaatgaatctcaacaaactcaagccaatggcaccttaatatgctattgcaataaaatcaacaatcttagctttggggtggggaggggtttaaataccgcctcacactaatctgatggttggaggcaaagattactcatatgggcttgtggtaagccatggaaggtttgtaaatgcttatattattggtgaaagaggagtgcatttgtaaaccaggttagagatggaaaagtcccagctttttatgagctactcaacaaaggggtataatgctcttaaagatttgaatttcaacaaatacatcagcttcgcatctcaatgaaatcatgctatccatagtagttctgatttttgcttacttgtaccacgagtaacttgttgtttgtgctagtattgtttttctagtgctacatatagtagtcgttgccatcttgatcttgctggtgcagaatctatgtcggaaaaaaaaacccaccgccattaagcaggcctgaaaccccaaaaagaatattcagctcgttgatactagggtaaatgtatccagaaatatgagtattccttattcattgttgttacctggtgttaaacttgctgcaacaatcggtctccaacaggaacctataattactttatagagtttggcaggcagatacatggattgcaaaacgatcatgctagctgcaggcggggggttgtacaagtgatccgggcaaaatccacaacctactcaatccaatccttctcttcttcggctggagtatccaccttggctgctgcagaagcgtagctcacgctgctgtctctcatgctcttgcactggcttgactgttcataccgaacaaatctgatcttgatcttcgtcgaacaatgtttcagcatctggaacattatattgcataaagaggacgaagttatagaagtagaaatgaagagataacactagttagatcgccacaacgcttacactgaggaaaacgctgatggggtggcgcccacatatggtattttcatactcttgcaagtactgcttgaatgcatctggattaccagtctctattatctccatgcccatgtggtccaaggcctctatcgatttatgtatagcaccatggctcttgtcgtagtatgtgtaactaaacctgatgagacgatgcaggtgagcataatcatatgcaaatcctataagatcgaagtaacaactacaacttagcctggtgatgtatcatgggcaagcgttctttggtgtccaattatgaaatgaactgatctgggctgttcaatcacgttttctacactatcgatcaaagcagatccgggtgaaacaaagcctggagcaaattagctccctttttacttcccaccaaaatcttatgcaaataaattgtgtcgtccctgaaccgcaaacaacatcagcccacagcgacctccccccatcttcacactcctacaactccaaacgcttgcacactggtgatcaccatcgttgggcagatggtggaccccaacatgatcaggctaagccatgtggcagaagtaaaccaggatacatctacagcatccggtgtttctatagatgaatttagcagggaagcaaggtgctgtcaccatccaccagagatggattcgagattggggtttgcgatatagtgttattacaacatgtgccaggtggagttgtttttttctttcaaaattgagatggttctaggatctgccaattggatctgatgggttctcaaattccatctgatgcctatatcgattattcgagcctaaatgttattccacatgataagttgcatttatgctaagtggaaatacaagatactgcacaacaatatctagagtactcttgctatgaggggttcaattgatagacaaatgctgctcatatgatggtacccttttcgttattgagagcaaattttgacatctactgaagttcaaatttgcatatacaaaattaagattttgtactgaaatttaaacttggaaagaaccatatttgtaagtgtgatgatgagttgatctgaaaagagagtcatagctaaaactgctattatggcatactatctaccttctggaaagagtacaggtagaaagactaagaatttggacaatctataggcctactaaaaaaatattcggcaagagaactctaagattgtggattttgcatcatgagctcattttaactaaattggctagcaaatttaatgaaaaaccaggcatgccaactcttctgcttttctacatggccagatctttagcctcgaataggccaaacactgcaaacttcattaattagttctgcagaactagtagatgacaaatgtgacacaggacaattaaagttttctcacactaaagattaccataggaaaacaagcaagttggcagagcatgaaaaagctgacagtagaaattaagtatttaccgggttccccagtggcagaaatctgaggagatagaaaagaagttcttcggatcgtcaagatatctagagagcaactgcccatacatggcttcattttggtctcaacccatttacagaaaaaggggtaagttgattagtgggtgcaggagggtctcaataaggtttagagatttaaacattggtttaagtaggtaactttgcaaaagatccgaaaatatttccttttgtaaggcatttgacctggagaggtgcctttcagaattttttttttccaatctcgtctaattttgtgatgacccagatgtttcagttgcccagtctttagaggaaggtgtctcagatgtttcttttagaactcttggaatatcagaatgtactgaaacatgttgctatatttgctgagtagggtgcagttctataaagtgtaaatcatgtgagttggctgttgagaaatcttaacgccttttctggtcaaatgcatcgtttatgttaagagagaactggctacctaccacccagatcttctatacagatatataccattgatttttttggttctccttgatactatcaagaccttctgatccttcctctaattatcacacatccattttctcacattaactgagaccctgagctaccctatctggcatgctatacaccgtcccataccaaagccctccatccttaacacatagaactttgcctttgtaaccaccttggagagaaggcctagtgtgcaacatggccccctcttcccctcagaccagacttatactaatttgcttttgttattcttgatagatgggtgaaattcaaacaaaatacaagcagattgtttaagcacaacaggaagagatttgttgatacatcgtgggtaagaacctgcaaagagagaacatgaattcccttagcgcgttggatcatcgaataatctgagccagcggattctcactaaacctgggtaaagcccaggtttagtgagggatgtgacacccctactatcagttattgtgctaggaggggtatgggcatgctcagcgctttaactgatagcctgagagttttgtttagtgaggtttgaaggctaaatggtttgttctggacttgcttattttgtttatggcttatgctggtctcccttgcaagggccttatgaccatgatgtttgctttgatcaatgtaactaaaggccatgctgctactgagagaaagatactccatccgacctaaaatatagcaacctaatacttgattagacaccacctagtactatgaatcttgataggggtctgtccacattcgtagtaccaggtggtgtctaatcgagtactactttagtattttgctatattttaggacggagtgagtatatagatgtgtggtttttgcatcaaaccagttacacattgtttgcaacgaggagcacttgacaatgtttaaacacattgaataatataataactcatatactgtacagtgtgcctgtggcaattcacttatattggactaatgtgtgatattgaaaattttcaggcaactcaagaaaaagtagcaacgatagcaggtggggtggcagattattaccaccactactttaaaaggggaatcttaagcacaaatggctctgtctgaaaatatagaaagttcaaaacagaaataattaatacggatggatgtctaaaaataattatgtcgtaaaatcatattagtactgctaaagtgctaatcatgcatggaaggcatattgggtcaggttaagggcaatactaatgttggtgttctggcctattatccaagagaaatcttaggtaaagacggtaattagattgcatggcatgtaatatgaatgtaaaatattcaagtcagtaacagcataccttcatggtctactggcaaatccccaattggggtgctataaatagtagctcttgttaatgcgcattttggagtatagtagtgatgtgaggggcctaacaggaagacccgagaactggatcacatacaggaaaacatattagatgggcaaagtgaaaattagaataaagtaatcagctataataatgtaagtagtattttttggacattcttaaaagctgaagctgattctgaatttcagagtttgattttgcatctctcttttcatcattgttaaggagacaagtaaaaaatctaccaaaactattcttaaaaatacatattcaaaattcaaaagtagcagaactattgcagtgtttagaatgacaaaagcatatcatatatttatgcaacaaaagtgaatgttttatgattatcttggtgtgttcggtttgaatagacatgggatgtttggaaactgaggttgtcaggaaatggcctatagctttggtggtgaggtaggtgtttaacatcctcactcacccgggtttaaactctaggattaatacatgtgaccatctagttctttagttaatgctagaacccatgtccaactttcaaaataaaataaataaaaatgcatgcatcactcataaagatcactttaccaattataccaatgagagataaaagtacaggttgataaaatggtacatccgaggtacttttacatgaaagcattcaagtcaaggtattaccagtacagcaagacagtgatttactattagaagatctgaaattttgagagagtaacagtaatgtgtaaataacatacatgttagttggatcaatgttgccaaaagcatatgccgcacaccgccctgagtatgaatagccagcatggctgtaatggcaagaaacaattgttaaaatagaacagaagaaattcaccatcatatgaatagttaaataccatcttacggcgcaattactgcactcacatcaggggacttggttagaccagcagccctcagccaaccatcaagttcctcatccagtttcctggctaacatggagtaacgaatttaggagacagagctaaagtggtaaattgtcgaaccaaaattttaaaaagaagaaaatggttgagatccctgaaagttttcaacaaattacatgcttttatgaattaatgttggaaactgcagagcaagaagataatggagtcagctaggaatgaatggttcaactcccagtaaaactaaacagctcatgtgtttccagaatggtctgacagctaaaatagttattgcatttgcataacaaatagcaaatgatccagtttcatcaatcatgtcagcctactacgtgtttgggcaaaaaagaatgatattaatctaataagcagtacctaaaatgtcatcatgcctgatagcacaataaaattgatccatgtccatatgataaggttgccggtaattcattccttctaataaaaaactattccgaaagtgcataatttatatgaaaccatgtataacaatggcaagcggttcctgcatttttctaacaatataaaaatagttcccacaatcttagcaactaaatttgaagcaagagagccgtaatgactggtgaaatcatccaaaatgccaaccaaacaattcaagcacgcatatttggatgactatcaagaaaattattcacaacaacctgcaaaacatcaaccgccaacatatatcaagttatcaacagtttgaagctactagactatttacactccagatcgtttaaaactaaaactccgaagatatgcagcatcctcttttgcattttgaaaagcgcacacaatcgaacaagtcaacactcactcctccacaacaaacaacacaagtgcactccaagaagctaggctaggccgcggaattgagtaatcaccaccaccgaaccggaccccgttaattccccaaatctcgtaagcaagaaatccctcctctaacttctcccccctccccaaaagtgggagaatccatcgattggattgaactagtaagaagccttctacttcaaccccacacccccctgccccaaagtgggagaatccatcgatcggattgaactactccctccgtttcacaatgtaagactttttaacattgcccacattcacatagatgttaatgaatctagatatatatgtgtgtctagattcattaacatctatatgaatgtgagcaatgctaggaagtcttacattgtgaaacggagggagtagtagagattgcagtagcggaggagagtggatcaagtaccattgttggtgtaccaagagccggcgtgcgaggccctcctccatccccaccccgcagcagagaagaagagcggtttcgatggcggcagcaaggaagaggaatccctccctcccctctggccctctcgtcttccttgttagcttaggttggtttttccgtctgggctgaaaaataaaaagtaatcactgcctcaagttgccactccaactttcaagaactgcaaaagaagaaaagatatgtagtgattgagaaaaaatgagtcctgaagaaaatagtatttgatggcctgtttagcaagagaaaagaatgggctctcctcatcaccaaaagaaaacctaacacaaagttagcttcaacagacaagcaccaagccactgagattaatccgttcaccaatttcaagttgaatactcaattgagaccacgtggatctttacaccgaagtgcatgtattatgttcatgtgcacacatgcaagtataaaaggtggattaaagtagatagtgtcctgctgcaatgaaaatcccaccgattcacaagtaaatagcagaaaagatgacagacgatatttcccaacagattcgggtgcactgcttaaggcaatactacaaacaatattcggattcctatatgaacagtagtaaacagtggagtaccttaggaaatccagcgatggacgtcgggggcggacggatcagatcggcaacggggaagagatgttcctggcgatggcggttggatcatggggatggggggcggcgcgagaaatgtgcccggcggctgaatgcggagatgcgcggcatcggtgacggcgatgaatcggcggcggcacctgtgagggcgaggcagagatattagaggaggattagggtttggaagcgcggcgaggaaggctgagcaggagcagaccgcgaggagatcttgacgatcttgttttgcccggcgcggcagccggcaggggcaaaggcggcgacaggacgagaaaatttacatattgctaactccaaaaacgggtttcgctcaaatgccgtataggagtggtttcacctgaagcctacttactataatacccgaacagacaaaaatacccttatttctacccttcttccacctccgtcggtgaccagcggcgcagggatagctggtctgcggccggcgcggcgcgcggtcgcgtgtttgtcactgggggcgtccgcgcaggctacgaccctgccgtcacccgctctggcgcgttgtgggaccccgcggcctcgccgcccaccgccgcgtgggagccgatcctgccgctgcgcgacgggcggttcagccgcggaggccgtctgctccggcggcaaggtctgcatggtcaacctccgcagccgcaacgctaaggagcgcttagtgttcgacctccgtgccgatcgttggaaggacatgccgccccgcatgctcgccggttggaagggccccgcggcggcgtcgcccctggacaacggcgagaccatctacgttttggatgaggagcgtggcgcgctcaccgcctacgactggggcaccgctcggtagaggatggtagctgagtccgagcgcctcaagggcgcggcggagatgaccgtcggcggcgggaaggcatgcgtggtggccctcggtggtgggaaggtgttgatcgtggacatcatgccgccgtcgctgctcaagacgtcaccagcagcgaggagggaatcgtgggacaggaggtggcggcgccggctgggaagcaggtggtggcaccagatccacgcgctcgtcggtggcggcggcagtcggtgaactacgcactcggcggcaggcagtgaaccgcgctcagcggcatgtggatgaagggtagcattctggcatgtaaccttcggttgaaagtggcattttaaagaaacccactaccagcatggcatttgagctaaacctggttttgaagatggcacaacgtcaattttctccgacaggacaggagcagcgatgaggagcctcagttggatgaaaaccgtcggaaaaacactataccattttcattttcttttttttcgtgaaaacggaatgggaacgttagacccgaaaacggtaacgaaattggtaatattggtatatcagaaacgggaccatcgaaacggaatatactgatattggttggaagtcaacaaatcatatcggaatcagcgaagagtggcatagaacaccgagaaaactaattcacccatacacgctggcggcgcacacttccacgtgaggcatacacccaatgaaacctgctacttctaccgtgtgaaaggtctgttgcatgattctatatttctatcttgcacaagttagttaatccatgcccacgcgagattttgcattatttttttcgtgttttttcttaatcacgcgtgcatgattttttttcacgatttttttttatttttttgtgaattttttaaatcatgtgcacctgaatgcgcctgattcaactcgaattttgagtcaaaagtttttaaaattttagttaaaagttttgaattttgagatgaaagttttcatatttgagttaaaagttttcaaaatccgatataaaagtttttaaatcttgactttgaaagttttcaaatctggattaaaaattttcaaaaaatcttgttaagttttcaaatctaagttgaaagttttaatttgaaactttttaaatctaagttgaaaattttccaaatcgttaaaagttttattgatgtactaggaggagaggccgagaggggctgtgccatctagcacgcacgtacccattaggaatctctatagcacacatttaactatgcgcgaagatgaccttttaactttattcttacatcatcacactccacataacatcattatatgatgattaacgatatgataataagtttgataaacaatataaacaaagttcaacagtactttagcatcgataagctgaggagaccaaagttcagcaaaatccacatgccacatcatagggttagcaacattttcttggtcacttccccttttttatgagctgcaagcgtaccaggctttcttcatttatgggcttccgatgggtttggccggctgagccactggggaactttcagatttttttttcagaattttgacgaaaactaccgtacaaatacagttaccgacaaaccggtcgggaaaacctccatcctatttccactaccattttcggaagatattatcgtttccatttccaccaccgtcggttaccgataccgactgaaacagtcgatgcaaactgaaaacggcagccgaaaatctcggaaatttccagatcgttttcacccctacgaggaggcgggttgtgtcgtggcgcaactgggcagaacgcattttcgggtggtggtttggtctttggtggatgtgaaggaggtgggaagcagtgcctaggcatgttaacacttaccccctctgtccgaaaaaaaaacaatcttaggtttgaacctggatacatgtgtgtctgtgtccaatttaggttcaaacccatgattgatttttttttggagggggcggaggggacggagggagtactggccatagtggcatcggtggcgcagctttgcgtcgtcgtggtttgcatgtacactcagccatccgcaagtggccgctacgcgtgcaagttctctagtgtctggctaggattgagcgagccaaaaatatcgtataaaggaaatgtgcatatggtacattttgttagcacctaatgtaactggccttagatttatgccgcttccctccttgctcggccgccacgcgctacccctcatcactcacacctggagagaggacagagaggggagagagatgaatagaggggagttgaggagagaggaggggtgagaatgacatgtgggacccacgtggcccccaccattttgaaattattttttttggtgtaattgacatgcgggcccacaattttattatttttcaaatcaaattgccacgtaagcgccacgtcactgccacatcatatgaagtccgagtcaaattagccacgtaagcgtcacgtaagcgaaaactgccgttcaaaccgccataggacctatattgcaccggttttgacagttgagggacccgccgtatctagtttttcggttgaaggacgaaaatcggattcgttgacaagctaagggacctcagatgaacttattcctagaagagaagatagatgaagtacgttgggcttgggcccaaggtgcggcccatcccttcccagccgtctcgtctctctctctctctctcaaaaaaaaaaaaaagaagtggagtaattttcccgtctccttcggcggcatccaccccaattcatccgggaaggggaggaggcgtccttccttcgccgctaagcaagcatccagcccacccagccatccatccagggaaagggtaggggaaggtggcaatgaggatgtccatgcccaggtgactcttagatttcttcggtttgagggaagggaggaagggggatcgatttcttcttcggttctgatttggcggaggaggaggaggagcacgacacccaacgatatggtgggcgtgctgtccaaccgggtagatcggctggacctcgccgccggggatcacatctactcttggagaactgcctacctctatgcgcaccacggtgattcttcttcttcttcttcttcctcctcctccgatgcttgctatgcttcttcatccccaaaaacctagtcactcttcatccatgtgaaatacaatgtgtctgatctggagatggagaagtagtagtaatttgttcatggaaaaaacannnnnnnnnnnnnnnnnnnnnnnnnnnnnnnnnnnnnnnnnnnnnnnnnnnnn

SEQ ID NO: 9647 - DNA, 396 bp, Oryza sativa
ttttttttccacctctacaggcggtaaaggtttcaccgagttgggtcaatggcgcaatttgggaaaattgcaaaaaccacactaaatgtcatcctgattttgaaattcccctaataagattatttgcaaatacacagtcctaattcaccttgattcgatattcctcaacatttgccgttgttcgcattttttttccttttccctcatgtgttatatgacttagcgcatctaactcagtgtgacatttgggattgtttttacaatttttccacgcaaacaagatagcccatgtgttacgcccacatgtgcgattaggtatgaccgaattaagcaaaatgcccatggtcgagcgccctcctgttccacagctacactcaggcccggtcctgggatttt

SEQ ID NO: 9648 - DNA, 1286 bp, Oryza sativa
aaatcccttgtctctgaacccatccacttttccagcttgatagccacccccttttagtattgccgaaatcttggttccacagttggcgcgccaggtaagggcagcgtcaagttcttcgccgactagtgtgatgggttccgtctccggcatcgacgacttcgtcttccctcccggacaggcgttccggttcggcagcctcgacttcatcaccaacgacttcggcaagatttctctcctcgactcggattcgaaccagtcgggaagaggtcagatctccgccccgttcggtaccccgaactcggccgaggtctaccccaagatcatctctgccgagttggcttcaaaccactcgtacgagatccaatctactcggacacgaccagatcaagatgatgggtcctatcccccaatcctgatgagacttcccgatgatctggctgctgtcttcacgaccaaggcatctcccacccgaagacctagacgggatccggcttcggcttcgatccaatctagttctagggaggtaggcgttatatttcagcctctcgggacggtctcgacggaagaattggattgctacctcagctcccccggcgtcagttctcgaccaacggagatcctcgagtacgacgacttcggctatcgctacgactacggtaacttcgacgacagctacgaggacgactacacgcctctctttttcggtgtattcatggccaacaacgagacggcagaacagtgctgagcccgagaagcggaagaagaacgcacacgacaagaagctgaatgtcgccgactggaggaagaatgacaacgacaagagcgagaacgactacagcgtgaacaacaagatcgcgaacgggctgcaaaggaggctgaggatcgacgacagcgcgccttggaatccgggcgacgagcacgagatctcatcgggcaacaagtcgtcgacgggacagcggttttccgcacaccctaacagaacgcggttgcagcgatcaccctcctcgacaccctcctcaaggaagacgcgctcaatcaggctgatcacgtcgtcaacatcttaaaccagacaaagaccatgatcgccgcctcggtcccggctaactccgcaagcacccgcacgccgactggcagccgagttccccctcttcgatctcaagactatcaccaaccaagcctcagcgtcatcggcgcgggatccagtcgcaggagcaggggtcacgacgagcgatctgtccattcgcctcccgaacgacacagggagcgtcgagtgaacgacctcgtag

SEQ ID NO: 9649 - DNA, 24610 bp, Oryza sativa
  unsure (1)..(24610): unsure at all n locations
cgctcggatcatcctgaccgagtggtccacccggggcggtaccccctggtactagaccctgtaggttcgcaacgtcaagcttcgcagatccctcatcgatggtggcagtgcctcagcatccttttcgccaagactctggacaacatgcagatccctcgcacggaattaaaaccgagtaatgcgccctttcacggagtcatcccagggctatctgctacaccacttggccagatcactcttccggttactttcggcactcgggagaacttccgcacagaaaacgtttgttttgaagttgctgatttcgagacagcgtctcatgccatactcggacgcccggcgttagccaagtttatggctgtcccgcactatacctacatgatgatgaagatgcctggtcctcgaggagtcatatccctgcggagcgacattaaataagccgtcacatgcgacaaggaaagctgcaagatggcccagacccgcgagatcaccctcgctcgagaagaaatccgactggctgcgtccacagcaagcgaaggagaagtgcctgcaaccaaggtgccaaagagcggagaaagcgacgccaagaccaagaaaattcctctagatccctctgatcctactaagactgctgtaataggcgctgagttagattgtaaataggaaagcgcgctcatcacctttcttcaaaataataaagatatctttgcgtggaaaccatctgatatgccaggtattcccagagaggtgattgagcactctttacatgttaaggaagacgctaaacctatcaagcaacaactccaccgtttcgcacaggataggaaggatgcgatcaaggaagaattgactaagctgttagcagcgggcttcatcaaagaagtccttcatcccgactggctggctaacccagtcctggttcggaagaagacggggcaatggcgcatgtgtgtcgattataccgacctcaacaagtctagtcccaaagacccttttgggttacctcgcattgaccaggtagttgactcaacggccggctgcgagctactcagtttttttggattgctactcaggatatcatcagatccgactaaaagaatcctactgcttgaagacttcattcattacgcccttcggggcctactgctacatcaccatgccctttggattaaagaacgcaggagcaacttatcaacgcatgatccagagatgtttttcaactcagatcggccgcaatgatgaagcttatgtggatgatgtaatcgtgaagaccaaacagaaggatgatttgatcgcggatctagaagagacctttgcaagcatccgcgccttcaggatgaaactaaaccctaaaaagtgcatcttcggagtaccgtcagggaagctgcttggatttatggtgtcccatagaggcatacaagccaacccggagaaaatcaacgccatcctcaacatgaaaccgccgagctcacaaaaagatgtccaaaagctgactggttgcatggcggcgcttagcaagtttgtttcgcgactcgacgagcgggggatgccctttttcaagctgttgaagaagacagancaatttcagtggggactcgaagcacataaagcctttgaagacttaaaaaaacttttcactactccaccagtcctagcttcaccacatccgcaagagccgctgttgttatacatgtcggcaacttcccaggttgtaagcacagtcctggtgttgagcgtgaagaagaaggccatgttcaaaaagtccaacgaccaatctacttcgttagcgaggttttggctaattccaagacaagatatcctcgggttcagaagctattatatggtgttttaattaccgtccggaaattatctcactacttctaaggtcactcggtcacggtggtcacatcgtttccactcggggatatacttcataatcgcgaagcaaatggatgaatcgcaaagtgggccttagaattgatgtctttagatatatccttcaagccgcgaacttcgatcaagtcccaagctttagccgaatttgtcgccgagtggactgagtgccaagaagacatgcccgaggagaagatggagtattggaccatgcattttgacaggtcgaagaggctttcaggcactggagccggggttgttttaatctccccgactggagaaaagattgagctacgtattgtggatacatttttccgcgtcccataacgtggcagaatatgagtcgctgcttcacggattaaggatcgcgatctccttgggcattcggcgtctgatagttcgtggagattctcagttggttgttgatcaagtcatgaaagagtggtcctgccttgatgataacatgaccgcttatcggcaggaggtacgtaagttggaagacaaattcgatagacttgaactcactcatgttcttcggcacaataacgaggcagccgacagactggctaattttggttcaaaacgagaagtagctccttccgacgtgttcgttgaacatctttacgaaccaaccgtgccaaggaaagaaacaattgaagccacggatactcaagacgtaagtatgattgaagccgactagagagagcccctcataagatttctgatcaaacaagaactcccccaagataaagatgaagccgagcggatttccaggcgcagcaaactctatgttattcatgagaccgagttgtacaagaaaagtccatcaggaatcctgcaacgctgtgtgtctttggaggagggaaggcaattgctaaaagatatacattcaggcatctgtggtaatcacgctgctgcacgaaccatcgttggcaaggcttatcggcagggttttttctagcccacagctgtgtccgacactgacaaaattgtgtgaacatgtgagggttgtcaatttttcgcccgacaaactcatttaccagctcaggagttgcaaaccatcctgttgtcttggccgtttgcggtttgggggcttgacatggtcggcccattcaaaaaggcagtcggtggttatactcacctctttgtggctgttgacaaattttccaagtggattgaagctaaaccggtcattacaatcatggcagacaaggctagagatttcttcatcaacattgtgcaccggtttggggtacctaatcgtatcatcactgataatggcacttaattcaccggcggagtatttaaagacttttgtgaagacttcggcattaaaatttgttatgcctccgtagcgcaccccatgagcaatggacaggtcgaacgtgccaatggtatggtacttcaaggaataaaagcgcgagttttcgaccgactgcatccttatgccggcaagtgggtagaacagctgtcgtccgtactttggtccctgcgcaccactcccagtcgagctacgggccagtcgccgtttttcctagtctatggagcagaagcaatgtttccgagtgaggtggaatttgaatctctacgatttcgcaacttcagcgaggagcgctacggagaagaccgagtagatgatatcaaccgactggaagaggcccgtgaagcagccttaattcagtcggctcggtacttgcaaggggtgcgtcattatcacaatcgcaatgttcgctcacgagcttttttagtcggcgacctagttctgagaaaaattcaaactacacgggatcggcacaagttatctcccttgtgggaaggaccgttcataatttctgaagtcactcggccaggttcttatcgactcaagcgtgaggacggtactcatatcgacaactcttggaatattgaacatcttcgtcgtttttatgcttaggcattacttttgtatcttcagctttgactgctaacatcaagcttttccttgagttatcagtcgggggctactataataataatggagtgtgacttttatcaattcaatttgcttacttgatttatcattgccttgtttgattttttggcttagtcaatgaggactgaaagttttttaacaacttttgtgggttttaggctcaaaaaggtttgacaaaaacttttaagaaatcgggagctaagtttgaaatatcaagcacaacataaattcatcagtattgtacaaattgtgcctccatcatcatcatcatcatcagaatcactgttacagtataatatcaatcagtatcagttttctcatcatcggaattattagatccagtcggccggaggtcgttgtcctggaatctctcaactacatcaatggctatcttgtcggcggctttctacgcatcgttgatgaggtcaagggcggcttcttcgctcgtcccgtctgcaaatccatcaatggtgtcaacatcaatcttcggttataaagacttggtcattgccaacgccaggcttgctcccatacttccggcctctttgatattcttaaagtatgtatccggagcgattctcagcttgtcgaagatttcggaagcatcaaatgtactcggaccattgttattgaagaacatggcttggacgagtggggtagcagcgttggcgacttcatccctagccccttcaagccttttgattttattgaccaagacatcgaattgagcctgagacttgattttgcgatctgcgtaaatagatttatatcaacgagtaggcataaagataagaggtattagtcaccagtaccttcaacatctttcagagccgaatccctctgtttcgccaatttggccttgtcattctccagagtttggatccgcttttctagttcagatatcttggcggcttgcactgtattgcttcttgattaattgatattacaaggatggcagcataagtaagttagacatagattgtatttaccttttgacgaaccgctcagttcaaagttggattcttgaagctcggcgatccgatccctcagatcatgctcagttttcctggcaagctccttagccttgtgcagctggtttctggtggtctcaagggttccaagatgaggaactaaattctcaagagtcgcggtcttcgcctcgttcctgagatggattctctgcaatgcgaatttatcggcatttgagcaaagtgggaaacaggatagttgaagctatgtataaggagacttatatttacgatgcgagtagcctggctgagtgcctttttcagcaagcatacttcctcatcttccttttgcttgtttatcacgattccctaaggttgcatatcatcgtcccaccatttgactaaaataggtggacgagaatcctcagctgactgtatccggaggacttcttcttcgtcgccgaccattgggccttaggcatttatgaataaaggtgaaacaattgaagaaagtctgtcagatcaaaatgggttcggaggatgtgtttacttgtgattatttccggtcggggacgagtaggcccttgtaatttaacaagagagccggaccctagatcgacgctggcatcctttttaggagggctgtcagcttgagtttctacttcaggaatatctttgtttggttctgtacccgactggtttccagtcgggggctcctgattagcaccaaccccagtttcggccgactggttcccagtcgggggctcgttgctgggttctacattgtcggtcgccggttgattgtcactcgggtgatcttctgcagtcgggtgatcttcttttgaagaacccgtctccatgtcagtcggttcagagtcttttccagaaagatctatgtcagatggcttcctacgagtttgagttatgctatcagtacaaatcggagcgtcgtttcgtcttccccgccgagactctcgccactttccccatttcccgctacagtgcaaaaccacaccggcggaagctagggttaacaaatccactccaatccatcctcctgagctccacaaaaaccctccacgcaaccaccgcaccgaatccccatccatttccagccatatctcggaccaaatcacaccatccagttcgtattcatgacggaagagagagaaagcttcgagagtcagtgggcgccctccgatgtaacagaggagaatttgaaagagatggtggcgcacggcgttcttctggcgaaggagatcattggatggcgtccagcattcggcgaagcattcccgacccccgacacacatgaagtcgtggtattttctcatttcttctatggcggattttctcttccaacctcgagattcttccgggggatttttgatttctatgggattagtttgcatcacttaaacccgaactccatagttcacatcgccaacttcatacacgcctgcgaagcttttttggacgtcaggccacattttgccttattccgtcgcatcttcttcctcaagccccaaccaaacaagagtaaaccatgcgtagttgggggggctggatttcaattgaggggaactctgagccaaaagtatttctccatgcccttcaaaacctcaaacaaaggctggcatgcaaattggttctatgtacaaaaccccgagcctgcactccccgagtactcctgtctccctccagtttatcaggactcttggaactcacttccaatgggagaggaagccgctcaggcgcttgccctgatggaccgtatgctgaagctgaaggagcaaggtctgcaaggagaacagatcacccggcattttatcaagagccggctagctccaattaaagagagatcctgtacagccttcaaatttgatggcaaacatgacaccaaccgtgaagatcctgaatctcttgaattcaaggttatgaaggaaagaatgtataaaatcttctcgaatgcaattgtagttagttattcgcacttgctgccagtggtgccatacaacgccttcaatccttctccaccggtatgtattcaaacatttcagcctttctcaaaagcatgcctttatctgctgttaagctaattgaaaactcgaaatgttatacccaggaattcgctttgatgaagtcggatcctccaattgctcaacgccgatcaccccgctggcgaactggtcaggcgagtggaggaccaaaaattcagtctgacactcaaacaaacacctcgaaatcaaccagtcagtcggactcccgcaagaggaaattggttctgagtgatgatgaaggcgataatgctagaaaatctggcaataaagaggtgaccgggaaacaaccaaggcaaaccaatccgaagaagaaaacatccagtcgtcccatgccgatttggtccgagatatggctggaaatggatggggattcggtgcggtggttgcgtggagggtttttgtggagctcaggaggatggattggagtggatttgttaacccttgcttccgccggtgtgcttgcttctgccggtggtggtttgcactgtagcgggaaatggggaaagtggcgagagtctcggcggggaagacgaaacgacgctccgattttggcgtttatttcgctagggtatcgggagtactaatgggcctaggcctaaacagtacttcagcccagttttgctatcagcgtgattaagttgtgatccatagggacttaggcatttgtttttgtttcgtcaacacttgctcacaacagtatagcccaatgctgttaaaatcctttttgacgcagttagataattctttggaattactacgatgcaaataaaaaggtgcataacataaaagtgttatactaattttgtaggcctttttaggctgcaaagattgtttgggttttcttgagatgactggttttaatacagtcatccactcggcatgttatatgcttattttgattatgtcatgagtcatagcctaggctatttagactcgtcttttatcagattttatgccacatttgataggtcttttgagagtttttactcggacttttatcatctgtgctgatttatgaacctttggagtgcttctcacttgggtttttctttatatttctttggcacattaaagcagtcggcggaggtttaccagatgctgcatatgcttggccttgagatatttatcctggaatcctttaaagggtgtcgaaggcatattttttggcctacgcctaatatgtctgcagcccatattttcaggtgtggcctatcacgttcttttagggacttaagcactttttgcttatgccaaagtgcgcgtgatcaagtgcccaataccttaaattcttttataccgcagttactcaactttttaggagttggtacaatgcatcttaaaaggtgtcaaacagtaaagctttacatagctggcctactgacttttttatatagtcaaggtgctgtttgggtttataaagcagttgattggatataatatcattgctttttgccacgtaagtgtgcatttttattaactaatattatggctttggctgattatatattgtggtcattttccaggcggttggtaaatcgtttacgagtttatttactcggatgttacaccacatatgccatatattttcaggtgtggtgaaatcatgtgtcttttagggacttaagcacatctgttaaagaagtgtgctcatggtgtatgcccaatactttggaaatttctttattcacaacatcaagctcttctttatagctgttttgctatgtgaatttccaaaaatgttgtcaactttaggttgcacgcatcatattctgcaaagcagtcggtatatcacttggatcatattatttgggggattcacactgcatatgctatatattgatatcaagtcacttggttgataacaattatcaaaaaccactcggttggttggattatttattccttgactatatgcttagtttgttcaactaaccatatagtcgagggctacacctaattaggtgcatctagtcgatgcacctgattttttctatttttcagcccttcacagtctttgattatattactcgggagatcaaaacagatgaagctaaagcactcggattgtcttttcggattatgagagaagattattccgtcgactgtaaaggtctcaggggctactgtggagattatggataccccattcctacacggcatgtatatccgactgggtatggggtgtcatgtatagatagaatatctttaaaaggactcgggttaattaccaaacttgtatgtcaaggaaatacccgggatcctagtcggttacgattgtattttatctgtaattacctattccgttagggatatggtttgtactttgtaatacggaccccttcccctatataaggaggggtccgggtgcctctaggggcacgattttctcccagatcatacgatcaataatacactcggcggatcaatccccggacaggagtagggtattacttcttgattaagaaggcctgaacctgtataaaatcccttgtctctgaacccatccacttttctagcttgatagccacccccttttagtattgccaaaatcttgtttcgacaaaaaggtaaagcttgttatagcggcttgcgttctcgggattagtgcttacatcttcatgacactctaatcctgtttatataaatcgtcgagttatcatatatgctatgtaatctaggtcgatcttgctacctaacctcagcggctagcctctatcatcgaaaacagtcgacatggttagatactgacttcgaattagattacatagtgcatctaccatcttcaaaaggttgccatcgacttgtttaaattttatgcttctttctatgtttaatgttgtatcagttaagtttgatccattaaagcattacctggaatcgtaatatctagcttgtttcatgactgctactagagatactattggggtttcagccgatcttgcctgatttagttgtctcgttacttatatgcttactcgacatactgaatctaccctttatattaagatctcttttgaatgaaatatattaaatttgttggtttattctaatgagtaacgagtggtatcggagtattagtcgatacgcattagatttaccctatcagctatgctatgaatatgtataatctttactccaaagcacttttaagcgcaagtaatttatactgtctcggcacactgcccgatctatcccaatcgcttagcttaaatatattcttgaaatatagattatatatcattgatatctacagccgatcgagtggatctaactcttttctcgttacttacttcattgccgatctgacctgcgttacatcggcttggtgctaaatgatatgtcatcggcagtccagccgatcggctatcgtttatggatttaactttggattctttgtttcttgttggttgcaggatcaaactaactagcacgccctgaacctgaaggcaaatctttggacctgcactagagtaaagcaaacctcgccagtgtgtgtttttcacatcaacaccttccaatccttgtacacatgtatgattagcaggaggttcattttatcgcatgtcgggtgcatttttatccgtaaatggcctgcatacgtatatttaccaaaactagtggaaggggcagtgatgtcgacgcataatgggcgtagctgccaacatgaatttgccgcgttgaacgacggacttgacgcatgcattgcgaacggcacgggtgcagccgcaactacaagccatagctcctttcctttcttcttcttcttcttcttcttccttctttcttctttcttccttctttcttttcttctctctccctccatggctgatgccaaaaagtggctcggtcggccaatgacagcgtgacgaccgatggctcgatgcacgaaggtgcactcgaccatgatgggatgagctcgcacgggcttgtgtctcgcgaacgacgaggccacaagacgagcgtggaggccgactgctagtgcgtgatggcttgctcttttgcctgtccctgtctggaacgatacgacacatcttgtgtggagataccccaatcggcttgcgccggcgactccaagtcgacagttgcggtgttcaccaggaacggcaaaaacaaaacgggatggagagagtatttcattttcgtaattagatcagcgaatgcaaaacggatctacgagttgtcatccttctatgtgaattagaaaaatgtgacggtgatgtcatagatctaattttacaaaatttcagtggcacccagccaatatcacgaatagtagtggtatttttctaatatagaaaatttacgatgatatggatccaatctatactttttataaagttaaagttatagtccactaagttcaacatgctaccacgccacatcattacccactaccaaaaattacatattcaacctcatgcaaatatacaacatcatttacaatttatttaattctacaaatcaacatgcaatcatatccagttatcacctctcacaaatctatctatcatttttatagtattaaacatatagttatcaatatgtttcacattaaaacgcaggtatcatctgtttgttttatgataagtactgataaactctgatgttttattattttttttcttttacttttagcttaattgtcgaaaaaaatattgagaaatacttagtaattttcgtggcaaaacgtgagaaatcatacagttaacccatccaaacagtccgtaaagcccgtaagaaaaatggcatatgagaatacacattcggggaggatatggcacagggttttaaaagaaaaaccatcaaattaactcaactcgccccaaattttcgaggggagattttttttttcctttttaacgtttttacacctcatcatcatcaggcctttcccttccctttctcctttctcgttgtgtgggttctttctaggccctaggacaagccaagaagcggcggaggggaagggaggaagagggcaccagccgcaccggccggcggaatggcggcgccgcccaaggcctggaaggcggagtacgccaagtccgggcggtcctcgtgcaagtcgtgcaggtcccccatcgggaaggaccagctccggctcggcaagatggtccaagccacgcagttcgacggattaatgcccgtccgtatcctttccctccacccgctcttctcgccgacgatctttctccgttcagttgatgaatcttgctttgatctttagggtctgggagggtagggttttggtgtggcaggcattttttcttgggggttttttgtaagttggggtggattctgagaattttctggattgatgggtgatcggttttcatcctgatttgcattgcgggtgtgggtcttgtggtcatctgccacaagaatcttctgctttcatgggtggttgggtttcatcttgatgtgcattgctaatgtgggttttgcggacatttgccataagaatcttctgctttggtgggtggttggttttaaatcttgatgcccgaacaaaatatgtttctgagggtaatttcgcatgattttgtggggtatgatcgaaccaatcttcttcgaatgcggagttcttgatgcatttggnttggtgctctgtcgatttgtcgatgatccgtcaattccagcattgggtttattgctgtttctaatccattatgccatctatatgtgtaacgcaagactagatagaggtgcttttgtgggcaccaactttgacatatgcaatttaactggtatttctcctaagttgtttgatatattaattattatgcggacctgccaattggttgtgctgttttaggcttttagcatggcaatggggcataccaatgacaatgttagtaatctagtgtgttcgctaatctgtttttgttcttatctgatgtgtagtttgcaaattataatctaggtattcgtttgcccgctttattttctagtttgcctcttgtaattgttttgtgggtgcatgtgtattataagtgcttacctgtattaggcaagataaaacttggaggggagtccttattctatttttcattttttatattgcacatttggataatgaatctttatttcttttggtcggatcaactcagtactcatgtggttatgtggactagacactcaaattatttcactgggaaatgtaggatcgtttagggcaacttagggggtacttttggatctgcatgccatttttcacctgaccatatctttttattttctgtgatggcccttattttttacctgaccatgttctttaatatggagtgtttataacgttgtaccttttctatgtttatagtaattgttttattcaagaactataactgtttggaacttttttttggtcatggtagattctcgatggtgcagaagagaaaactcgatggttatatgacatatctttccatatcaattttacgaattgaccacttccaattaattttagtgcccttttctctttttcagatgtggaaccatgccagttgcatcctcagtaagaaaaaccagataaaatcgtatgcaactttatcttttactgtttgcatgagtttcacgctatagtattatggtttattaatctttattgcatctattggaaatctgacctaactcaaagtgtcgattcttcatttcaaattagtgttgatgatgttgaaggaatagacacactcagatgggatgaccaagagaagataagaaattatgttggaagtgcaccagctactgcaagttctgcagctgctatttcagataaatgcaccattgaggttgctaaatctgcccgtacttcctgtagacggtgtggtgaaaagataaaaaagggaacggtctgtatcttttgatctattaattttttatatgctttctaattcgtcccttgaggataggaagttttatgccatgaaaattttatgtttgtactttgttgcttttcaaattatagtcatgaaaataacctcctcttgatgattaacaccttacagtcttatatgagcattcagctaacaatcatagataatcagaagtttcacattcttgaatgaaccttgatgcagcatgtaagaataattaatcataacatgtttcctattccttatagttactccctgggaaaaatactgtattgtccaaaattctgcatgttactttgttgttctatactttatttatttagaacatgaactttagcgctcactaaggatgaaatggatacccgacttggtcctagcacttgaacacttgtagctggggaggttaaatagcttccctaccactatgccattggcatgttcttttattttctgaacttgcatctgggaaatgtatggttctgatacgcagggacaccataggttcttttctgtaccctattccctgtggcctgcatcatgttgcatataatgcccaagcttttgcactggaattccaagtgaccagaaagcctaaaggccacagtttcccatttattttgtagttactctgctacgtgccactagcaagcattagaactctgaattttgtgttaagtttactttatcaaatgaagtaacctgcaaatgtattaattggaagagtatttattatgttcatatttcttattcatccacactcctagttgagtactcctaatgaattacaataattaccgtggagaattatatacaggaaaatgtttgatgatccagaagtactattagtcatgcacttagctaataatgtatgttttgaaaacatatgaattgtaactgtgatatggcaacttgtaatgtaaaaacatggtctttgtcttcactctaagttgtttctgtaatagtattattatttgtttgtctaggttcgtgtttcatctaagcttgaagggcaaggttggtatcacgccagctgttctctggagatgtccccagctgcaactgttgagaatttctcaggctgggagatcctgtcgcatgaggataaaagagctgttcttgatcttgttaagaaagatgcccccagctcaggtaatgaaacatgggcatcaaattttcttcgcgccacttcgtaatctgacttgatattttgtattgttgtttctcaagggcaaacatcttctaagggttccaagcgcaagaataatcagaatgatatacacgactgcaaagctcccaagataatcaggagtatatcagaaggcacagcagaagataaagggaaagctgttgtatcacatgattccaatgctaattcttctgatcttcaagaaaagcttaaagagcagagtgacacactttggaaattgaaggatgaacttaagaagcatgtgtcaactgctgaactaaggaacatgctcgaagcaaatgggcaggatacatctgggccagagcggcatctattagaccgttggtaatattgcatgctatttgtgaaatggtttttaacttcctggcttcctgcactacattatttccatccaatgagtaattgatatttaaacaaactgcactacaaggatcccgcatataaatatatccttggccagttggccgatgctacttgatagaggagggtacgattataactgatgatgaatggtactagtgtacgaaatttgtcaggatagttgttccccaagaccccaattggtcatctatgtaattttttgtcgctagatttattttctgcttgctttctggatcccaaatcccagttgtaacatcctggttatagggtttgtgatactgatcgcttagtggaattcagaattgtcaccgtaacctaatgattgcacactatttgctttggttcttttgtaatctggttcatgtatacaattattatttccttaaaagtggctataccttttctttctaaaaaacacattttaaaaatttgatgtgtgcagagaaatttcaaagtcaggcagcacttaagatatttgttttcaggcaaaaattgttcaatagtatttaggtctgaattttttatgtataattcaagggagacaaacattattgattgcataataagctttacaatattgttggttgcgtagacctgctttgggcatttcctttgttcatctcacatagaagtcagtacacttcgtcgctaactttcttcctcgtctggcagtgctgatgggatgctttttggagcattgggtacttgcccagtttgttctagcttcctatactatcatgggggccagtatcattgcagtggctatgtgtcaaaatggtccaagtgtacatactctacgacagaacccgtgcgcagtaaaaagaaatggaaaattcctgacgaaatggataatggttatcttacaaaggtatgactatggctccccacccccacccccacccccacccaaacccaaaagaatatcgttcttaatgcttggtttctacagttgaggtaagcaaatatgtatgtatcttgcagtggttcaagtctcaaaaggctaagaaaccagagagagttcttccgccaatgtcacctgagaaatcattgtgccaatcaacccagcaaaaccgatctttccttagtgaaggactggataaattgagagtttctatagtaggacaatctaaagatgtggttgtaagtgatcttttactttttggtacagttatcctcaggttctcttgtgagttgtgttcgttaaagcaagcaccaattatgccatgaccttgctgcatgttgtggcatgcaccagacgccctttattttttccaatcacagttactttgcttacattgttatccagattgattcttaccatattatacagattatatatattatgcatatttgttgtgtggcttgttgacatgaaattggaaagtgctcaactgtacatgcttcatatatttgtttgtttaagtcaattccttgaagatagctagtttagtttgttaatttattccttgagttcctcgattatttctttaatctccaaaaattttaatccatggaatatgcagagtgaccacatttagattgcagagcaaaggttaggagagtgtaggttttttccctatgtacttgattcagttcatgttaaattcatgtcatttgttgaataatagatcaaattttatatgatctagcatgctgcttttgcatcaagtggtaagatagatttgcaattatttgcatgggatactgttttcttttattttttcttctctgctgatcagttattgggctatacatttttctttttcttgttttttggtttgtactttgtacattcctctaaactaatcatgtaatccaactactgtaggatggatggaaacagaagctgaaagatgctggtgccaactttaatgccacagttaccaaaggtttttcctcgtgttatcttttttttttctgaactacacaggatttcctcgtgttatccagaactggaactatcttgttcagacatttgaacctttcatatttggttacgtatgacattggaacctatatcttcacccaagtgggtgagcagtttgacaccaccccatgaccaaaagccaccactcaaattcctaaaattggctggctctcacgtatgtgtaattttagactaatacatgacacttaatctaactgatgttttgaaagtataagtaaaatgcattgtctaactcatgattttttatgggagagatggattatggatcacttatgtgcaggtgataattttatgttatctatctgactgtctctatttctgtaagaacatatgggcattgagccagtatttttgtgcagctgatataatgaactgagtcatgtgacttggtcattgtttcataggttaggtaagctcttagtgtttggtgaaatcttttcgcattattttcacatggaagtcttgcactgcagacagcagctgcttagttttatgtagtgagcttgagagtgagaatgctgaagtcaagaaagcaaggtatcacattttactttgcccttatccttttacacttacagtttgacctattgttttgcgaactactgtgttacctattgttttgcgaactactgtgttaaaataccattatatatgctacttcatttcaggaggttgaagataccaattctgcgagaaggttaccttggagaatgcattagaaaaaacagagtgcttccatttgatttgtataaagtagaagctgcattggaatcttcgaaaggaggcacaatgactgttaaagttaaagggcgaagtgctgttcatgagtcctctggtttgcaagatacaggtcatattcttgaagatggaaaaagcatatacaatacaaccctgaacatgtctgacctgacacgaggtgtgaacaggcaaggattttgctcacagcatttcttgtcaaattcaggatttgcacttttaggagtgattgtcaaggcatatttcatatgagtgatatggataaaccgataaaccctccagcaattttagtcaccaaacaaagaacgtggattgcttctcaaatccaacttcccggtcttcccttgaactaacagaatgatataatgctaaatttcccatggttgttaagttataatgttgagtcaagtgcaaccatataaaatagcatgaacattttggaagtactttggtctggtttggtttggtttggttttcattacatatgcccctgaagtcatagccctcgtctcttgttcaagcccaacttagctttggttgtcaatcattccacgatgtctcgtatacatatatgaatcacccgatctagaatgtcttatttactgccattctgcaataaaaaatgttggagcttgcacaaatttctgtttcctttcctctcaatttatgttcgggagcataacacactgttgaaatgagggggaacttttcttctgtagtattaccagttgctaaatttctgttaggttattgcaaataatggtgaccctgcttgccctacttaatcttttaacagttctctctctctctctttttggctgggaagctattatatacttcaggtcattgaagaggataatgggtctgattgttatgtattccgaaagtggggacgagttgggaatgaaaaaattggaggcactaagttggaggagatgtcgaaaattcatgctattcaggaatttagaagattgtttcttgagaagactggaaacccctgggaagcatgggaacaaaaaacaaatttccaaaagcagcctgggaaattttatccacttgacattgtatgttgtgggataatgtttttacctgctggatttttttcccctttttagtggatcatgtggattcaatctgatgtgtttaatatattgcaggactatggtgtaaggcaaggaccaaagcggaaagacattgacaaaatgaaaagttcacttcctccccagttgctggagctcatgaatatgcttttcaatattgaaacatacaggtgcgattttactgttctattttcaggttttgcatgtgcacatgctttgtttttagtattagaaaagaatttcacattattttgtaccagggctgctatgctggaattcaaaattaacatgtctgagatgcccctgggtaaactaagcaaggaaaatatccaaaaaggtgtgatactttgctcattgtggaactcattttgttgatctgtaagtccaaacatatcatgattctcttgcctgcactgcatgcaggttttgaagcattaactgagatacagaatctattgggtaacactaataatcaagaactggcggttagagagagcttgatcgttgccgcgagcaatcgtttcttcacccttattccttctattcatcctcacattatacaagatgaggatgatttgatggtgaaagtatgtgttcattaccttgtgttatattcctgtatattgggaagatattccatgactattcttattttttaaaatcacgacagttttaagtgaaatattttgctataaaaccttccttttgcaaaagaataaaggcgttctatgatcattgctgaaattgaaatgggtccattccacgcacagatcgtacatgacttgtaatgatatcttggcagttaggcatgttccataatgctcaaatggaatcgaaggaacacaaaaattgttatttattttgtcatatataaatttggcttccagtaaactatgttattgaagtaaaaaaatgtattttcgcactactttcatttatggttcaagttctcaatgactctcattttgctatctagttggaacattttagaggatgttataataaaaaactaacatacctatggcatttttccttttcttttcctttggttcttcacatgttctccttgccattagatacagtgctgttcttaaatgcaatgatatctcctgcatattcaaggaaaaatgtgttataactgtccaccgtttaaagggctgttttggttcttgtgttattttcattcttattttctttgactgatcagatgtatttcttattgccaattgtaactttattcagagacccaattgactgtaactttggtgcaatggtgcaggtgaaaatgcttgaagctctgcaagatattgaaattgcttctaaacttgttggcttcgatagtgacaatgatgagtctcttgatgacaagtacaagaaacttcgatgtgccattacgccactccctcatgattgtgaagattacaagctagttgagaagtatcttcttaacactcatgctcctacccacaaggcatgtattttcttctgtatacaaaaaccttatagttttttttttctcttttgtagatagtacaatacagacgattgtttctgttttcttctgtataggtattgacatgtcctctttttaaatcttttttgaaggagtggtcactggaattagaggaagtcttttcgcttgatcgagatggagaattcagcaagtactcaagatataagaataatctacataacaagatgttgttatggcatggtaagcaatctatccaagtaatgcaaacacatttggcttacgcaatatttgaaaaggtttttatactctcagtatttagtgccaaaatctaggtttgagatgaaacttattatccatgcgcagtctttgccatggcagtgcgtaggtgaacagagggttcacagtcaatccaacagttgtaaatgtttattttactagttcttcgtgtggtttactcgtgttgtatgttatgttgttatgtcagtatttaaaaggctactttttttgtaattgtactggagatctacttaacgtccctaagtaactctttccttcctaccatttgaatgattccatgattgcaaaacttaatttataggttcaaggttgaccaattatgttggaatacttagtcaaggactaagaatagcacctcctgaggctcccgtgacaggctatatggtttgctctttgttcacttcataaatggttcaactgtagcactggcaaaagattggttgaatttgattaagctattttcctttcaatcaacagtttgggaaaggcctctactttgcagatttagtaagcaagagtgcacaatattgttacgtggataggaagaatccagttggtttgatgcttctttccgaggttgctctaggtgacatgtatgaactgaagaaagccacggtaagatataaagcctctcactaccaaaagagaaattctggttataacattaacttgaacttctatctttgctttgaaatatgatcctgctttaaggaattgaccatggcatttctttcctgatttttttattgtgatctatatttctttgctgattcataattataagaaaaagctcaacgagttactcgagtgcaattacttgttttttttccccatgtttatcttggcttggcaccacactcactggcttactgctggctgctgcagtccatggacaaacctccaagagggaaacactcgaccaagggcttaggcaaaaccgtgccgctcgagtctgagtttgcgaaatggagggatgatgttgtggtgccatgcggaaagccagtgccagcatctatcaagacatctgagcttatgtacaatgagtatattgtctacaatacatcccaggttcagtcaaattgttatccatactcttttgcgcgcttctgttcatcagaagttcagttccttacctttcacgaaaccttatctctggcaggtgaagatgcagtacttgttgaaggttaggttccatcacaagaggtgactagaagacttgaggtaggagtagaaatgtagaattaatcagtggaagtatctccatcgttatcagtagtctgtggtggctacgcttttgatgtgttagaatgatttatccagtagtttcaggttggtaggaggttatgtgctgctcgcgtatgatccgttttggggtatgttgcatgggcatcgcgcgagtggcgcaagtaaatcccctgcgcatgccatgggcatttgatagatgtttgcctaattttctgtggcaatgtgcgcatttggcatctctgtttagcttgctattttatcatcactcgcgttatttgtgcgttgttgcgttttggctatctttctttgtattttgattcgaggtctatgttaggatactgcaatcgaaataaactgaacagcattagtgaatagtgccgtctgtaggatcaaagatagaggcgtgtgactgtctagcggaagtaatattcttctatcctataagtaacggttagtctagcacgacaattcgatgagcatagattgcaatagtttttccccaggtattagtgatttggtaatctccgcttgttttgtgcccttctttcactctggtttgtcgtcgtccttcacccttcgctcggggtgctcccacttcctcttagagagatcacttgacttgatagccacaaagacacgttatgaccagcatttagcctcaaagtaatatttaaccatatgatcaacaatatatagaacttatcattcttgaggtgtggccgtcatgagtttattccaatcatattattagaaaacagtaggcaccgcacgtgaggctcaggcgtccacgggaactgccgacggcgcagcaggggcatgcaggatggccttgggctcgtgctcttccttctcctcgtcctcctccgcctcggcctcatacgcgtcacgttcctggacccagagctccgcgaactcgcagttcttgtactgctcgaaccacggcccgccggaagtgtaatggatggcgcgcggcgccgtccccgccgtgtcggcggggtcgacgcggttgtgccccacgaggaagttccacacgaagggcacctcgccgatgtcggcgtcgtccagccacatgaagcggtgcaggtacgcgccgctctgcgtgctcacggcatcgggcgtcagcgcggcgcggttctttgagtgggcgcttttgaacagcnccatggacgaccagttcttgcgcgggtccaccgtttgcanggcnccgtccatcttggtggcctccttgggcgcgtagtcgtggtgcacgcacagcaccgcgtagcgcgggtcggccatgcgcgccagctccgccgcggggnaaaaccccgggtttttnccgggggcgcccggggnaancggaagagnnnaagttcgccagtcgacgaagagcgcccagccgcggtagccggccaggtggggcgtcaggaagcgggtgaaggagaactcggtgctctccgtgggcccgcgctcccgccagtacagccccgcagaccggagctcctgctgcacgatcgggatcacggccaccggcacggaggagcgctgcagcagggagcgccggcacacgcggtacgcgatgtcctcgcgcgagtcgtacccgacgaacacgcggaacgtctcagcggcctgcacgtcgccggcgccagctacagggccagtcatcacgacgtcgttggtaggcgtgaccgacatagtatttgttggtgatatataagcagaaggttagtagtactgtttgctagcttccccgcaaaaaaagaaaaaaagagtagtgtttgctagctcctggtgctacgtacgcataggccgtgcgagttatcacaaactcctccgcctttttaataagagcctaagagccctttgtcctttgagtgtggggagcgaattgaaacgaggacatgcgtatatgacgacatgtacgtcaacagcgttacgcttgcattattaggcccagggagatcgatgtccagaattatgcatatgtgtttctcttcttttgttgccaaaatcaacaaaattagataaaggaatcctatagctaaccgattgctgtgtggtccggcgccggcggatgcatggcgacactgcactgtggtgtgggcagcgcgcgggcgggaccgacgacagcgcgcgcgcggttgctaatttgtacgggtaatacgtggtcctgtcgtgtgaactaccacagcagcacggcaggaacacgcgcagctgcatgggcagttgggcactctgcctccctgcgtcgattgctccacagtcgtcgtcatgtcccgatcctaattatcacgtcaaaacagctaggcaagtgttgcttgtttttttttttagataataagtgttgcttgttgctccatcgttttcctttttcaattatatatgttattattcacattttcactcagtattttattactaccttgtagaagtttatcgagaatgcatatagtcaagg
